United States Patent 7,868,149 (PLANT GENOME SEQUENCE AND USES THEREOF) - sequence listing, part 69

SEQ ID NO: 37865 - DNA, 14525 bp, Oryza sativa
aaccttcatttaatggccagcgacttccttgtcatactgcgctgaagcctggaatggatctgaccgggactgacataccaactccaggagttagcacgccggctccggctagggacaagagccagaaagctcttatcattccgacgggacggggcgaggcgtgtgacaggccgcctgttgccacctaacccgcgatctgaccgatctgtgaccggtcacacaccgcgactggtcacggaccggataagcgtgcgctgcgccgcattgaatgcagcgtggtgcgctcgtccaacctgctataaatgcggttaggtgagccccgctgtgctcacctaacccacacatgtggcgccaaaaccgcagggggtcggggcgccccagccctcggggccgaaacgggggcgccccagccctcggggccgaaacgggagcggtccgacccctcggggagacagagggaggggtggccacgtcatcctcgggcccgacccccccagggggtcaggccacgtgggtgaccgcggctatccaagcctctagtcacgatacccccagccccatgtcaccgacaagtactattctagagtataatattgtagtgtttaacatgtaaatatgtcaaatcatctttctcacatcattttcacaatatttcaatattcattatttatataatatttaacatatattcatctatgcgtttcgcagcaaagcacttggtatcacctagtttaaatataagaaggcctataagattttcttttaaaaactacgattatgcacgactgttttttttatgacgaacttatatcatgtgttgtgtgtgacgtacatacatatgtaatttcaggtatgactactgcttcatgcggtacaagaacgccaacttcattggacaggtggacacgagggtggacgccagcgtaagaattaggaaagaagaaaacatggacaaccctaagacgttccaaaaggtggtggcgaagacgatggacaaataccccaggcggtggcgaccgcggggagtgccgcattgggaagggtgaaggaaaaatacatgacgtttgtgaacatctacgggctgtcgcagtgcacgcgggatctagcaccgctggcatgtgcccaatgcctgtcgacggcagtgtccgacttcggcgacatctgcaacgccgcggagggatgtcagatcgaatacagcacctgttgggtgcgctacgagatttaccccttctattttccgctcaagactgacgggcgagccaccactgacatgacgaagtacaccaaggtcgttgtgcactgataattaagtttacaactagttatgtaaaggattatgttgtaacgcgtagcaatatacatataattaatttgtgggtgagatcttatatgacctctttgccacgatttgaaatggttctagagttaagtaaaaaaaagttctagaggacgaggtctcttataattctttgatttttcttgcacattgtctacctcccgtgtttgagtgtctcctctcctaagaccccaaccactactacacatcgatgtcttgctaacttcatgggtttttgttcaacaaaaaacaaaaacctcatgggttttaactgtgactctgaggccggggatattcgacctgcccgttagtaaaaccgtgctctgggcccaaacatacaggcttcacacctgtgagccagcttgtcatcccgaatcgccgtgagacggtgagagtgagagggggaataagatcactttgactcccttaactgaccatcgaatctaaatcgtatccctcaactgcaatatcagaaatcttgacccccgaacttgcaaaaccggtgcaatttgactctcctggtagtttagggcggtttcactgccgtggcgcacacgtggtagtgttgacctggtttttgttccacgtggcattgacatgacgcttatatggcattaaaataaaaaaatatatgcgggacccatttgtcattcacacaaaaataaaattgtgggacccacagacatgtgggaccgacatgtcatcttctctctcactacccttcttcctcatctctcccttatctctctctctctctccccttgacatgagtcggcgacggcggcgagcgggtgccggagtggtggcagcggtgggcggtggacctcgggcgacgagcgtgggagcagctcctccctgaaatgggcggtggacctcaggcgacgtgcgacggaatgcgtcgggggagatgggagaacgctcctcgtcccagctctgtgtcgtgggcagtgagttgggtggcggccgcagcgtcgacggcgaggtgggcggtggccgcggtggaaagagagcgatagctcgctgttaacagtgaaatttggtaatcggcaaagacgtcatcggcttagaatcattatcggctgcagcatctcggaatcagccgatgggagttatcaagtcgccaatagtcggattcctgctatattcggttaaggaaatcaatctactaaaggaagcttatccctaagtgaccgagtttaaagaggatgcggtatgtcagtttatctattaattaggaatagtttgttagtttccttttatctttaggaaagtgtgtttagtgtccgataaggactttatcttttcctttttagtttctttcttgtccgacaaggacttgtatcaacccatgggtataaatatgtacacccggggtctatgtaatctatctctatgaccaatacaattcggcgcatcgccaccttttaccttttctactttattttatcgcccagtgggacttggcacccgacgtggggctgcatcgtcttcgatctccggcgaagggataagtccaatgttccgtcggtccaggcaattgtatcgtctacgttggtgtcgttcaaggctgcatcagtacattcgacctcttggattactctgctttggataatatatttgcctacctatttatcatatgtctctgttaatctagtcttagcatatcaatttagctctatcggctgcttcccgttttagggtttctgccggtatcggctaaatcgcgttgctagattagattagcttagacatctaccaccctgaaaactcagtcaacggcttgattgtctagatattatgtttctttttatacttagtgctgcatcagttaagtttgatctactaagtcgtgcttagaaccataatctctagcctgcttcttgattgccaataagggtttcatcggggtttcagtcggtgagttatctagacgttgcatcagctcataaggattgcatatacatataagttggatttagccgatgacaacaaaggcttcactgtttaatctagtcttgtggatttcatgacatcggacctccagccgatgtgtgctttgaccttcggatcgatgtttatttatcatatcattatttgctgattggtttatactggactatattattgttatattttattatcggtagccgattgcctttataccattatctacattggacgtatagccgattgcttaaaccctatcgctatcagctggtatcggcatcggctattatcggcatcggcttgtcagctgatcggctgttttgatctactatttgcatatcttgtcagttgcaggatcaaactgactggcacgcccgcatctcaacaacctttggacctgcactggagctaagcagatctcccaggctagtgtgttcgattttttcgtcaacactcgcgccccccaatgcgcggtggcgaactggcctcgagcgctccggcgtcgacctgaccatgatgcgtagcgacggctggagctcctcctcctcctccgacacgggccccctccccaaccacgtccgtcgcgagaccacccccttcttcctcttggacttgccgccggccgcgcccgtggcgacctcgcgaaggctgaggaagttggcggcaggagcagggggctcggtggccactagggcggcggggttctcgcgctcctcctcctcctcctcatcctcggtgcactcggtgtcctccgccgtgcacattccttcgtgccaccgctccctgctcgctccctccccgccgcggccgccccgcgccatcatcgctggaatcatcccgctcgtcgctgttgtgccctcaccgccacacccttgctgagcgctgccaccgccgaacctgaatccctgctactgcagcagcggaggcggcagaggcgacgcgaagactgtcggctgccgctccgtccatcgcccaccgtcgccgccgccgatccggacgccactccccacgcacgaagagaaagagggagagatagagaagggaggaggaagaagggataagagagggtggcatgtgggacccacatgtcagtgggttccacaatttttttttggtgtgaatgacaaatgggtcccgcatatatattttttattttaatgccacataagcaccacgtcaatgccacgtggaacaaagaccaggtcaacactgccacgtgtgagtcatgtcagcgaaaccgccctccaaaaccaccaaaggagtcaaattgcaccggttttgcaagttcgggggtcaagattactgatattgcggttgagggatacgatttagattcggtggtcagttgagggagttaaagtgatcttgttccagtgagagggaaatcacatgggctgctcaccgtgtgatgatctcatcaggataaggcccaggataagttactcggaatgctcgtcttgaatgcaatatattgggaggccatggaagtgaatttttgtcccttgaagggacatcttctcgttttatacatgtcgttaaaaaagttatcaaaaaaataaaaaaaattattaagatagatcaatatatgatatatcttgccgcaaacatgcgagttaaaattcgacttatacaattcgaaacaaaaataacaaatttgaccgtgaattacgcgttcaattcatagtcaaatttgttatttttttgtatttgtataagttgaatttgaattttcatgtttatgaagtgacatatcatatattgatatatcgtactaatttttttaaaactttttatgactttttaagtgacacgaggggatatcccgatttgagttttccaggaggccatgcagaatcgcagatacacatataaaaagaaggaaacaatgaaaacgcacagacatggttaaaaatgcataataaatgaatcaaacaacaacaataacaataataaataataaataaataacacaatttttcatactaggaaatctggtatacggatgaattggactgtactatatatatatatatatgtatgtataggatcaggatgtgttcctgccgaccggccggttgatcgacccatgcatggacagaactgatcaccacacgcatatactctgtcctgcgtgtaaaccagctagcatgaatgtcatatgcacatgcgcgcgcgcgcgacgccgcgacgcccgatcactcctcggagagcttctcgagcagcatccgcatgagcttcacctgcacctgcaggtcctcgatgtggctcgccgcgtcctggaacagctcgccgagcccgcacggctcgcggcggcagggcaccagcctcctcagctcccgaacctgcttcaccagcctagggtcctccaccacgccgcccctctcgctcccaccggccatggaccgtgccgccgccgccgccgccttgccgctatgccgccctttcatcctccgatcctcctcctcctcctgatcggctctgctcacagcttcttcagttcttctcttctctctcgcccagcagcgagctaacgaagcaggagcgcagcagccagcgaggacgggagaggccggccgcatcactcttgcgcagtagcaatgagtgcgcgcatatatagccgcaatctttgtttggatatatgcacggattgatacgatagaacgtgcaggcgttagctgatcgatcgatcgatcgatgatgatgatgatcaatcatggcgttgccggtgcgcctccatatgcgcatgtccgtggccgtcaccgcgaaccacctacaaaaggatacgagcgcggcttattctaatggcgccgttgctgcggttggccagacacccgccgattctaatagtgatcctagctaggcaagcaacgttctactactagtatattgcttcgcgccgcacacactcgatctctccatcgatcgatccgtcggccgcgcccggcgccttcgcagaaactaagcagctcagctggccggacggacgacggacggctggcttgcacttgcatgtcagtatgctgcatgcatatgcatgcatccgcttggtgtagctaggcttgtagcgtagtgtatagctaggtagccaccagttttaattcattcgctcggcgttgcaacgagaggggaggtctctgcacatgcacccacatgattcgggctatgcgcgccacgccgggccaacaaaccgaacacacaccaactcaggcatatgaatgcaggcattcattcatgcatggtgcgtcaatcgctcgcctttgtgcctaactagcgaagcgagcgatccgtacgtggcgcccgttcgtcgctgggaacaccctggattattcgcccgcctactgcacctttctgttccttgcaccgatcgcgagtatattttagcacgttaggaaggaaggcttgggatgggctccttgggatgggctcctaatcaggtagccctcatgacaccgtcattccagctcagtctgcgtgtactgatcatgtagtgcagttttagagcgagctagctaggtctcttcttgttgcaacgagagaaagagaaagggaggtggtttatattagctggccaattaactttgctgtgcattattggacgacgtctgtgctcaccttccggcaaactctaaacatactgctaatataagtgaagtttcgaagtcatcatgttatgttcggaaaaggcaaccggttgttgagttgatcataataatttgggccctgatttttagctgattctcaactgaccaaaggccatccagaagcatcggcagggcagacattagtatttcgcattccgaatgcaagaggataaagaaaacactacttcatttggtgccggttgagaaacctccatatatagatgtcagatatcccaacaggcgccatggaggtagtattgatgaggatgacttaaaggtgggtgctggtttaagaaccgatacctttgagttatatggtttgcaaataaaaaaaagccagctcggctcaattcgagccgaaccgatgcttcaaagcaaaaaaaaaaataaatcaaaaaatctaacaaaaaaaatacaagacacataaaagaatcaacatttcatagatcacataatcaaatattcacatcagagaatcaacaagtttgtggaggaagataacaaaatcaaatattcacatcaaagaatcaacaaatttgcggcggaggagccccagcggtccgccgtggcaacgtcacggggtagcaggagcgccttgaggagcagtggcgacgagcgaggcgaggacggcgacggccccgtatggccggtcctggggttttggggccctaggacaaaaacttatatagaggcccctatatatatatatataaacataactaatatatgtatatttatatagtcttataaacacacaacattcgatgtgataaaattatctatatataacattttaaaaaaagaaataaatagcagtaccgagctgagaagacgaccggcgaacgatcgacacgagcgtggctactggtgaaccgtgattctccgacttgctgtttccgtttgtgagacaccgagaagtcgagaagtcaccgagagcgcaggagcaacgagcggcgtgatgtgatcaaggcgacatggcgagtggcgtgatgtgatcgaggcgaagcgactggagtcagatgaagagatcgaggcgaagcgactggagtcagatgaagatcgcttcggctttgctaaaataggcctgacgatggactaaaatttattttctgtattggactattcagttgtctagcttaatatagacctatgacccatggactagaattatccaatacgtagtatatatactatatgtgtataggggccccctagattttgggggccttgggcggccgcacggcctgagccccctccccccaagggccggccctgtggccccgtgacgcaagaggcatggttgacggtgacgggcgccggcactcctcctgctccctcacacgacaaggacgacggcaccgcgttggctcggccacatcggcattgtgctttcccttgtgagggcgctgcagcgtcagcgtgcagcgaggggggcgaggatggcaacggcgccgtggcgcaggaggtgtggttgacggtgacgggcgccggcactctcccactcccccacccaatgaggacaacatcgccgtggggtgcccctacgtcggctcaaccccgtcggcaccacgcttccccttgcggctccgttggccctggaggcagaagggaggaggcggcatggtgaattacgactagtgatttagggaggagaagagacgagaagggaggagaggtgagggaggtggtggcttgggaaagaggaaggaaagggagaggagcacgggctggacgagaaaggaaaagaaggaagaaaagagaataagaagaaagcgaagagactgaagagacaaggacaggaggacgggagataggtatctgttgtattaaaaaccagcacttttaccttgtataaaggtgtcgttttttaatagaaattgacacctttctttgacagaaaagataggtgccggtaccatttaaaaaccgacacctatttataaaaaaggtgtcgatttttgccattggcacccttgcgagtgtgcgtgcgtgtggaaaaaacattataaatgtcggtttagctattccaaccctatagtgccgtctcctttatggctttcttagtcgtcaaatgacatatgaacattatatatacataactgttaaccttaaatgaagaacacattaaggtggatttatgtcgtatcctctaccattttaatccatgttatgatttatattacccttcttcttcgatccagctccaacgagatgacgatgtctccgacgagatggcgacggtctgatcagtttgagtttgtggttagggttaggatgagagggattgcgaaagaggaaagaatattgttggccttaattagagggatgtcaatcagagatggtggcgtggtagtgggagaggcgcgcgataccaaagccatgggagatggatgccaacgatgggctaggtaggcaacgggatgagggatgtcgttcggtgcggataccaatcttcaaaggaacaaattattcattgatgtcactcgaattacaaaacttctagttatgtacctaatacagaagaacattcagtttaattggtatttaccgggtatttttgcttaagccgaatttgagttcacagctgagcgtggtgttgcgccacgcattctcttctagtgtgctctatgcctctagttaacatataagcttataagtttcaccgcgttagctagtactaggcttttgtttgtcaagcttgtattagagagacatactcatggtgtatgtaataatgtgtgacaacgaaacgggcatatgtagacaaaggctttgcccaatgaaattattggtaaggagctttaaatcactagagaagtatggttcaattttcagtagcatcggaaaaaaaatccaaaaaggaactcccatcatacagcacatcggctttgcaagaaagccaatggacgaaacaaattaaagtctgacaattaacatctccgattgaaagatatattgcaaattctttgctggataatactccatataagaatgttttctaagggtcagcgttatacgggtattcccaaattacgcttctgttcaatgtatcatattttttttctagctatagtatacattatccttgtactacgagagatggctctttgtgcttccctacaagaaaccagtgatcaagtagcttatgattatgctccaatgatgcccccttgcatgtacatacgcgtgcgaacttgacaatgtctacgtaaacaaacagctgcagagttatataatacctagattctcattgctaggataaggatgtgggtgggtgatcatctcgttgcaacgaaaatatagtttagttagtataagagctcaaagaggcagcatctgtagaacaagctaggtgtgccgcctttgcatcatgatcccacgtgcatccaatagcagcaaaaccgtaataaacggcactggagtgacccgcacgtatcttcttccagcgcaagccgtttaagcgaggagacagggggcattaggccggcctaaccatcatgaacactccatcatattattgaagagatcaattagagacactcttagcacaagcctaacttgtgtactagtttctgtttactctgttttgcagatcttgcttttcttctctaaagtctggagggaaactattgtaaactctcgagaagatgatatctcgttatttatatgtcacttaaatagttctaaaataattttaaaaaataagatagatagattaatatgtggtatgtcactccacaaacatttaaatatatgtcaactagctataatttaatttgttttctacagctcgtaaagttgaattttaggttgtacgtttgttaagggatatatcacatgttaatacatcttattattattatttttatttttttcataattatatttttataacatgtaaacaataagaaaatattttctcgagagtttaaaaaccactctcgaaatctaaagtacgtaatctcggaagttctgtaacgttttttttccctattcatgcgactactctgagctcacgagagtacgaagctgaggccattggatgcggtaggaagctatctttaatagggttaactgaatccatgtcattcaaaattaccatataagaaaaatattaatactatttgtgattagttacatgtcacggaattttttgaaattaaaaccgcatcatcgctgtcacattttatgtcattatatagaccaaaatgcttctgtatgtgggacctacatgtcagttttatcttcttcctccacccttccctcttatctctttccagttatccctcggtggtcaaagaatgtggcggtgggtgggccatgggtgtgtggcacgggtggctagagagcgaggcaatggtgaccttgttggcgagggaagtagaggtcgtcgaaatttgctctatggatggagccgtcgtgcgagctccccgagggcaagtaggaactttgagatgtcgatggtgttgcacatggaagtagccggacgagcgacacgcaattgacgctaatctcccctctcttttctcactcaggaggagatgcatgagctactcatccttactgtcaggaggtcgccagtagaggtgatgggcggcgtgagcatatccaatgataaagaagggggtggaggggatgggcgatggctgcaggtggtcggcgcctgaaagagcatagatgtaacctagagggggggtatgctttcctgaaaaatacacaaaataatcgtagcagtcaaattaaatagggcccggaacctcctggtaaagaacacatgaacttacgggtagttatatactgcccggaacttctggtgttcttggcttaggaattttcgggtacaccgaaacttagaaaaacgacttgaagattaaattattttctaatcatattcaatcacagggatgcatagaggaataaaagaagagaaaaacacaggcacaaacacagatcaagcacaggagagacaagaccgactttttcccaaagtccggatctcaccgatcctactctccgttgaggaactccgaagagctgggtctcgattaaccccttgcctcacttatgcaaagatcccagaagaagtctacagccttcaaaccaacacccctaggtcattctctagaattgagtgacaaccaagatccatcttaaactccttctagagaagaccacaagtgaggcttgctctactaggacaacctctaatctcagcacaatttccttaatcacttacctcttttacttgcagaggtgtggaataaattcacaaactttcctaggacatccacaattgcaaaggaaggtcgcgggtgacacctaaccgcctaggagaggatctccaagagtaataaggccaaagtgacagcccacgaggtacccaaagtgctcacaccttcctaaccttcaatccttctccaaatcactccaacaccctcatcaacgctctcaatctcactataatggctcaagatttgggtggaggaagcaaaaggatcttgggagaggctagaacagctaggaggtgaaagaacaaaagtgaaatggccaaagagtgagcgggagatgaaatccatatatatataacgggtaggtgacgccatctagccgttactcacatttttgaactggaatactacctggaagttccagactggggtgccaggaacatccggccaacacttaggaaaaatctcaatttcacctagtggcccagaagttccggacaagagtgccaaaacttccgggtgggactctctgtcctgggaggggctattttcaaaaataactcccaaaaatagttcaatgagttgaagagcctaagagcacttagggaacctcagagcatcacttgaaacccctcttaatagtacagtttttttcctaaactcgaagcgaaaaataaaactagcctaaaccggctccggttcttctcaccacattgaatctgaagaactggtggggggggtctccaagcgtcctagccacctcgtaagcaacctgggactaatctcttgtacttaagctcaataaaatgcattagttcatttaaccatttagtcattaatcaccaaaacccactagggggttagatgcactttcaacgtcggcatcggagtcagagaagccagggaggttgatgcagcgcgggctacaggagaggatgcagatctaacaacgatgacgaaaaacgtgacgacgatggtatggttctatttcacaaaattccaatggcacgtaggagatatcacgaatagtaatagcatttttataatatagtaattttgcaatggcatgatccaattaaccccttttaataaggattcttttattaataagatgtttatgagtcttaaaaaaagtccgaggctgagccacacgtgtttctatagagagcatatgattgatgaggcattaaaaaggttttttttttgttatgcttcgaacggtatataacctacttaagggattcctttaagaaaggatgtagccagaagtagaaatagaattggaaattcacctttgtatccgctcttgagtttttcgttagtctttgagaggtgcataccattactactaggaggtatatatctattgattagaactacaaagtatatattcctttttacactacaaaaggtgttttgcagagggcttccacggcgaggttgtgtggtggcgtgttgggacgaagtcgaagctgcttgtcggaagtggcaaaatcagcaatgataacccttttctgctttgtctcggcaccgttatggacttgtggcggctttagtgtagttgaaaaagagggggaactggctgaaagccgcacatgtttttttactagtgccaatgacgctgtgacacccataggcgtcatcctccttcttgaaggtgtatttatttgctctcttccttctccttgccccgccgatagttcacactctaagtctagtgggagtgcactcgtcgatagctgcctgatcaccttagaagaggattcggcttcctgatccttctcattacctggaatctctggttagagaggaccgctcgcgtttttgatggggtcctctcccaagtggatacggttattgatcacgtcgtgcaggaggggaggctctgggtgaaagcgaagctgagtccttctggagttcttcttggcatatatagtcatttagttttttcttttcttttccatgcgattttgcttgttcagggtttggttctatctagcttagctagctgttgatctccttttctccccgtgtaaaccttccatacccgttacagtagattatagttgtacaaaagaattttctcgtaatattaacatgtaaggttcttgcgtgttcgaaaaaacaacgaatcagtcagcgagatatcccagcagcatttcttcgtaatcatgcatatcaaaaggtactgaagtagcctcgttgcggttaaccaccatatataaattcacgtgcttcctgattagttcagtttggggaacgatccatatctcacccaaaatagatctcagcataatccaacgttctgtgaaagaacatatagccgactggttacagtggcctgagtaacactctaagatcagtcatgagttc

SEQ ID NO: 37866 - DNA, 7838 bp, Oryza sativa
agccctgacttgggaaaatctgacaataatagcccgaaagaactcgtcgatgtgtatagtttcttttttcaaattgtccatgtttacactataccccgcctgaaatttacaaaggatctggcgagaaaaagggcttccgtgtccagtggatcaatagtaagaagtagtactcccgagtacagaaacccctataggtgccggttgggaactggctataggtgccggtttctaagccggaacctattggtcggcacctttatctcaatcttattggtgccggttataaaaccgacacctatactatcaaaaaaattaaaaaaacgatggcacctacactgccggccttctccaccgccgccaccaccacctcgcccggcctccacgccgtgccaaccttcgcgccggcctccacgacgtcaccgccacgaggagaggaagccgagaggggtgagtctccacctagccatgcccgcctccgcgccgccacccaacgtcgcgctggaggatgatgaggacatcctccactattacccgctggcaaagatgcaaaattcgggcggcgaccgtgtgagcctctgaataatcccaccttgcttagcttgggaggaggaagccaccttaaaagggagagccacccttcccctaccggactagtcttttagggagattgggcctttccccgagtgggtgtgcctatgaactggagattgggcctttccccgagtgggtgtgcctatgaactgttggggtccgggcaaccttaagttattgggcctcggccaacctcacctgggacggattgttatcaaggggggaggtcccctgggagagaggccgccaccttgccggggccggattgttatcaaggggggaggtcccctaggagagaggccgccacctcgccggggccggattgttatcaaggggggaggtcccctgggagaaaggccgccacctcgccgcggcggccgccaccccacgccatgctagaggagaagaagggaagggaggcgaggtcccccgggagagaggatgctggcgagatccaggcctactccaccaccactgccgtcgccgccacctcgccgcgccagccttcgcgctatcgccaccgcgaggagaggcagccgagaggggtgagcctcctccagctgtcagccgccacgccggccaaccttctccaccaccgcaccgtctcttcgcccgcgtcggtcggccttctccactgtcgagccaccctggaggaggagagaacgggggagggcccccaggccgagagaggaccgccgcgccattcttctccgtcggccgccgccactactctgtcaccgtcgctgcgcaatgggagaggaggggcgagcgagcgagagagagggagggaggtcagaggtggatggatggattaagatgaggctggcactgtgggtggtcaagaagagccggctcggtttttttaaatataggtgccggtttttaaatagaaccgacacctatatttatattataggtgtcggttctaaacaaaaaaccgacacctacagtgtaggtgccggtttttttaataaaaccgacacctataatgtttaaaggtgccaattttaacttttttttatcgtgcggaggtgggaaaatgctcataggtgtcggtttatttaaaacctacattatttatctataaatctataaggtcggtccctatgagggcttttgtagtagtgttactccttgaaggagtttaataatataacgattaactactagctccaaaaattgaaatattatttatagataatctaatagtccactcatacaataagagcaagtacaataagatgccataagcatattgtataagttgccacatcacatttgtatttatgtggataggtaaggaaatgagagagaaacaaagcggactatagatttatagccagcttcagcgtgagttccaataaactatgtgagagagatgggtgaatgatatattaatgatgcagtatatatctccaactaacgattatatgagtgtactattatgttggctatatatgatatttagatttttgaagccagtagttaactatattattgattttgctctaattagttgtagatatatatattgtatcactaatatctaatccatctatctctctcacatagtcagtgtttggctaataggatagggaaataatttcccaccaaccaaaagacatacttaaatcataaccattcattctccctcttccatttaattctaacccttcattcattttccaatcccaatcccactccctatttcctattatccaaacacacccatagtttattggagcttgtgctgcaattggctaaaatttgtagcccactttttctctctccttcacataagtaaaaatatgatgtgacaacttgtacctccacctacatcaggcctatcttactcgcagtaacactcctaatacaaagaacatgaaataatttaatcactttctcggttggatcacctcaataatgcgaacaatgtgattgagggttttgatggtataggatttaaaacaaattaattttacaagatcagagctgttagttaagtatgtatgcatacacgtcttatatattataaaacatgagaaaaaagtggttgtgttttatattataggataatagaagtactacatagtaataagtttcatccggcagaaattcgtgccgagaacatgcaaaacaaaactgggccagagaaatgcacacatatctgtagaagcccagcgcgcagcctgagctgagccggccggccttttcaccttttctcgtgcatgtttcctgtattttcaatcaaaatcatctagtaatgctctctagctatgctgtcgtttcttccctccgggaaatcctcctctgcatgtgcgagcgactgcgtcgacaggatccaggcaggcgcatgcgtgtatgtctccatccatcgggtgccctgtcaaccaaactagtactactactcgtattcctagtgcaatctctttcgtaaaaaaaacaatagtattaaatatgacataacttaatactattataaatttaaatatatctctgtctaaaattatattactcagatatatcatgtttaaagctagattgattttttaatgtaagggagagagtactgcactgcagtgtgcgtgttttgcccattcaagcgcacctacgttagtgtacgtgtggccgctttatctgcccactgccgagctatctatcaatcgcgtcgactacagcggaagccgtcaatccaccggcgatcggtgtcgcgtatgcgcaagcgcaatgcatggatgagtgacttcaactattgctctccggccagttctctcgtgtatatatacgtggaatcaccaactcccaaatcttctcccgttgtcggggcgataatctcttcttgtttctttattttgcgattgcgattagccgcgggttggccagatgtctggtgatcgaggaaattactccctccatctcttaatatagcaacctaatattgaatgggacagctaggttactatgttatggaacgggggagtattattctccgtggctcctaaccatccatccatcgtagtagtacgttttatcgatcaacggtcatcggtcgacggatcgacttgacgagggtgtgtgatcagtgtgttcccttgttgatgtcatgttgtcattctaagttgaacatttgtcgcttactttgagatttttgagattcatgtatatatgtcataaatcacattattgtactttcttttcttttcagtacaggacgaatcttaacaaaagcattcaatggttcagcatgttgcacatgaacttggatcgtgaaaacaatctttccgtttcgattttactgtactgtccgtggataacgtcttacctggagtgtttagctcatgttatgccgttcacaatttctatttgggcttaggcccaaaactctaacagtaaccacattccccgctgtcccgtgacagttgctccaaatgtacactcgaatatgattcgacgatctttttccctgctcaaatcagcggctgagagcgctgagagcacagagagcacggtttgttatcattacttttatctctttcaataaatcagagacagatattagaacggtgaaagctaaaactatcaaaagcatacaagtcaattgcaagcccgccccgcgagacctgccatgtgcatgtgacatgcacgagggcaaagtgaaaaaaatgcggcattgcgtttggagatatgtcccttccgcacgggggaatccacgagcgctgcagcaggctgcatccgtacgctctgggggccagaggcgggggctggctggctggcttgctggcttgcttgctccaacaaagctgcaagctgctcccggtgtccggctggatcgtagggccctgccgtgccggagagcgagcacgcgcatgtgccgacgccgtgcaaagtccccccctgcgcgcgcgcaaccgatcgactcatggcacgcaggcagcagcagtaccagcgacgcgcgcgcttattattggtggtccacgctacttgctgtggctccgctcaacagccagagccagcggtagcgaagccgatcgatcgcgcgcgcgctcgctctctcgctcgctccaccgcgttgtttgtgtcgcattggttggccctctctggtctttagctaagctaccgtaacggctggccggacaggccacatgcatgcgcgctgccacacagcagagacagagcttatcttagggtgtgtttagttctaaagttttttttcaaacttctaactttccatcacatcaaatctttcatacacacaactttttagtcacatcgtctccaatttcaatcaaattctaaactttggttagaactaaatacagccttagctctaagctccgcgccgcgacgcgatcgatcataccaccacggtccacgaccaccacgaggcaaagcaaagcagctgcggccctagctcccgtacgcgtcgcatgcgggacatgctgagataaaactcgtaagtgcacagataaactagtagtgcgtggtgtatcgtacgtacggcccggccgtccggtcggcagtcaggccactttgcaggtcggcccgcccccggccgggctggatggctcagcgtgcatgtgagcgatgtaaaacgaaccgagaaagcttgcgatcgatcgaggggactccatgtcacaccacgtaaagtacatcatcccggcttcttccctgctaagctagctagtagtagctcgcggcttttgcgacccaattcgctttgccattttggtgcgccggggtggtgtggtagtgtacaggtgtgcgtgcattgccgcgctcgacgagccgtgtactccgtatgtgtgtgtcccgggcatcgtgtcgtgtccccccatccccatgtgcaactccggtctactccctctctcctctcgtcaggctcaggccagcctgccgtataaatgaaggcgtcgacgcgtcgacgtgacagtgtgcggcttactgaagtactcttcatactctctcgtctctacgtgtacgtacgagtcagagttatgcactccaattatttctcaatcatgcatgactggtgaggatgtgagtgtgttgaatgtgcgtgcatgcatgcatgacacacgtttgatggagtgatggctgtcatttctcgagtgatctcggaaccaccgcggcgtgcagccggccagtgcatgcatatcagcatatccattggacggtgacgcatttcttgtgggctgttcgtgtcccccgcaagaagatttttttaaaaaaaatacttactcctgatcaaaagagcacatgcatacgctgaaatgcatatgctagtaactctcagcatctgccagaagtggctttgacccctgaatatgaatatatgatcgtgatgatcgcgctcgtggccagccggccggccggtcagtccaaaccctgcatgcgccggcaaggttgcatggcgactctgccccattttgcgagtcttgtcggtacaggcagccacatgtacacgcatgctttcagggtcaggttatacagcagccctccctttctcttggagccgtcgtggccggagcccctccaatcgcttgctcgtgcatttttcaattgcgtgccccctgcgcatgtgttaaagacattctttccacccaatttggccttttcaatccgatcgtgcctttctggctgccatatattttagctcccaaccacatttacggtatgacgaaaaaaatgatcgatgtgacacacccaattattggacgcggtaccagcacaaaaatcttgcgtaactttatatatatggatcgagacatttggatgtgtgatggtcacatacaaaaagttcagtaagaaactagtaagaatatttaatttccctgttggatccccgcaaaaaaaaaaattccctgttggaacattcatgcaatcaacttaattagcacccaaacagtcaaattttgtgacacaaaattctttatttgaacttgcgtttgtgaaaaattatttgtactccctccatttcaaatcacttgttttattctagttttgtcgtaaaataaaacatttctatctttaatattaatttataaaaagttcgtaaagtttatcaacatgtgagtatatatatgtcatggaagtattaatactaaggataaatcatgataaatcaaaaatctgaatcttataatataaaacagtatcaatttacttaggatatacataccaggatatataatcgaaaatgcatttagtcggtatcccgttccaagagattggcacgggatcctctccctccctcacgcgactacagcaataaaaaaaatgcagatgcggctggattttgctggggctattgtagcacagaggcatatggattttgcggaaaggttgtggcgtggcgttggccattcagtgctttagtgcggcgtcgcttcttcgcatatgggggtcggaacgggtgcatgcaaggctaggtcgagttaatggcggtgatgacggagccgccgagagatgggggcaactcgcctcctagccacatggtgcaaagaagggaggagtcgggtatctcttggtctagaagaacttgaacagaaagaagattggaaggaggaaggaaaaatgaaaagagaaaggaaggggaaatggtaaagggattgatagagctatcaaaattttgttttaaccattgcacaggagtgaagcggctgcaacggctgcttcaccgggtcaccatggccacacacagaggagagggatgaggaggtctaggtcttgaggagtggccgaagaaggatggaaaacaccgccaccatcacgtcaagggaggatgggaaacactaccaccgttgtgccggtaaccatctccatcccttcctctctcccctctccgcttagatttgataccagataggtacaggatttgtatcggcaagtacatgtgtgataccaatgaggtttaagttggtacctgacaaggtatcggttggtatatggcagatattggccagtaccgacgaggtatcagttggtaagtaacgggtatcggtcggtaccgatgagggccagtacctaccagaaatgataccgataggaatcaggatatgataccttctcggtatcatctccttgagacgggttctcgtatagccgtctcctatataacactagaatgacaagtaatttaaaagaagactaaccatcactattaaaaaaacatatattttgtaaacatgcaaaatagatttttccagacggccatccaccccgcctgcacataaaggcctgtgaaaatg

SEQ ID NO: 37867 - DNA, 1348 bp, Oryza sativa
tcctttgtcttgttacgttttcttttcttcccaaactcattgcttatgtccttgaccatattgtggacctcatctccggacaaatctttgggagcaggctgaaattctcttttaccattaaaaattttcttctttcttctaaatgtgtgacgtagcgggagccacctccggtgacccatgtataccatctttcgtgatttcttcagccaccggcttcatgtatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacaccttctttccaaagaatctccagatcgtcgataacaggctccaggaatacatcgatatcattgccgggttgccttggaccttggattaacaagcacaacataatatatttccgtttaaagcataaccatggcgggaggttatagttcgcaataagaactggccaagtgctgtgagtactactcatgtcaccgaaaggattcatgccatccgtacaaagacatatcctcatgtttctagggtcggcagcaaagtctttgtgttttcgatctatattcctccattcaatcgaatccgctgggtgtctaagcataccatcattccttctttccgtggcgtgccaacgtactaacttcgctttgttcgggttggcaaagattctcttgaaacgataaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgttgggacaagcatgaattctacagacctctaaccccagtggacacagaacctgctttgcttcgtatgtcatctcgggcaatgtgttctcaacaggaagcatagccttcaaaattactaaaagatctgtgaaactcttgtctgtccatccactacttgccttcagcttcattaggtccaaggtaactgacaacttagtgtgttttgctttgcatccagcgtacaaaggcgtctcgaaatcacttaccaacctgctgaatttcattccatctctctcattctgggctgggtcctcaacgtcacgtaacatgtcttgcagcagatcgtgatccacatcaaccatttcaccgcctaatggagaaggtataaacatgtcatgctcattttcatcttcctgattatgcgcaccacttctgtctgctgctgctccacttcctgatt

SEQ ID NO: 37868 - DNA, 25527 bp, Oryza sativa
  unsure (1)..(25527): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtgggggatgagcggatcttcttgtctcaccctctccctgctcaaccccactacatcattaatcttttgtttggagttggttctcggtggtgcattgtgatcccctttcttgtcccgtaacgattggtcacgcttagcggtagtcggtttggtactgtgccatcttcgaggttgtgttaggagccgctagcaagcagtggtggtgtgtttgtttttggtttttcctagttacacccttcagtgttataattttgtgctccctccattctagattataagtattcgtaggtagaaatgaatggtggagggttgtgattggttgagtagtagagttaggtagaaaaagtgaatggtgaaggattatgattggttgggaagagaatattgatagagaagttgttatattttagtacaaatctttagggctaacagttttaatattttggaacggagggagtttttttttttcttctatatcaatgtgaaaattcgcattatatcgtgcaggtcgtttcgaaaataaaagtgtcaattcctgaacgccgttaattttcatcaggggaattatcgacagtaattatgcatggttaccgtgataaaaaagatttgcaggattctttaaattttttatattctttttagtttcctctggtagagttccattcttataaaaatccaattaatgtgttctttttttttatttgaggacgatggtgccaaattcggagaattctttaatatgcaacaaattaagtaatggacggcttctttttctttttattcttcgtcttcttcttcacaaatcgcgggtgaccgcaaccaaactacaaacaggagcaccgtgcatatatttcaaacgtggaaaattacaggagggaaatgcaaggtgaactggaaaaggacgtgcctcccaaccacactaggaggactaggggttctgaacatggagatgtttacgagggccttgcgactgagatggctctggcatgaatggaaacaccccaccaagccgtgggtgggactagagacaccgtgtgatgaaacggacaaacttctcttcgccgcagctaccaaaataacaataggggatggaaacacgatccgcttttgggagtccgcctagctggatgggcaaagaccaaaggacagcatgccgctcgtctatgcaatttccaagaaaagaagcaaatcgctacgtgaaggcattgaaaatgacacctggatcgatgacctggagctaaattggagctaaatgggaacactacttttacagtggaactgatcagccagcttgtgtccctatggagcgcaacccaggacatcatgctaaaccaaaatgagtcggatcacatcgtctggaagctctcgaatcatggagaatactcggcctcttcggcatacaaggctcagtgtctaggaacagtcggcaccaacttcaatcccctaatttggaaatcttgggcccctgcaaaatgcaaactttatgcgtagcttgtgattcaaaatagagtctggacttccgatcgactagctacaagaggatggccaaatagcggagtgtgcctcctatgccgtatgacgaacgagacggcatgccaccttttagcttcctgtagatacaccagaaggatctggagactgacggccaactgggtggcttatcagcaattggatccgagcaattgggagccatgccaaagcgtacacgaatagtgggaaatgttagccaataaaaggaaagtgcccaagaaagggctgcgatccttaatcctactcatagcctgggaaatctggaaagaaagaaaccaaaggatcttcgagcacaagaaaacggcggcccccaaccttatggcaaaaataaaggaagaggcaagaacctggataatggcaggcacaaggcgacttggagaattcttaccagcttaatcatagcgcttatgtaatttgtacagctcttttttttttttgcctctaggggttgtatttttttacgcctatatctaatgaaatagcacagtctcgtgctgattcctttcaaaaaaaaaatatttcaaacgtggaagactcgttacggttggacccaaatcgcgtcatgttctgactgaattttacagaaaggtcagtggacagggatatacacatttgtcaccttctcaaattgattttgctattttttctacaacatatttcttccttggttacgttgtgctcgtttttttttccctctctatacttggtcactgacatatgagcccaagggtagtgaggctcaaatgtcagtgacaatgtcccactatccacagaaatgttgaaaagtattgtatattccggtgtttaaaggtataaacgacctcacattagcaaaaatctattctcaaaaagataacgtcctatgcatatagttaaacctccaaacgttaaattaataatagaagaaaaatactacaattaaattgatctgtgaaaatgatatatatcaatacatttgtcattggaagcactttaatatagttatttctttaaaaacttttatgaatatataggatgaaattctgactagtgtattgtagattacgttgtgatctgtagaactttaacaaatgaaagagcaccccaggtacgtagtttttttttttttttgcggggaggtacgtagttttactgatgtatggtactaatagtgtggttggagaatatatattattcgacagtttattgctataaggattgtcaaatatgtagacacacacacaagacgagtgaaattgtgtaaacctcaggtcgatagagagatgcatatggatagagagaaactgagatcgacaagtgttaccggcaagggtgtcgagcagcgtagtcttgccgcagccggaggggcccatgatggccaacacctcgccggggcgcgcgctgccgctgacgccgttgaggatggtggcggccttccccccgctgtccaccgccgtcacccacacgtcctcccacgtcaggaacacgcccccgtcgagccgctcctccctcccatctccagcgacgacggcgataccgtcgaacgcgccggcgcagttgtgctccggcgccggtggagcttgtacaggaggcggcgtgtcgtcgggggcagcacgcccgcggacagcctcgagcacggtggtgaatggggaacgcaggagtttactgacgatggcgccaccgccgccggatgaacgccacagcgggcgcgacgggctcggcgtcgccgcccaacgtggcaacggcgatgtcgccatgctagctggtgagacagtacgtggcgagctcgtacaattagtcagtgcaagtgacacaagtgaaaccactagtgtgctcttccgttttagcctctccaatgaggttattttccacttgcagcatccatatccctatatatataggcatcaagtttaattagagtttgttgtgatgtctgcgtccgtcagtgttatggtggttcgtttgtaggttaggggtggtttggtgtgaaaatgaaaccatatctggcgtaaatgttctatttcttcgaataatggaatttatggaattcaatttaaaaatatactgttcattcaattttttttcacatattcaggacgcaactttttagcaaaactattccgtcgatctcgtacaatctatacacgaaaacgacgtatgggtgacgaaacggatggtgtggaagatgctagaccgaacggtctcgcacaaccaacatgcgagaccgaaagagcagtattagtgattaattatcaattagcaaattaattaatcactaattagattaactaatcactacttaattgctaatcaggatcattagtaatgattggcgtattgctgcggtatcgctggttggccgcgcggtctcgcgactttgccgcgccacaccctgcagcgccccgttacgcgagaacgacgttatattcctcctaaataaattatatcctgaatatttatgaaaaaagttaaatgaacactatatttgaaatttaattctttatttatgatctttgcttaaaaatcaatactggagaactgatctcttgtgggtaattgaaaaatcacatttgtcccgattccaatgggaaccggaacctaacaaaagatagctcttattcagtgagatctttttacttaacactcaaaatgaagcagtttgtcttcccttataaaaagatttgtaaggttaagatacctctgaagactagagtctttctctggttgtttcttaaaaacaaaattcttaccaaagataacctgtacaagagaggttggagaaaaggagataagttgtgccaattttgctctagggaagaatccattcaacactttttcttcgattgccctactgcaagaataatatggaacattgtgatatgtgctttaaacattaaaccaattctgaataaaactcagctatttggtacctggttaaccagttttgataaaaacatgaggaatatgatgatggtgggggctgctgctgtcatctgagctatttggaaaacaagaaataaagcctgctttgatacattctcccaaaagatcccattgaggtggtctatttagtcggtaatctaattaaatcttgggctattttgcagaaactggaagcaaactgaagaagattggagctgggggccaggctggtaaagcaggtggcaaatgacatcttcaactaaagatatgaatggaggccctgtgcaagaagattggaatgattctgtctctgaaatcttgtctttgtctaccgatgtaacccccctgagttctcactcacttagcttttgtctagtccctgctgttgggatcctggtaacgtttgctagtttcagtttgcttgctgacctgctgttttcaggtttcagcttagtttctactgaacctctctgcttttcttttttctcttttggtagcttgtttaagactctatgtgccgttccattaatggaaaggggggctttcaggccctagttcagaaaaaaaaaaggaaccggaactaaaaatctttttttccccggttaaaaaacccaacaccactttatgatctttagtcctggttggtgtaactgatttttagtcccggttcaaaaagcgtctggcaccctactatttttagttccgtatcaacgcgtcgtatataatcccttgcacttatcctctcctccttgatcgcaaactccacccttttcctcctcctcatctttaacttcctctcctacctttcatcctctctcctctctctctttcctctctcttatccgctccttttctttgcagcactagcaatgaggaaggagcgaaggcggtggcggccgggcgcagcggcggcggcagccccacgtagccgtgctaccagtggcccgcgcggccgcgttgtcggctctggcgctggtggcggagcgggagagggaaggtacctggcgcgggtgatgtctttgttgattatctgtaaatttattgatttgtgaagtctttgcatctgtaaatttatgatgtcaatttgagtatgtccatccaatctgggaatttgtggatgattttgtgatgtttctgtgaatgtggatgatcttattgttgagtttggttcgaaatcaatatgcaaacagcaaaaaacaatgaaaaaaaagaaaaaaaatgtagtcctggattcgttgtcctggtttgaaacctgagactaaagagcattgcaaaccgggactattgtgggtttctccagcagtgaatgctacagccaatttatacagagtttgtaggttgaatgactacgaaggtcaagaaggtcaaggcatctattctgaacatgcaaaaaactagattttcgccaggagaatcctctcctagacctgaaagtgatttggcgcatcatggcatcaccgacgttggtctgatgaaaccgtaatcgccgtatctggtcacaccgatcaatgctattgctagaatggcaaccgcaccgtgatcaagcggaggggaacagcggatgccgtggagctaacgagggccatcggcttcaccaaccccgtctggccgacaagacgtccttccgtccaacaaagggggatggacacgatgaggtccgccggcaccatgctaccgattgcccctagccttttatccgcatagagctcgtctacattgccaccaccttgcagatctggttccgcctcccacaggcgtctacccccacagacaggagaaagctgttggtgtgaaaatcgtcgtacacacgaaggcctaaaaattttgcttgctctagtgcaggtcctatcaaataaggttcacacaatgccaatacaactaacaaggataaaataaagaagattagatcaatgggccaatcgttcatggggtcgatatagtatggtttgcccatgccgatactgatggaatttcggatcgatcggctataactaatggaattcaaaagtcagaataataaaactctattggctgaaacttagatacaatatatttataaaatcttctaatattattataatcaatcttgatagatcagacttaaccgagacgggataagagtgaaaataataagatagaatcttgagtaaataaatatatctttgaatatgagctgatatgtttgaaataaaacttatcaacactctatatagaagaaagttaactgatatcaatcaaaacaagatagaatataaatcatcaaaaactatgattatttatcacaatctagatagatcggacctaatcgagacattatcacagtaactagctgattataataaatattgcaaatttaatcgatgcaaccaattataatatgttaagcagatacttcatcggctaaaactcttatgaaactatgataagaatctatcaacttgagtaaatgtaataaacacacgaaaacctagaagattagagctaagcagaatagttcggggttaacattgtgcttaacggatttaaacgagtctatgaacatttttcagggtgactgatatagaaaccataaacttagaaagcagaacgaatcagagcaagagccaatatatttgataagcaatgcaagcaaaagaagaactagtatatcgaacataaccaaggaagtactaattcccaatacaagcgaaggattttgacaaaacttactttcttgttggagattgataccgatgtagcctatctcataaacaagaacttgtcaagagcaaaactagggtggcgatgccctaaaagttgaatattgaactgttattgtttacaaagaccccaggtgcacatatttatacctataagcaatactaagtctgactctatcacgatcgaattgatctaaaactctatatctaattaaggaaattattacagactccgactcccacactactcatatcggctaaccattacttaaacatttccgattctaacacgactccataggctcataactctattaacaaaatagagttaatagagcccaaactgatccctcatcatgtcggctatcatatcagccaaaggcttctgttgaggtaccccctgaaattgctgttgcacttggtctaactagttatagtgaggcaaatattggggtagaggtgatccccctagccgatactgcacctaaggtgagtgaggctgatactagaagttaacattgccccccatgtgatgctaaggagactgatgcaccatatggatatgttgatcaggaacaaattgagagccaacaggttgatgtagttacggaataggtgattgcagtgccacggttatctgtggaatcggctcaataaccggctgccttggcctaaacatagaggcgacttgatctggagtaattcgggggatgttttgccctatatgttgcggttgttgtttgaccagaacgtgaggattaaaccctggttgccccggcgccgatgtcgacgcaccatgtttcccaggagctaagactgacactatcggctgttctggggccaaacctgagataggccgatgtttatcagaactgagagtcttgtattgtggaaaaacaccttctggaagaaaaactggtcccttagcctgatgctcaactatcgtgccatcaaccacatatttaatcatattagttaaagtattgacaagcactcctgactagttgatcaatgcgtgacgaacaacataaccaatctgatcttgcaagtttttgaactcttcaggacttccttcctgcttattatccttgggttcgacatctttagttgagcttgtccctagctctccattgtttggcagcactatcttgtacctctgaatcactgtacccagcgtgtctagacaaatgaatgtaaaagttggttctgcatgttcatcatttgttaatactctagggcaggtccaaagaattgctttcgggttctgagcgtgctagttggtatgatcctgcaagcaacaagaaacaaagaggaaacaaagttaaatccataaatgacagccgatcggctggattgccgatgacgtatcgtccaatattaagctgatgcaacacgtgttagattggcaatggaatatataagatgagaaaagctagatccacctgatcggctgtagatattaatatgtttaaaccaagtgattgggatagatcggatagtataccgagatagtataaaccacttatgtgtaaaagtacttcaaggtgaagattatatatattcatagcatagccgataaggcaaatctgacatgtatcggctagtactccgataccaccttatactaagatatcaatatagacgaaatataaagaacaaggaatcgatctaataccaggataacctaatcagaccggtaatatagcttaatatatttcaaatgagcgagatcttaatataaaaggcagatttagtataccaagtaacatataatgaacaagataactaaaccaggtaagatcggcagaaaatccgatgctatctctattagcgatcataagacaagctagatattatgattcagatcattacttaatagatcaaacctaactgatgcagcattaagcatgaagagaaatataaaatctaaacaggacgatgatagccttttcaggatgggagatacaccatataatctacctcaacatcaatatctagcccaatcgtctatcttcgatgatacgggccggccgatgaagttagatagtgatatcgatctagattatatagcatatatgataactcggagattcacataaacaagattagagtgtcatgaagatgtaagcactaatcccaagaacgtaaaccgccataacaaattttaccttttcgccgaagatcgaaaccgatgcagcccaactcgaaagcaagaactcgtcgaaacaatgaaagtagaaaaaggtggcgatgcgctgagaatattattgaactgatgttgtttgtttacaatgtatcgggtcatatttatacccaaaatacatgatatgtccttgccggacacgactctatctctattataactcaaaatatgaacaagtcccttaggcggactcttaccaaaaatatctgtaaggaaactactaaaatatcctaatgaatagatacaattgcccctaatgaatagatacaattgccctttctggattcaatccatgctttgcaatacttgcgtagagtttgaaccatcctcggtaacgatcccatgactgctttgccgggatcggctgtatcggctcctccccgtccgatcgggtaatagccgatgcagacggtagctgatacaactcttagccgatgcgggttctgtttctaaggctacagatcttcttcaaatccgtttcagttcttactttggatccaatctatgatttaccaattttggtcgttaatagcggcggcgcgcggccatcctgcgtggcgccgcggccaggcggcgtcggctcatagtggtggagcggcggtggcgcggtgataatttaaatttaactagtatatagaatgatgattcaaatgtaaaactaattaaggtgatatgactttatgaaagtagaaaagtattgagatagtttggacctagattaatcatctaaaggctaaaaataattgaggtaatataaattaatgggagaagaaaagtagagagataattgggaccatagattaatcatttaagtactaaaaataattgatgtgatatggcttaattagagaagagaaaaatatcattaactaagtgaggatgaactatagaggtacacagtatatcatgtaaaaataacgaagatatatattaaaatattatatggatcatgtgggatgatgatttaacatgcttgcattctaaaagctctaaaatttaataaattataaaattatagatattatagcatgtttacatgatgtttaaatttaatgattgttagtggatgatgatataacatctttttagtggatgataatgtgacatctttgcatgttatgcttttagagtcagtgggttatatctatatagtaagagaggattttagactttatgaaaggttgatggatgtaaaattggctattctctattatttaattaatgccatgattttcttttgcaaactattctgtactatttaattatcctcggttttcttttgcaaacctatgttttacatgattttgcattgaaacgttaaatatcactacctggaaaaccggccgttggcccatttttctaaaacatactatacacaaacgctcatatacacacgtacacactcactcctatgaatatatacgcacgtacatcctacatatcctgagattgataaagtcaccgcagacagctcactgttgatatcaatatcgcctaccactaaatatgggacttcaatccgggtagacaggttggtgttaacatctaagctccgcccatttttagctgtaattgtgttgctatatgtccttgtcttatataattgattaagttactgtgcgaacaatcaagagcttgaaattatcataacagtgggagaaaataaacattatttacaatgttgagatgggatgtactccgatcatattcataatataacagtctagattaaaacatagagccacgttttctttcaaaaagaaaacaaaagatctccgtcaaaatatattttacaaataattcaaattaggattagattattctaggaataggcggcaaaaaaaattacattttactctgtaccaaacaaaacagatatttttcccatttaaatgtaactagctagtttatttggaccacaagtgtgcaggaggccgcttcaatgtttttgcacaagaaatattcgatctccagtcgttagttttttcttcttctatatatatgcatgcctctcggaccacatcaattctttggtgtcctcattattctcctgtccacacttaatataaagattcgacagataagagtccacatctgttcttttgccgatcgacatgcttttcacatggcaatgtataccatatttgattgctgcggcgacagatgtgtgttggttctgaactttctcttgctctgcacttctatccgtcagaacgtgataaaacggcccagccacttgttgcatcccacatctcctgccgctcactgcttcgcccacagaaggatttgtattagaaaaatcaaaacttgaaggaaaaatacaacgaaatagggaaggaaaccacattaatatatatatggaatttcaaaccacacgcccttaagaaaatggtgatcacatatgcacctgcatacattccacataagtcacaattgatcacatacacttcagatatatacatccacgtacttaggccctatttggatcatctaatcactagactaaaattaatccctagactaaaaactttagtacctactgtttggatccagagactaaaagggactaaaagcacgtggaccgaggaagagagaagagagaggctgttactttagtccctataagtacctccacgagggactagtggattttagtcccaatatacatatttagtcatccatgtttggatccttagggactaaaatggagggactaatccattagtaccataaaccaagcagggccttaagcacattgcacaaatatcacaagtgagatggcataaaccaaacctcgggagtcttcaataaagcaagccaacacatgctaatttaattaaaaaacaactaactattagcgacaagtcagaaaataaagataagagaaatttcatgtacttgaaaaagtaactcgaggtacctaaattttatactatttttttatatctcaaggtagtacttagaggtactagatttgaccctagaaagtgtggtaccttccgatactttttgatggactgtaaaattacttaggctgtgttcttaccccaggttttccaacttatctcttttgttttccacgcgcaaaatttttaaactgcttaacggtgcgtttcttgcaaaaaaaaattatatacgaaagttgcttaaaaaattatattgatccatttttaaaaaaaaaatagctaatacttaattaatcacgtactaatggatcgttctgttttccgtgcgcactgtaccggttgggaacactctctagcgaacacagccttagtttgttatctactccctttgtcctaaaataagtgcagttttaccttggtcatgtccaatatttgaccgttcatattatttgaaattattttatgatcagtattttcattgttattagctgataaaacatgaataataccttatgtgtgactaatttttttaaaaaaatattataaaatttttaaataagacggacggtcaaacgttggacacggatatccacgactgcacttattttaggagaggtccggtctcaataactaactatggtatgtactcaaatactcgatgggtgacaattcaatcatcccgcctcctgctcacctcctgggtagtccagccatctgtcaattctgctacaggcagcagtgccgctctgggccagtttcttgtagcgaaagccgggacccgatccggttgagggcactcttgtttgcttgctccctgctccggcctcggtgccaccaaaactgttgttccccgtctctgcaaggagactgcgcaactggtcgtcaaggacacgacggctgaagtactgatcctgatcgagtaggagctgcaagctgggtatcctctacatatcccgccctcgaatactcgatgggtgacaattcaatcgtcccgcctccggctcccctcccgggtagtccagccatctggcaattctgctatagggagcagcgctgctctgggccagtttcttgtagggaaagccgggacccgatccggttgagggcactcttgtttgcttgctccttactccggcctcagtgccaccaaaaccgttgttccctgtctctacaaggagactgcgcaactggtcgtcgaggacacgacagctgaagtactgatcctgatcgagtaggagctgcaagcttggtatcctctacatatcctgccctgccccaagatgccatagttattgacaccggaccggactggcggtcggaccggaaaaaaccggaaccagcgcctctgccggtctggctcatctaaaagaccgcctgtgcaatcaaaccggtatagaccggctggaccgcccgattttgcagaaaaccgcctttcccaggcatacaagcaactatgccaaccaccaagccatgtgcttccttgtgtttggaacaaaggagttatttctttattagatactgaaccgctttggacctcgaccgatcagaccaataaaccagtaaaccgacggctttgccgattcaattgccggtccggtctcaataactatggtatataccaaagagcaagaaggagtcgtgtctgatgcgccactaatatctcacccctgtagcctctctcagtctctcgcgtgattcgtggacgattttgttatacgcttacaaaatttatcaaatgtaaatgcagtataactataatgtaattatattataatttgcatgtaactatgatataactttcacataattttagatcattagatttacttcaatattcatgtaagttgggaagaaaagaaatcatagtaagcacgggtgaggagattcggtcttgtgacctccgcttcatgaaaatagcatgttactggggatttctaaaagttattgcaattacattatgattgtactgtatttacatctttatcgacaaaattatagctagtccctttgtgtatgcgcagtcacagaagcagtactaggcttctggacagctgggcctaaagctaatgcttgttgggccatgattttatgaggtatattggcggtggtggtggtgggatgtgtgtgcgcgcggggggaggggtatcatagtggggttggtggtgcggaatataagtcctggcaatgccctggtccacagcatagggtatccgaggctcatgtttgcctctacggaagtgcacggatactgctgttgctttctctcaatagtatctgtcgatggagcgattcctcggacaatggagagtggagacccctccccaagtgtgaatattcaaccagggggtttgtggtgtacggcgtagaaagagatcaaagcaagagcggatctgtggagcccgagctccccgccaagcaaaagacacaggaattatacaggttcaggccatccggaggtgtaataccctactcctgtgttggtttcattgtctttcctatatcagctgagtacaacgaaggccttttcaggctacaaagcgaagtatactgatctaaagagtccaacccttcatccgtagcttgtccccttctttttatagtccatggaggggctcacattattacaaatctactccttgtcttgtgttatcagttgtcttgttgccggttggttccctaacacaatcttcgagaaacctgcattacctcgggtacctaggcttctgtccgagacagctgggtcacgccatgtagacccccgtttttataacaggaatctctcgtgttaatagtaccatttccctggatcaagtagtatggtactcacgattacattgctggaatattaattgcgattgtctagcgtgaattattacatcataagcccgcacgcagtcttagaacataggaccaaacggtccggaatacataccaaaagcagaaatagataagcagcagaatcaaggtagcggcgacgccattgccacaggcaacgaccgtaactaagacctactaagcgccgccatcttcttcaccctcgtggtcgtaagcatatgggtcatccgagacatcatcaccagcttctgatggaatttgtaaataacaagagtgagtaccaaccgtactcagcaagccaccacaacaatgatgcatatgattgaggatattcaatgaaaggctaatggtttatttgcataaagccaattttgcaattcttttcacaagcctaacacctagcataaactgatcaaattttatctctatagttcattaaacagccatggttctgtccaccatccattgtgttcccaaggatagcttcccgccactggtcgtcatggttttctggggtctaccccttctaacctctcgagaagttgatccaccagtctaaaaatcatcatgcatatcccacccaatcaaattaagaaattagagtctagccaagtgtaatacatgtcccgatgctcattaaccatgagcatggctatttgaatagatttggtttactcacactgtagtggatgtacactttacccatactcctcgactacccaacacatgagcctcgtcccaacacatgagacgcgtcacagcaaagcctttcaattacctcacttttgcagtatatgctccatgaacttatatcctcgtgcactttaggcgtcataagtttctagcagtgagaggagttctggcgttcccgggaagggaaaaacacacacattcctaacgttgcttcttgaagttgaacccagtccatatcgactgtcttctcttgggtatcttcttttagtcttgtcaagtcagtctctagccatccgtaacgggcatccgccagcggactggccatccattccgggcattcgctagcaaactgcttgtcacttcacacacctaaaagaaaccaatatgcagggatactacctccactcggctatttactccgctaggtctatacccactcgagaagtacgattgtactggggacgtttcatgtttaacttcatggctcggtccttaattgaccagggatggcactagcctttaccggacaccacccaagtcctccagccgtcccagtcgaaaatatttgtttagtttaattttctttcacaaatcatctcatcactgtcatggcaatgtggcgctcatgtctccacacgtcgtatgtcaattaccttccctaaggtaattgcccaagcataaagcattttgacaaatatgaatatgcatgggtctaaattagcatgggctaagcatttgtcaaatattgactaaagacacacgacatcatgcattacaaagattatatggataatcaatatcaaaggtatgggatgtaacaaagtaggacattcacatataaatagcatgcaaactttatttaaatcaaaataagttcgcaataggtccaacatgctcaaagattagtgataacttgccttgctcacagatttgctgacccggatctttgattaactcagcaactccttcggaatctaaatttacgtgcgaaagatttgattagaattcaaataaaatcaccaaaaattcaaacagtacaaagtaaattgagaaagtggtaccaacaattagatcttgattttagatgaatttaggttcaagtttcattcgaatcctagttaaaatgagtgagttatgtaagtttaaagattcaaatttgaattaataccaataattgtgaaatggtactgtttataattgatttatttttaatccgaaacattatccaaaacccactgtggttgacatgcgggccatccccctatttcttttctctattttattttcttttggaaaacaagctgtgtcattgacaggtgggaccggccctattgacaagggggtcaaccagtccttgtaacaaaatctataactaagttttcttagattttaataacagggaccccacatgccattatgtgggttaatcaccattaggtggaggattgctgtgcgctaactacatgtgggtcccacacggtttctatctctcgttctttctttttccccatcgtcttctacctctcgctcacgaccgaacagagtaacggcgcgcagcgatccaatggctcgagccgggacggctcggcccgtggtggggaaaggtggcggtgcatcacctgaaacccgccggtggcagcggcgaggcacggcagccatccgacgcgcggcgcgatggtgctcggtggcaccgagatcgcaagaacggcggcggcgcaatggtggttgattcgtgtgcaggcgacctcgatttaaccatctaggtttcacacggagtatagaaaaggaaaattctcgccgatgctacattggaacgaggtctccccatggcgagctcagccatggcgtggtggcggaccaagtcagcatggcaacggcggcgcacaccccaagtcgagggggccgctagcttcagggtgactaggcactgctataggcgcgagggcttaccacgggatggcgagacggcggagttcgacggcgcgcggcgtggtgcggccgaaacaggggcggctagcggttggcgacgctcgtaggtgttcgacgcctggtcttcctcattcagcagctcccggctccttccaacaacagcaacagcaacttctctccacaccccgccacccacatcggccgagaagccctgtggcggcggcgcagcccccgctcaccaggtgttcgacacccggcggcggcgcgatcttgtttctcttcgatggagcaagagttttagggagaggaagagcaaatgggaggttggaatttgtaacgcccagattttcgttcgggactaaaaatcattaaataatgtatttttagaaattaaataaaagttaaatcaaattaatcaagtgaaattatagaggaaattaaaatttcctttaaaaatcgttggccgagaatattttgtaacattctttctgccctaaaatactctccggatttttccgtaaatttttcggagctcaagaagtaattttaacatcacaaagtgcatttaatcaattagaataaaaagaaaacaaatcaaatcaccttccttccttgggccatttttggcccaagccttccttctctctctcgcggcccacatgcttctttctctcagaccggcctagctcgctccccccctccaagtttgttcccccccccaaccggcctccccctccctccggccgacaggtggacccgaggccccacctgtcagctcttcctcccacctccagcccgcctccaaccgccaccatgccgccattgccgccccacacgccaccccgccatccccctttgcgcccaagcggtggaactgcatccccaccacctcctccacctcttctctctctttcccccaaaaaaagggcgccggtttccccccgccacgtgcccacgtcgccactccaccatgccggccgttgccgcccatcccggccacgatttctccctccccgagcctataaaaactaaccccggagctctctctctctcatttttcctccttccccgagcttcccgtcgcctccctcgctctccctgcgccgctcccgcgcgctgccgatcgccggtgaccctcgagccggccgccacagccgctcccacctctgccgtgctgcaccactgccaccaaaagctgtgtcgcgtcatgccgcgccccggcatccacttcgtgctcccctttcaaccccgcagcaccatccccatcacgaggccaagctaccgccgcctgtaccgcctccagccgcacatcaccgccgtcctagcgccggcgtgccacgcggcaacctccaccggcttcgccgtctcaagggcaagcccggccaccgcctattttcccctctccaccaccgaataaccacctccacggcaaacccgaggccgccgccacattcgccgcctccggtcacactcttccgctattgccaaccactccgcgcgacactattgcctccgctggctccgccataccgcacagcccctccggcaccactctactggctccaatcgctgttggaaccccggcctctccgctcgaggtgagaatccgccgttttttctcatctccggccagcgactcacgccgccgtgagccacctctccccctcctaacagctctcctttcatcccatggtgcagccaagcccgtccgcccctttccgagcgacgcccgtcgccgaagctccgtcgcgtcgtcttcctgaggagccccgccgccgccggtcattgccgtcggccgcccctttcgccgtcgtgcccctcggtgagcactcccctccctctccctcttcctccccttcgtcggccgcctcccgggcctgctcgtgacgcgccaccgtcgccgggggctgtctgaccgggtcgccgttgccgtgctatgcacccgcgccgctgccggccgtgccgggcagctggctgccacctccccttgtcgcgccgcgtctccgctctctcgcgtgcgctgccgttgcccgcgtgcgccgtcgccgctggttgccgcgccgtcgctcggccgggccggcctgagccgtgcccgtgcactgccgccgtccacggtgccgctcgagccgcggtggaccgagtccaccgtgcgcccgtccccttatgccgctgacgtgtggggtccacctgttggcgcgcctctcccttgatgatgtcagcgccccctttttcctttgtaaaaataaatagtaattgtgcaataattcgttaataattataaaaaatgatttaaatggctcaaatcttgtaaaattcatatctaattgatatgaactccaaattgggccattcaacttgcataattcatctaaaattgagctctatatgtttgtttactttttatgcaatgtttgcttggtttttattagagtttttcctcgttttgcgtgccagcgcgtagaatccattatttcagaagtctgcggtcgcgaggaaaagagttcagaagattcttttgatgaagcaaggcaagtcacacattccccttgagcattttgatcctactttacaaatgttttaccgtttgcaaataaatatgcatgttttgctaattacaggggatccgagtattgtctatctgcttgcttgtgccttattatttgatatctatcctttgtcaaccttgggtaataaatcaactagctcatgttacttatgtgaccaagctagaactatatgcttagccatgcttaattaccactgataacaatccggcccagttggggttggccgaggcccaataacttaagaggttgcccggaccccaacagttcataggcacacctactcagggaaaggcccaatctccctaaaagactagtccaataggggaagagtggctctcccttttaaggtggcttcctcctcccaagctaagcaaggtgggattatttagaggctcacacggtcatcgccgacttttgcatctttgccagcgggtaatagtggaggatgtcctcatcattcccacccccttaaacaagggcctagctctgataccacctgatgtgctcgagggtgtcccgatctttcgatgagagtgataagtcgattggatggagtgacgttggcgatccgactacaactatccagggatgttgcgcctttgcaatcgttacaccaactccagagtgataagtcgtgaatctcgacggatgcacgatcagcccaaccacaagggtatttgttcctgcaagcaatcgagaaccagtaagaacaagatgaacatcaactaaatttgcgaatcaaagatgttggattgaatcaacagaagtaacaagtggggttcagtaacaagcaatccggcgatctaatcgatcacgggatcaactcagcaaagtagcgatgctatactttgatctaaacaaaacccgattattcttggcggtggagaaagctataagaagaggaagaggacgaccacaggggtgctggggtcgttctctcaacctaggacgcgtccctaatggacccaacttgatacacggcccattgggcctaaagaggtgacgcagcaccgtggacagaaaaggactcagtagtaaaatgaagattgcggccactctagaactgatatggacatgaagtacttgcacacctaaatcggagttcgcatgaagtcgtggcggccatcagaagttggtgctatgctgcagtccgaatccatcccgcgcaaatcctctccccgtttgatcctctccattgttcctgagtaaaacaagagtgcacgtgtctctggggtataaataagaatcatatgaatttaagaatgaatgcacctgatagttgagttgacgtgtacgagcgcgggtaataggaccatgaagttgtacttgtggaggcgtggatgtatcgttggtgttgatgtcctcaacaaccactagctcagttgatgggataattgcagtattagacctttttagtattagaacgggctgcgtgctcaagacacccgaccatgttgcattggtcgtaattatctaattaaaatgcgactgaatggtgggatgtgggtgcatggttttgctggtcgcaaccatggcaattaaggaccggttcgcgggatgcactggaagacatacagcgcttgccacaagcgggaatgggtaactgcttgacttgaagtatagctttccgctggttgacggatccaggcaagggtgagcgtgatggagttcggatgggccctgcgatggcctatgcggctttccgatttgcctaggcatgaaaggggactgcccgctgcctgttgggggcgcgggtgaaacctgaggtgtggtgtgtttggtcagagggggttatatgaaaggtcttgtcacaatcactcgacatggtgacgtgtccggccgggcatggttacatgccggtggattgtgtcttgtgggtacaattgtgcacctctggccagagtaaaactattcgaatagccgtgcccacggttatgggcgatcaaccagaatcaccgtgattagtctcagtcccaataaattgactcaatgcactgtagttcaggtggaatggttgggcctgttcaacgtggtgtagcgttgattagtggagattgaatgttaccttaattactcaatagttttactgttttgctcaataaaatgttttacaactgcctttatacaaatagccgtaaaccgtccttgtatccccttgcacgtctgcattgttggtgtggcttgctaagtacggtggttgtactcagcatttgctattgttcccccatttcagaagtgtagtgcttctgagctgaagacgaagttagaagactaaggctcaaaccccagttgagttttgcctgtggagtggagttgaagcccagctaggatcgccttttccgctgctgctgctttcgtttcggtgtgaggactaagtgcctcttctgtaagtattttacgctttatttatgtttggatctgtatattaagaggcggcattccagatgctgaaaacgccaaggattacattgctaatgtcgaggagaactttaagggctcctcgaaaacttatgctagtgctctcatcatgagaatgctcacatctcgttagaacgggaaggggagtgtgagagaaaacatcatgacaatgaccaacatggcggcacaactaaagagtatggacatgtccatctctgatggtttcctggttcacttcattatgaactcattgccatctgactacggtccatttaagattaactataacactcagaaggacaagtggtcaatcgccgagctcatctctcactctgtggaggaggaggagtgtcagaaggcggaaaggcaaagaagcaagcctaccttgttgataatgagaaaggcaaaaggaaggctgatgagatttgtgctgctgaaaccagtaagaaacccaggaactctccacacaagcccaagccaaaggggaagcctaagacaccagcttctcctgctcctggtccatcagcaagtgccataatatgcaggttttgcaaaaagccagggctcattcagaagaactgtaatggctttaagaagtggctcgctaagaatggaattgagttccgtgaggactatcgcaaagggggagcgaagtcttaaagtggcggacggaaacgaacttcatgtagaagctattagagacctttcattagttttggaaggaggccatcatttatcactagatgatgttctttatgttccatctgtcaaaaggaaccttatttctgtttcatgtttaaccgaacgcggtttttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaaagagataaaagcgagctaagcctgaaggcttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacatcacgttgcaacaggcccaaccaaccacctgaactacaccagttcattaagctaaactaggggtgagactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaattgccatgggcacgactagcaaaaccatgcacccacagcccaccatgtaatgtattttaattaactaacaccattgcggtggcactaatccaaagctattgccaataatcaaagtctatgctttaatgtgaccccccttttgtgcactagttgaactaagcatggctaagcatctcctaaaccaacatctagtcattttaatacccaagttatcaaaggcgtaagggaaacaacatatagctgagtaataggacccatcccacatgatattgtaaaacaatgcaatatttaatagaaatgcaggatacttgtaaattgggtacaatatgatcaattgcaatgtatgacttgccttgctctcgcactgatgagaccacagcaacgtcttcgagcaaccacgaatcgacgaaacggccgaaatctacgcgacaaacaaagcacacaagcaaaacatgctataagactactgaaacaggaaacaaaaccatttttaatggattctatacatttttatgaatttactgagacttgaatggacttaaacggagctcggatgaattagttatgatttttagaagattctctgtgtttttactattaaagaaaagccgtaatcaatttattgcgcaataattcatcccagggctgacgtcagcataaggaggggtggcgccgacacgcgggacctgcgggtcagtgactcaaggagagagaggggcggctggcaagcgggccccaccgagcggcggctcaagagagagagggaggggcgccggcacgtgggccccactggcagtggcacaaggcgggaggggcgcggctggtggctcggctcggcttcaaagccggcaggccaagcatggcgaatgacggcggcacgcgcggtcgccggcgacggcaaccggcggcgcggacggcgacggcagacggcgcgaaaagcgg

SEQ ID NO: 37869 - DNA, 7569 bp, Oryza sativa
aatttgaatccctccgttgcggggtgcacgcgcgagtgggaggagtggggatggtgggcggcgacgtgggcgcagggcgcggagtggggcgcggaaggcggggaaggcgggcggcgatgggtggtggtttcggcggcggttggcgcaggcgtgggcggccggaggttagggaaagggctgacaggtgggccccacctgtcagcgcccgagagggagagggaggccgggagaacttcgggagtgggagggaggagcgggccggcgcgggaagaaatgggccgagccgacggcccaagaagagaggaaaaaggaggaaagaaaaagaaaaagaagaaaggattttttttccagggatttaatattgcactttgcttattttaattggttaaaattatttccaatgctctgaaaattccactaaaaatcctgttagcgtattttgacatgtagaacccaagaaaaattccacatgccgattccgattattatttgcatttattaatttagggtttctttcttgcctttaaacaaataatttcttccaaccatttattaattgaatttttgctagggaaaagaacttctgggcgcgacagttttagagttcattttggacacaaagaatgttttattcaatttaatgatgagattgtgggtcttgctctccagcaaggcaatctttatttgctctctcttgataattctgcaatgaatgctcatgatgttgtatgtaatgttaagattaatgagacctcatcgaaattatggcactgtcgcttaggcgatatttcgaaggggagaatggaacgtctcattaaggaagagatacttcattcattagattttactgaggacaatccctgcttagattgcataaaaggcaaatttactaagacaatgaagaaaggagcccctaggagtacgggagtacttcaattaatccatacgaacatatgtggcccattcccaataacgtcagtggatggttatgattcattcattacgtttactaatgattactctcgctatggttatatctttcccattaatgaccggtctgaggcactaaaaaaatttaagatttttaaggctcaagtggagaatcagcaaaatgttaagattaaagtagtgcgctcagatcggggaggagagtactatggcaagagtgctccatatgggcaaattccggggccatttgccaaattcctacaagaaaatggcattgtagcccaatactctatgcccggagaaccacagcagaatggagtggctgtgcgccgcaaccgcaccctaatggacatggtgtgaagcatgcttactcattccagtttgtctgtgaaattgtggatggaggcattaaagtctattgcccatatattaaattgggttcctaccaagtccgtacctaagacaccttatgaattatggactggtaagaaaccgactctaaattatttaaggatatggggctgtcctgctgaagctaggccttttaatccacatttaagaaaattagattctaagactgtaagctgtcacttcatcggatatccagaaagatctaaggggtaccggttttactgtccagaccatgtccataagtttgttgagatgagacacgcagtctttttagagaatgatcaaatccgtgggagcttacagaacagggagatagaccttgaggagattcggttctcgcaatcggccatccaacaggaaaatctaactgtacctcagattgtgccgtaggcgtcttcttctgtggcccaggctctagttgaggatattaatgaacctgtagcacaagataatgtgcaaactccacaacccactgagatcactaatgaaccattaagaagaacacagcgagagaggaggtctgctattcgcagtgactatgaggtctatattggagaagacattgggaaatcagacgatcctacttcatttaatgaagccattaatagtgaaagttcatccaagtggcttgaagctatggaagatgaattaaagtctatgggcactaatggtgtttgggatttagtagatattcctgaaagggtcaagacagtaggctgtaagtgggtctacaaaactaagtatgactccaaagggaatgtcgaacgattcaaggcaaggctcgtagctaaggggtttttacagagagaaggggtagattataatgaaacattctcccctgtctcaaagaaagactcatttagagttgtcatggtgctagtagctcattatgatctagagttacatcaaatggacattaagattgcattccttaatagtgacttggaagagcaagttttcatgacacaaccggaaggttttgttgtggaaggcaaggaacatatgggatgcagacttaagaaatcaatttatggtcttaagcaagcgtcaagacagtggtaccttaaattcgataatatgataagaagctttggatttatggaaaatgaagtggataattgcatttatatgaagagtaagggtggaagtttataatcttaatactctatgtggatgacatcttattggctagcagcgataagcacctgctgcatgagactaaggtgtttttgtcatctaaattcgacatgaaagatcttggtgatgcctcttatgtattgggcattgagatacactgagacaggtctaggggagtattggggttatctcagagatcatacattgacaaagtgctaaacagatataatatgagtaagtgctctatcacgcctgctccaatagtcaagggcgataagtttgggttattccaaagcccgcggaatcaattagaaaaggaacaaatgaaggcgattccgtgtgctttagctgtcgggagcttaatgtatgcccaagtctgtacgcgagcggacttggcttttgttactggaatgcttggcaggtaccagtcaaatctaggactagaccactggaaggctgttaagaaagtccttcgctatttgcaaggcactaagcactacatgctaacttatagaaagttagataaccttgaagttactagttactcagactctgattttggagggtgcatagacattaagaaatccacatcaggttatgtcttcactctcgcaggaggggctatttcattgaaaagctccaaacaaactattactgcatcgtcggcaatgcaggctgagtttattgcatgttttgaggcaaccggacaggcggtatggctaaagaatttcattccaaggttaagagtggtcgacagcgctaatggaccactcaccatatactgagacaataaagccgcagttttctattcaagtaacaacaagtcaagtgcagctgccaagcacattgacattaagtatcatgttgtgaaagatagaatccaagatcaaacaattaaggttgagcatataagcactaagttaatgcttgcggatccgctcactaaaggtctaccacccaacttatttaacgagcatattgccggcatgggattagtaggtgacctataagcaagattctagaatagaggcataagaatcaatcaacacccaataagattaagttgattcctatcaaggtattatagtggctataggtactgttgtcatagtgacattttattgattactatgacacattgctttggttcgctattctacttagactggactcgttagcattaagatcaagtgggagaagatcaagtgggagaatgttggttgatctcctggtaacgagaccagagagacacgtcgtggtctaggcccacccacacccacgcccacacgcggctaacggcgaggagcgagcgatacgctcgcatctcatccactacgtgcgccgatcggatgcgcatcgttctccataacggattctcccccgatctcctctagcgctatattaaaagggagaggccgtctgtgcttaggtgacgatctaagtacactaaaccctcccgataaaccctaacgccgatcctaagaagtgctggaaggagaccgaaaggcgttctccaacgccgttcccggccagtgcaggtggcggcctgaagggcgacgccatctgcttcacctccggcaacttgctaccacgacctcgacatcaccgacgactcctaccgcgactaagatggcttcaagctcaaccggtcagtcaattcccgcataagtttaggtgatcatgtatgtgctaaggataagttaatgagtataagatctaataattgtatcgtagtcaacacttaaattaataagattagccccatgtagtatttttattttcgtggttgggacgctttagataaattcatgcactaaaactagcgtttcagagcaagtttaatagtatagctaaccgttggctccaaattatctatagtcaatttaataatcaattcatacaataattacctataaatatatactacacaattaatatcttatcccatctgacatacacaaatacatcttagagtttgtgttgtagctgtagccagttgctcttctctcttctcttttatttcatcgaaacatgtttatagctagattatagtctctattaccacactaaattacaccaacgtaataaattgtattctgtccatttaatttacttataaaaataagtatctgacgtgacggccctcgctagatgggggaagccggaagcccaaagggcgtttaatttaataattcaactgctgtgcttctcctccggaaacgaagggtgactttagtcaaagactggtcaccaccccactttgcttttggcgacgaaaccctcgccgcgatggctacgacccgccgccggaccgcctctgcgattccctcctcatccgctccagccgacgagctccccggccgaggaggggacgcgctgggggcggagcgcctggagggttccgtaccggccggggagttggtaaaggcgaaggcgacgaagaagccggtcgcgttcgcgcgcgtctggtcggaggcggacgagctccgcatcctggagtgcctcgccgcgcacgtcgagaagcacggcgcgcccccgggtcgctcccagctgcccgaggtcctcgccggccgcggcctcgacaaggaggagttcaccgtctcggagatttacgagaaggtgcgccgcctacggacccagtacgacaaaatgctctccggtcctcggcccgtaccaggcgacaacaggttcgagctctcttgtgccatttggggcaaccccgtcgcgccaccaccaacctctccggctccggagaagagctcgattccggcgtcgggaaccaggggccgcagggacctagaggagctgcgtcctctgtatccttatctcgtcgatgaggtggagaggatcagcaccaatgagttgggtggacatgttctcaagatgggattggagttcatcgatgacggtacagccgtccgtatgaacggcatggcgaagaagcagagggttctggagctcaagacgatgttgaagctagatagtatgaggaaggaggtgacgaggacgttgctcaacaacatggattgacaagatcctccatcgtggtatgactttgtgcatgctgtgccccttttgttacatatagctgcacgccaatagttttaggatgcattagtactctatctattataagatggtaaggatgatccaatgatatgtgatctggtcatggattagtatatattagtttgcctagtaagatgatgctgatggtccaacggtatggatggcgtatgggttattaatatatgtaagtttatctagtaagatgacgatgatctatatatgatcttgtttgataccatcagccttatttatttttgcgcttgaaatgtcattgggccttcatatttgattggatgatttatggtcagctagttaaaatggattcagggattcagttaggcagaaagttatgtcagatgaaccagtactatattgactaaaattggaagtaacttgatgttaaggtaagttaaaaggacacttgatgttacagtatgttcaaagtagaaagttctcatatatataacaaagtaagttcattgaacacatgggatttgtgtactcgaaaaacctggaattgtatcttaagctgtcaggaccaccgagaaagatatctgaagctcccactacaaatatttggttttactactcaattccttacatgtctgctgaataaactgtgtattcaaatgcttagaatttagacgaagcgcaaagagcttaacacaatgaattgtgaggtatttagaacaattcgtccctatagatctatttgcatgatacaattttagagatcaaataagattgaatcaatatgtacgtagaactattttctatattaacgaacatgtataagtagttggtaaacgttatataaatacatttatgtaaaaacattataaatagagttggcggtggtgccagattcactgccaccaccatttgacttcttttagaatagcatagatagtcagatacagattattcttcctcttacaaatccataaaaaaacaataccgtatccgtatattttattttttgcagatagtgcctacaggcacatatagatgcctacaggcacaaatattaccgtatccgtaatatttgcaccaagttttagtaattcgcagtatcaatattgtgctgtgtgtactttatttttccttgaaaagtgctctgtggtcacttttgttttatcttttcatggggaaaatcaaattactaagaccttgtgtcgcatgggctgaaattttgacccatttatgtgtatgggccaagattttagttaaagttcctgccttgtaaactagtacatatggatgggttgggatctggcccattaaaacaagtcctgaatggttttcccggtaagaaattatatatttgttctgtatgaactcaattggttagatcaacctgatgtttgcctgatgaggaaagaaaacctttgcttcgtcattctgtacaaacatatatattttctgttgacaatactcagtgaaaaaaacacactagaacggataccctcatctcaattgggcggtaagccccatctcaatcgggcacagcgtccgtcacaggctagaagtcactgatgtgaagagttatctcaatcgggcaaacggccgtcacgaatgaatatatctcaatcgggccctaagtaaagcccgtcaccgatagctttgacccagacgaccagtcaaactatagcccgtcacagatgacctatctctatcgggccacaactagcgcccgtcacagatgactactaacctttatcgggcctaaactagagcccgtcacagatgatactcatctcaatcgggcctaaactatagtccgtcatagatgactgatgacctcaatcgggcctaaactagagcccgtcacagatgactactgacctcaatcgggcctaaactagagcccgacacagatgactagtgacctcaatcgggcctaagctatagcccgtcacagatgatctcatctcaatcgggcatttagttatggcccgtcacagatgactataatccacaaaaaaaataaattttgtttttttg

SEQ ID NO: 37870 - DNA, 6046 bp, Oryza sativa
aagcctaaacattcctttggggttaattatttcgcggaggatgaagctggctatctcctcacgaacctcctcaaagctggtagtcagagacttggttattgtgccctacattgtcataattccagattagttgatcgatcatatataagtactaaaatgtagttagtctatcacaattgagaccaccgacctcaaactcagccaaagtcttcaccttttctctatacagaagtcgcatgttgtggcacacatggaatccgcactggtcacctatttgttgcttcaccgagaagtcttttttgtggatgagggtgtcatgtcctgtcttcttgaggcctcctctttgcacgtattaggcccacgcttcatctatcgctagttgaattggggtccaatcatatgcgttcttatcaattctagagttcaggtaatgacatgtactccatttaggtgttatgaccagaaggatccaatgggcactgcggcattaatatagtgaaagttaattaagtactcaaggaatgtgtcatgctgttgtgtatatttagttaacactcttactatttattataggcacacataatgtactccttgtctcggcgggaccacaaggtgtcgtagatgtagttgaccattccttgacggtcattctggagatttgtgacagtgaccacttgtggatgaaggaaggcaacttccggtgcatgcttctgacaccattgccaacttaacctacacataggatcaacgatcttgtaaggaagttaaaccgattgttattaccagaatgagttgggcgacaatacttacaaggagtagcacttaaggaggcttgtgtccaccgctcggagcttgtagaggtcgaaaagatccttgaagtcgaccacgatataatttgttggaccaaggaatggctttccatcgtgctgtccaaggatatcggtagctttacttggcttcctggcgttagatttctccatgtagtataagtgaaggtccttgcaagcggtgcccattgcggcaagcacgtcatctccaaccaatggcatgcctagttggaactcctgtggagcgacgtatttcttcttgacctctttgcccttagtctcttcctggcccttgcccagatctagctttcttggagctagaagcgaggtctgcacctttcctccccttcctctcccctttgcttcgggtttatcgagagtaattctctgaggggaagagtgtgccttcctgctcttcttcatcggtgggggttcatgaatcgccttgctgtcggcctccgttcggtcctccccaaaatccgtgtcgtactgcaactgcacatcgtaagattgtgcatgacgatcttgagcaggaggggctgaaggagcagaggcgggtctctttggtggacgactgcctggtgcagtggttggcctcgctgtaaccctgatctcaatgaggtccttgggccattggatgaaggtaccacgggcatttcctagtgagaggacctcgtcgttcggtggatacttcagagggaacagctcgtattcgggcttcaccgagtcgacttgaacttttgcacagccggccctgagttgcgctccatgcactcttgtctctagggtcggcttgtacgcaagtccctcggctgctggaacagtgaaggtcggcatcaccctaactgtgagggtgcagctcgttggttcctgcgatagattaatcaatttttttagaatattatatatcatatggattcgttacgtctttcatgtattgagtaagttcacggttaccgttatgtggtcgacggcgctgtcgaccgatgttggattttccgccaactcagttgatgcgcaactgctgcgtttttcggtgggacttcctaactctttgtgcgcagcagcagcggcagcctgggggatctgttgctcttttcggatctcttgcctaatcttggccctcatcgactcgagcttttcgtcgaatccagatgtcagctcagctcgtatcgactcccggatcttggctacaaggcgtgcatctttctccgccttgttggaagtccgcttcttgtactgccacgcgtagtctggaaatccatacttccagggaacagaagacccaacgccccgtgtccgtccacggtgttccttgttgcccaacgctttcgtgaggaggtcgtcctcgcgtctttgagagcaggcctcttgcaaggcttgttgctcggcaaccaactccttctgcattacaatttagtggggtcaaataaactgcacgatgggaaacaatgcgaacatctagtttgattagacacttactatagcttcgtatacttgttgatcttctgcatttggcatgaagattgtgccatcatcatgtttctggtacctagccctggcccagttcctagcccgagggtgtgggatatcgccaaacatgagcggtgtgcacgattcctccgcttcttcatcctcacgctgccattcctcttccttaccggcatatccggcggtaccaagccggtgcggatgctggttcctggtctggagcaagcgatatgcctcacttctagctctggactcgggggtcgacttcttcgcatggaattccgactagacctgttccgtgatccaaggaaatttctctcttggatctggatttgccgggttgtagacgaactcgccgactagcttagtcttgaagttcttccaagcagtgcccataaccttgaaagcagcccacctgagacggtcctcatgctccgcaggataatcaaagctctccttgaacgttagccaagcaatgtccttctctgcggccggcacgagcttgaagtcgtcttgcagaatactgaatttctgcctccctatgaccccacagatagacctaaatcggctcaatattttccttggagatgtccgcaaccctacggcgtccaccgctgttatgcggaaccgttccttaggaattttgttccctgtcctaggagtacgtgcccttgaggacccactagttgtcgtcgacattggttcgccttgctgagacattgtctactttttttccaaaaaaacaaaaaaaacacaattgagtgctacaatctattacaatgaattgaatgtcacttataaaaataaatgaaacatataaataaactaaattgcgcatatcacaatgatagaattaattgaatggcacatataaataaattaaacatatcatcaaatcctaaaatcataaattcacctcataccatctattcatccacatagcatgcatctatcactaaattgattaatgcaccacattccatctattcatcatcatgtcatcaatcaaaaaaaatcattcgtttaccatatatcatcaatccctaaaatcatctatcactaaaatcatctatcactaaattcattaatgaaacacattccatctattcatcatcatgtcatcaatcactaaaatcattcgttcaccacatatcatcaatccctaaaatcatctatcactaaaatcatctatcactaaattcattaatgcaccacattccatctattcatcatcaagtcatcaatcactaaaatcatctattactaaattcatcccaacatccacatttcatcccaacatccacattttcattatcaaccacatgcaggtagcagagggaggcgcgatggaggactcacatgaggtcggccgggggggctcggtggtggcggcggcgggatcggtggagggcgtcgccggtcggtggaggcggcggcgggctcggtgcaggaaggatgtcgccggcctcggtggtggctgctgttcgtgtcggtgaagaggcaggcggcgacgacgaggaaggccgacgccggtcggtgtagaggctcggtggcggcggcagcgggctcggtggaggcggcgggctcggtggcagtggcggcgggctcggtggcggtggcggcgggctcggtagaggcggcgggctcggcggcggtggcggcgggctcggtggcggtggtggcggtctcggtggcggtggcggcgagggaggacgacggcggcaaaggaggagttggcggcggtgctagggttctaaggaggcgggaaattgtagcgggacttagaaaaattttcgatccgatctgagaaaccctagttatattagagtgatgagtcatctcaatcgggctttgccgtagagcccgttacagatgactcatcggtgacgggctccatactaatgcccgattgagatgacattcaggcccgtcacggatgactcatctgtgacgggccctaagataatgcccaatagagatagattaatctctatcgggcttgaactaaggcccgtcaccgatgactatttttccatttcccagataagtctttatatttgtgagtacaaaatatatagctgctgtataataattcattttattagtcataacatattttcggatagtaaatgatttcaaatcgaaatatggtcaacaacaaaattgatcctctcatcaagatgtacaacttttattttggtcatttatctatataactttgtttctaacagcttgaaattgattttgacaatatgacaaatgtaaacagcatttgtgaggtcaatgtaaacaggctcttggggatcatcgtcaaggtcaatgtgaggtcttacatgaagattatggttgtattcttcttcatcgacgacgttgtcaactcctacaattcggcgctttccatccctcacgatgtgcatcttcttgtttgaagggtcttttatgtagaatatctgctcgacctgtttcgcaagtacaaatggttcatcggcgtatcccaccttagatagatctactaaagtgaaaccttccttgccggctttgacaccagtgcgtagattcacccaacggcagcggaacaaaggaaccttgaacttgacgtagtttagctcccagatctcctcaatgcggctgtagtatgtgtttgacccaacttgatcctggaatgcatctatacggacgccgctgttttgcactgtgcttttgtcatcttgtttgacggtgtaaaatgtgtatccatttatatcgtatccttgccatgtgtctatggtccaagacggtcccatccccaacaactgtactgtctcatttgggacatccgtggacattgtcacacgattcttgaaccattcgttgaaccaagaattatgttctctgttaatccatgcatcagatcgccccaagttctcatctcggattttcactaagtgctcctcaaagtatgggccaacttctgcatatgttggagcacagcgtaatgagcctacgcgtacgacgtttgatcgggcctaattcttttccttccgattgtgccaacacctgacaaccttccctcgtgacgagacgctggaactctgataggatcggcatcggacatgtaattggcacagaactcaatagcctcctcggtcgtgtaaccttcaatgatgctcccctcgggtttagctctgttacgaacataagacttcagaactcccatgtacctttcaaacggccacatttcccttagaaatgctgggccacatagttttgtttgcttcaccagatgaacagggagatgaaccattatatcaaagaaagacagtgggaaaaacatctccaggtgacagagggtattcacaatatcggtctgcagcccatctagatcttctggatctataaccttctgtccaattgcattgaagaaggcgcacagacgttggatcgtgtgacgcactttcggtggtagaatgcctctgatagcaactggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatccttcgacagtgtgtggcaggctggagggaggtacactttacctgtctctgcatctcgtatgggctggagttcgctgcgaatattcatgtcctgtagatcaaggcgcgcgttc

SEQ ID NO: 37871 - DNA, 8104 bp, Oryza sativa
ctaaaaaaaaaacaaattagaggcacatattataatatagtattgcaaaagtaagacgtgatgaaattgctcaattaatgatttatattactcacttgattgatccattttaatcacttttgggaatttaatttctattttccttggaaaaaggacaaaaaatcgccccctacagcttcccaccaaaatagtgaacagtgggatacagttacactaggtggtggggggtatttatactgtgcaacaaatatctgtaacgtccctaaaacaatcaaccgtgacgggcatacaagtaatctctatcgggccttaataaaaggccgtaaaaaaagagtgtcatgtgtgatgggcaataaactatctcaatcgggcctctagttggagcccgtcacagatgaccctcatctgtgacgggcttcttttagggcccaattgagatatggaaccctcatctcaatcgggcctcaactatagcccgtcacagataagtgtcattcgtgacgggctttagttttatgccgatataccatggctgtgcgaccatatctgcccgattgagattacttccttgtgacggcccgcaaattccagtcttgttatgggccgtcacagatggaaggatctgtactagtgacataagagtaaataaatttcacaaaactacatatatcgtggcttaaaattagttttcatatagttaatcgaacaaataggattaatctagtctagcaacctgaatttgtagtttatgctaaaaatatgtgaaccacagagaaacacatctgatgttcccaatttcgtatatttagttctgctactccatgccttttatgtttgttgagcaaactgtgcatttgggtgcttagaactcagaaaatatagaagacttaacacgagcttctttggcttttgcatgtcaatcatgtggaagatttgtactagttaattcctcctcttataaatccatcaaaatattatccgtttttatgaaagttctgtatatatgtattaattgttcttcatagaattttgtttacagaaatattaatgctactgccgatgtaatcttcagcatatgtaaacaatgtcatgctttctcgtaccttgatcttgtcataattcatattgcgctgtatgtctagttgtctacttttccttcaaaaacgttctgtgatcagtggtttgttttttcttttttgaatggtaatataaaataactgaggccttgtataggatggctggaatcctggccctttcgtttcaatgggccaagatttttttttttaaaaaaagtaagcggtaggagaggttcctatagtgaataaatataaataatatataaaaaagattacaaaatacatatgtacatgaaaatgggccaagattttagttaaatttattgtcgtatactcgtggatgggttggaaaacaaggtttcagtggtttttctggttagagatgatcgtattattctataagaaattatcaatcagttagatcgatctagctggtatttgccagtgtcatttggaaaaccttttctccggtaatgaatacaagcatagtttgtgtactcattgcaacaaaaacataggagtaaatttcacaaagctgcatatatcgtggcttaatttgttcagttacctatatttttctaaatttaataaaatgtaagttagagagaatcatttaatacactataatgatttacttttgcatctacgttttgaaagacgcctatatataggatacttattttcaggcgttataaatagattcctctatgagttttcattttcagatagtctgtaaaatggcccaacaaaggcacattgccaatttccacaaatagtgtaatcaattcattgtgacaagtttaaaaaaaattatagaaaagtgctgccttttattgtagtttatttgacaggaaagattctctctaaaatatcttaagctcacaccaaaagatagagacaaacactactgagtttctctaataagtttccaaaaaaaaaaatttccaccatttagtaccactaaacacacacttcttcagttaagtttcttccaagccgcagacaggattatctcacaagcatcagaagtcatcaccgtaaaagacaagcggcctctgctgctctgcatcaaaccagggagttaaactcaatatttaaaattgagaaactatgtgctgattgtctataaatatattgttgatgtaaatttggaatcgattattccgcatgagtttgaccatgatgcacatagtgtaatgaagacatgagtgtggaaatctctacgcgcatagtggaaatcatcgacccaggttacccaatagatgcataggtaaatctcatgtcatgatcacaaatagccatcacattttaagttgttgatttagatgtaccgatatatctaatcttctcatcatctggaactaatgcaaagatatgagtaccatcaactgctccaatgcaatcgttaaaatgtggccacatgcgacgatctttcctaattctgtcatggacagtaggaaaatttggattatttggacgtacaatatcacgtcccaaatccactacgacgtagagtatttcaaattttcttgaaattgtctcaccgcaatgcttgaaacggttttgtgccctttggtttgatgaaccatcacctagtatgtagagaaaaattgcaagtgcctctaatgtatgcatgtgtacagtaagttccagcttatatttactaaccaaaaaatcatttaatgcaataaaggtgtggtcattcatacgaagcatcttgtagcattcacctggtgtggccaaagtttcttgcacccatcccattccactgagacgtgatgtcctaggctcagccttatccaagtagagagagtaatagttctctgcaattcttcgagttgtacaaaaattgcttgcagcaatagcaaacaattacatggcaagcaaatcaaattcatattcttcatctgatgaaccatttttactctcactttgacatctacacattaaaacaataaatattattagaacacagatatatcaacattcatgaatatatagctgaaaataagtcagtccaatagtagtgcataacaagttcatagtaggtctaaaaataagttcacattcatgggtatacaacattaattaacaaggtgattttatccaacaatagtgcatgacataggtactcaataattgttctcataattgaatacaactgaaacaacaaggtgatacaaccacaaattgttcagaattaaatttaacccatacaaacatatgtctcaaacacatttatagttctgaaatgcattgacataacttgattaaagggatacaattcatggctacaccacattcaactaatttacatacttcacttcatacttcttcttaagccatccaaagcgacctgtaggagtgcgcaaataattaacaaacatttccctttgatccttcttgataaatatttcaattgcaatgaaatactcatttatctgttcaacagcaccacattcctccaccaaggccataacatcctttatagaacaatccggaggatcctctcttgttttagtgaaggactaaatagatgataaagtctgtgaagagagttcattactctttgacatctcctctaccatcttttgggatccactcttgttctttctggacttatccacctttgagccactacctctctttcgttttgtacttggttcatcatcctctgtctcttcatcgatctcattatcatcagcaatatgaattgactcattggtgggtgttggtatagtgccttaccataaagaccaatggttgacactggtattgcgaatgtcttcaaacattttctgcagtagctcttcattttgcaagccaaccttcataaacttggtgcatcctggtgtatcctacataacatggcattatacaatgggttagaacaattaatttggcacaatagttatcaatttaacacattatttcaaaatacttactgctttcaattgcttccaacgttccacagtagctgtaacagtttcctttgtgttatcccatcctaaacatgtttgagatgtcaacttcatccaaaaattgtattcaaccctaagcttatcccacttattcttaatttgaagcctagtgtacctcaaacctgttcttgctgcaaatttctcaatgacttcatcatacctaggattagataaataggtatttggacgattacccgcatctacttgctcaacaaaaatctcatagacaactctagtgttgtagtcattccaatcagcagagcccatgggcattttaacacccttcgaaggcccattttgagccatgcctatcatccactgactcacacaaatcttttttttcaacacaaacatatatcataggttcaaatttagtacttaacatatatcatagttactacccacacatgacatgagcagaaatcaaatgtacaaatcaatttatttttcatgataagatgaactagcagcatgaaagtaacatgagcaaaaaataaaatgtacaaatccagccatatgtttggtgtactacagccgtaataatatattgtcattctcccgtgattataacctacaatcaagcaatcaatccccataaaaattaaccaaagttgagggagaaatgaattgtgggtagccattgtcgccaccaatatgacattgtcattatctgaacttggatgtatatctatttatctgagacaaaacaactggacagtgacaattgcctaaataattctacttctagggaggtatgtgctttcaaatcattgcgcatacactgtcggaaagtgcatccttattcagaaaatatactagtaaaaaaagattatgacatgaagtattaagtgaaaagattgaagtgataatgtatgaactttcagtggtatataaggggtttaattttctcgtttcattgtattccatacatcagtcagtgctactaaggagtacatatgtatttattcatgtgctaaatctgaactatcaaattggtttactaaggtttggggataacttgcacacagatatggagaaatcccttcacaccgccgctgttgccatgctccaaaccctgctatcgtcaccgtgctgcgtgcacacagaaaggcgccgtcaccgtgcgccgccacctagttgcccaaaacgtagctccaagaggaggagagagagtagctctgccgccgtgtggcatcgcagtcatcgccgcagccgcctcctcgctcgtctcccctttgtctcctttctagcgataaggccccgagggcgacgagtggatgggaatcgcacccaccggttcaggttgatctaaggggtagtgcgatggcattttcctgtaattttgatgaaaagggatgggtggccctataattattttcagagtggagctgtggagccacgttttcgccgctccacctcaacaatacaaatttctcgagcaattcaccccgctccactccaaattttgtgaatctagaccgtctggcacagccccagctctatgtaagttggagttgggagctgacgctgtgataaacggggcctaaatgtgcaaatggtggaaatctctgctactccaccatgtgaacctcctctcggcggggcaaaaaaaacatctttgcatagaaaactattaaggaaccggcatgttggtatttcttacaatcacagattaattcgcaagcgtacggaatgccgctatatcacctccccttagagtaatctaatggtatcgaacacgaggaacgtgcatgcattatctacgatcttgattcaatccatgaacaacaaccttagaataatttggctagagaagattcctatgtctttttagttagttaattaagttaaaggttaaactctatctgtcttgctaagtccggccttgagctctatgatgtacccgaacgtgcaggtatacaaagaacaaacaatgttgtcaccaccaactgcctacctcacttttcatagagcacacaacaaacaaaggtatttttttaacctagacatgatgcctaagttattaattactattctagccatgctcaggaacttctttttttatccagagacctagtactagagcactcagttgcacactaatcgataaacacataccgatatatctcacataaataaactaattatagaacataaacaaactcaaatacttactttataaaagaagcatccaccgctgtacgagcgagagaagaaggccaataatcctggctttctccagaactccgtaggaagaatggcgacaacccagcactccataaaattctcgaaagaactctgatgtactaattatgaaactacaagtgagatgtactctacttgagctcaagtttatgtgtgttgaagtgcggaggaagacctccttttatagctgctaatgactgttcaaatggtggttaacccctcacaaccgtcattgggagttcatcccggtcttctacatgtaaggtggagataaggtgggccaagagtggctagtgggccccacctctctccacagactttctccagcagtttacaggtgggcacctatggcgattaaggatggtttggccccacttttaagtcggtttcgactgacttgtgcaccctccaatccttgtactcacatataattggccagaggttcattttaatcacatggtgggtgtattttctccttaaatgtcctgcaaacatatatttaccaaaactagtggaagtggttagtggtaaactcctaccactaagatttgatagtatatttgatacaacctctgtttcatattataagactttctagcattgcccatacacacacacacaaatatatatatatatatatatatatatatatatatatatatatatatagaaaaactattatatagccacctcccacctcagtcaaaggtcagtcaaagcacccccacatcagtcaaaacccggtcaaactgcctaccaactcccccaccacccacctcttctcagctctcgtcttgcgaaacagtgtagtaacgcgacagccatcgtgcagtaatactgtgtcttacgtgtagcaataacattaaaatttagttgaaatatagtcatgacggatctacttttgataagcattttttttctaacatcatggtgcaaatggttttaaaaaatcatacatcacatgagagatattgttattcgaagcttgggtttttttggatcttaactctccacaagtagtaatactatagcattactacttgttactactatctgttatgcgttactacaatcccatcacgacgttattgtaagtgtgtagtaaaagccataagttttgtagtaacaatgcgtcttactgcaatttatgaatagtgttactgcataaacatgtggtaacatgtaccttccatgtagtaacacttcaactttgtgcgataacaagtatatttagcatgtgagacttttaacccatatttttcttttgatttctggtttactaacgttctatatgttctacagtaacaaagtgttttactgtagttcttggatagtgttactacataaacatgcggtaatgtgtaactgtcaggtggtaacgtgtatatgccgtgcagtaacacttttacttttgtgcagtaacaagtatatggttagcatctaagactttgaacccatatatttttatttcaattcctggtttactgtaattcacaacaatattactgtcaaaagtgcagtaacgtcatatacatgcattgcagtaacactatattggagggaggagaccagttttcttgacaagagggaggaagaacgatttcttgtggaggggaatatgtagatgtattttgaagtttaaacctccacatgcactacagtatcattgtgaaaacggtattaaaaaacaatacatatcttgtgagatattgcttttcaaaaattggcattttgaactttaatcctccacatgcagtaacataatgtgtaccttgcagtaacaacggcctatacatgcagtaacatggttttaccaaatgtataaaattgttcaaaacactt

SEQ ID NO: 37872 - DNA, 5561 bp, Oryza sativa
tcatctcgtaaacatgacatagtaaaattacaattatcgtcagtaacatagctacttggaagtgataacatacacctatcatgtagtaacacttctacttttgtgcagtaacaagtatatggttagtatgtgaggctttaacccagtaataccagtcacttgactgtaataacaacctatatattttgtagtaaccggacgcgtatcgttactacatgttttgtgccaaatactacaaggatttagcacgtatgagaagataaatttttactaagaaaactctctcacaactgagaaatagcctactggttagtgccatgtggtaatttgagttgaaggtcttgagttctattcccattgaaggcaaattattcctttatttttttctctctcaaaaaaggagagaggtggaggggggatcgggagaaagaaggggagagagggagcgagcgctcgggtggggagaaaagaaggggagaggggaggagcgctggtggggagaaaaaaggggagaggggaaggagggcaggagaggcgtgtggggtgggggaatcgggaggggaggggggcatagaataagtattctatacctcgggtgggtgtagaatagtcttaccctatatatatatatatatatatatattaatgaatctagacatacatatgcgtttagattcattaacatttatatgaatgtgggtaatgctagaaagtcttataacctaaaacagagggagtattttctgtgtaggagttgaaagttaaagtttgaactttacgttcgtcaacagaaggctcagccttggttacccactaattgggctcatcacttactatgaaatgtgaacaaggcatcatctataaatagagagttggaggagaggatttgtacacgtgagaatgaaagaaagaatgagaaagaagccacacccccacatcttgtgcctccattttttctagaattatgcaatccctcttgaactatactttagcaggaggggttgcgtaatgcgttatcagcatgatgttctactggagaccaagaaagaagaagggtaagaaattgtagatctgcatcgtatttcttgaatcgaatcacaaaaatggattcttctctccattcttgatatgttttaccactcgcgataaacaccgccaccgccgactcggagtcatcggtggagagccaattcgggtgttaagggcagtgccactggttggaagttgtgcccctcgaacaaatctcggatcgagtcatgcacttcattgtgttgcgtcatgacatccaggttgcaaggttgtaggacgcccgtgtcccaccatgatcgtgcaccgcaacatgaaggccgcgaactgtatcacgcgggaacaatgggagaaagaagaaagaagaagaacgaaaaaaggaaagaaggctgtagccccgccactcctaccatggccatggagaccgccacatcgcaccgtcggccagtgggccaccgcatggtcgtgccactcctagccccgccggcacatggtcgcgccacacctcgccatcggatggccacgtgtcaccatcctcgcatggccgcactccatgctaagcgtcggatagtgccgggctgagcctccgacatcgtcgcactacaccctgtggcgccatggcttccgccgccattatgggagggagaaaagaaagaagaaaacaaaggaaagaaaaaaaggaaaaaaaatggaggaaaaagtagcaagcagcactagctagcgtagccgctgtcactgaccacccgcaatggccgcctaccgaccgctcaccttgtgcctgcccgtatgccacctccggcaccaaccatcgtgccgccgcatcctcccatcatcgtcgcacgactacttcgccgtggctcatagccgctgggccgtgccgttgcaccctcgtacttggccgtcgtgcgcctaggctgtgttgcgccgcctcagcttcccttgcccatgcgcatggccattgggggaaagaggaagaaatgaaacatagaaggaaaaagaatctcctacgattttacaaaaagtccattgtagtttttggaaattaagcgcatatttcttgcattggaaactttacgttttatacactgaattttctagaaaatacacaaataaccctcttcatttgggatatttgtttaaatagcatttgatatttgcaaaatccactaaaaaaatgtattctctcataaaagagccaaggaattttgaatatcgatcccaaccatccaagttgaggcacttttcttgttgatgtttatgattatgaaatttatttatcgcattttttattattgattatttgtaatgctgtttttacctttaactaatatctttgcgataaaatatatagaattgcatagaatatattggaattatttgtgaaaattttgtgtaccattatattgcaacatttgtacatgttacctgaataaaatttgcacatattttcgaatgactaaagatgattggcatcgcgaactagaaagttcgccaaatctagattatccctgacatatgcaaccaaagttgaaattgtactgtagtaggaagctctgaacaccattaactcaagtgcgctctatttattaacttgatgagattgatcaagcatttctatttgatatctcttgaatgagttcactagacgaatgagggcataggcactcttttgactgcacaaaaaagtggtttaaaggattatgatgcacacccaccactcatagagcaagaactatgcgcaggaatggatattttcgattcaaattcactaagcaaacgatccgaagagtatggtaatacgatacaccgaatttgcacccaataatgtgaaaactcttgatgctctatctaaacgcgatgaaagtcgcacgcaagtatcattagtacgcatacaagaagtatgcctagctagttgagactagaattatgtaatgttcaggatagtgttaactagaagaacattgccttcccaaaccaccagcacacagttgataatgaaatcaacacgagcagcttgtctggtctgtatttacctcaacgaaagaagaatctagaacaatgcactcatgagtatgagaagaaaaggaaaagcacactcatcatgaagagaactcctagcctatttgcatggctacggatgtagaatctcctatgctaggctggatcggtcctaaaatttattttagactagaaaaacattgtcatagctgccgagcaaaaagctcactgtcaagttaattgaatccaacgtaccggaatactttgtttaatcaattcactttgtcatcgtttgttgcaatttttgaatacaatattttttcaatacaatattttttaatacaatattgaattgaataaatggtttctaccctagtagagcacacatttttctctgcaataaaggattatttctagtataaaatagtatatttgagacgtttactattttgttgctttttcctagcacatgattataatgctttgaattttgtgttgcacccaaacattaaagaaaaagattgaattgtggtccacataaccacaaatagcactttaagagaaacaggcattttttttaaaaaaaatagaaatagaaatactatggcctttgctagtagcagcaattgaaaattttggccgtgccacgatcatattacctatggaacaaatatgcactttataaaaacatttattgtactatgaacttcattgaactctctaaaattatgaagatttgggttacactacttgtttgcaataatttttctgccatattggtcttagaattataagatgtatggtcatagcacatatatgcataatttccctaaataaggaagatttgtgtgccagtatgcaccagcatgagattaacacatggaccacataccacgaaggtataatttcagcatctctgaagtggattgcatggaatacttgcgctcctatttttggtactatatggatagaatgcttctgaattagtcaacatcccgtgtctatttgaaactgcatatttgccaagattgatccaacaagatgacgtgaactcgaatgaatttcactaatcatctttagaagtccataaggacaatgctaaagtagcatttgatgattggtgaattggcatagactagcattaagtaccaaatatcgagatgaatagactaagtgatgcggacatcactccttcggatacacacaacaatcctccaacggtcattcaaggaccgataacaagagctcgcgcgcgataattgaatttagaggtgagctcgttcttatgttcttctttgtacgaatttgagaatagattgctacctaatgattatattgtgattaggaacaatggaggggacaaggagacacttggagaacgacttagagtcatggaggatcatcgaggacatccaagtcaaggtggaggcccaaaccaagtcaacttcgagtgcaattcggagtctaggaccagtctgcactaaaacgggcacctaggtcatatacatgctcggattggggcgttctttatatggatggaaagctaagaagataacatttccaatcactactaaaaaagtgatttttctgtacgagagcccatgatttttgtaaacggaccataactagtggcgtctacaaaaatcgagcgtcattttcccatacggctccttaagtggcccatatggaaaaatcgattttcccatatgggcctcttaaaatggccacaagcaaaaatgagctcatttttgcatgcggctcacttaagcgcccacatggaaaaatcaatttttccatacgggccacttaaggagccgtatgcgaaaataaaatttgaaaaaatttaaaaaattgaaactagtttatctcaatcatatgaaatccaaattagatgatttttttcctaaatgtttctaaaaccatgctctatcatgttattgcgttcatattgctattattttggtcattttttcttgtgactttgtttaattatcaattaaaagtttgaatttcaaaacttcaaataatattttgaagtagtaaatgaattcagatgaaaaagtcatcaacaacaaagttgtataactcatcaagatctataacttatattacattcatttcctcatccgacaaagtgatggaaacattttcacaaaatttacatatctctctccatagtttataaaactatataagagatatacattttgtgaacaatgttacagataactttgttggatgaagaaatgaccaaaataaaagttatagatcctgatgagttatacaactttgttgttgatgactttttcagttgaaatcatttagtatttgaaaatgttgtttgaaattgtcatattttgaaaatcaagttcaaactgttcaaacacagtcatatagaacaatgaccaaaacaaaagttgtagatcttgatgagttatacaactttgttgttgaggacttttccatttgaaatcatctagtacccaaaaattatttgaatttcctatattttaaaattcaaattttatagttcaatc

SEQ ID NO: 37873 - DNA, 12815 bp, Oryza sativa
cggccgcgggctccagtgccaaggcggcgggggcatcgatccgacggcggcggcacgacctcacatcgatccggcgagggagaggccgcgggctccagtgccaagggcggcgggggcatcgatccgacggcggcggcacgacctcacattgatccggcgagggatccagtgccaagggcggcgggggcatcgatccgacggcggcggcacgacctcacatcgatccggcgtcggcggcccgtttcggcgtggatccagcgacggtgcgacgacggcgtcgatccggcgtcggcggcccgtccccgcgtggatctgccacctctacctccctctgtcatcgccatcgacttccccgccctgccccgcggcgcgacgacggcgtcgatccggcggcggcggcgcgacctcacgtcgatccgcgtcggtggcccatcccggcgtggatccagcggggacgcgacgacagcatggatccggcggcggcggcctgtccccgtgcggatccggcgccgacaacgacggatgacggtgggagcggtgaagtggccgacgacggtgacgaattcggcagcgcggaggccggctggattgggcggcaatgggctagggttcggctttttttttatttcgctgaattcattttcgcatgcggctggtataggggaccgcttgcaaaaatccaatttttgcatacggttgctctagccgtatgcaaagatgacgatctttgcagaaaatttcgcacatgcggctggcctagccacatgcgaaaatcgttgtcgtccgtctgcaaagacgtattctgtagtactgaatagttttggtcccacatccaaattctttccgagtcaacgggaatcgaccgaacaagttgacgtacataatctgtcctggtgctgcgtcaccgtatttgtgtctttgggccgtgtatcgtgttggaacccattagggttgcatcaagggttggttgtacgaccctaaaatatatatatcaatactcgccgtaatcattatggtttgggttttgcttagattattctgtcaagaacagtttcgtcgctagatcggtttgtggaaccccaaattcaagtgcttaatcattcatatgcaattgtgttgcaatctatcttgttcttgcttgtgttcttcgattcgcatgcagtgattagccttctcgacgaggtcaaccgtgtttcggcacggttgataaccagaggagacgtggtgctgcgattgcagggctcagtagcgtgttcgttcagaagccggatcgatttgtgtcgcgactcctcccaaatcgactgtttatcaatacctatcataagattgggacctaacatccctcatcagtaagacccgttctaatatctatggattgcagtatttgctataacattattgtaatacccgttgtgtgacacatgtagtcctaaaagtaagtggattctgatagaaaatccaatatcatttatgaggataaagtagaatatgtcacacatatacaaattgtatatgagatacgtgagaagcaaactcactaagcatatgaaccccaagttcttctatgcacataaattggataaaaacaacataatattgcggaatgagttatgtgaaaatcatgcagatttgtccactaaatcatcgttgacatcttatcttggataaatatgtccgagaaaccgaaataatgagaattagagaaatgcaaaattcagagggagaatactgttaactcattccagaattttgatatgaaaaatcaagtgcccaaaatcaatatagaaatattgaataaagaattgggtggattgtacttttcttcccttggataagttttccctacagtttttaatcgatgtttttaatgagacaattcgtacgatattacaaacatatgctatctactcatttttctccaaaatttcccagtgggtttttacggagttttgatgaggcaaatgcatcacgcagtgagagctaatgttagaaaagggaaaatgttagaaaaccactggcatgtagaagtctagcctagttacccactagtttggcccatcactaatatgaaatgtgggcaagacattgcctataaatagagttttggaggagaggatttgtacacttaagaatgaaaagaatgaataagctaagaaaaaaagtcacatcctcatattttgtacctccacttttatagatattatgtaatttttctggactatacatggttgcataataataataggcagactattttgctatttcatggcattctgaaatatattagcctactctgctttccaaccgaaatccactgcagcataagtagctttttgaaaagaaacagcagcatatatatatatatattgctctaattaaagccaaacaccagaaaccaatagaaaatggcaaagaaagttattcctaggtccaccattgctgtaggatgggacatgtgtatgagctctagttcatttggaatctttaattcacatgcactccctaacttgatttaaaatacaggcaagcatcgtcaagtttcttttttatttgtttgtttattataagccgatagggagggcacgcggcgaaacatggcaacaacatggcgacatccgtaaagtacgagttctattttcatatctatgaaacctaatgattttctacttttctccatctagagttcttcccgaagctctatgaatttccctttcccaatactggattcgttcacagtgcaccagtcgatcgtcttatacagcactaataatcaattgaatcgataggaattcagtggcacatgtcacacgcactagaagagagagtaggtaggaaccatgcatatacaactatttagtaaagatgctcaaggaagcactggatccttcctgctaaacacagccacatgcatggcagtccctgcccaaaaaagatattcattcaataaaagagatataaagtataataatacatattactgcattttaagaacggtgaggggcggcaaacaatttttttaatgaaatatgatgacccctattttacatttagggttcaattttcagcaaaagttatggttatcatagaggtatgaaaggcacgcacctacaatggaacgtcaaaaattggaccttcctcgctactgcgctgggcacctgacctctgctgcacgctcgagagcccaaaccagtactttccgcgtaaaaaacatgcaagtatacgagtgaactaatgctcgatgactcttctgcggcggttctgcgctcagctttgatcgttcgtcttatttgaaatttttttataattagtatttttattattatgagatgataaaacataaatagtactttactcgtgacttatgtttttaattttttttaaataagacgaacggttaaagttggacgcggaaaaccatggctgcacttataatgtgtaggatcgaacacaagcaaccaagcctaccagagggggtgaatggtagggaaaactaaaaacccaaaaacttttagtggaaatgaaagttacacgcacaacctgacccacattagtcacacgcactcacaccaacatccacacaacttttcaaaccaattcatcgattaaatcatttgtaaagccaattgttcatcacaaatattaatcatgacaatgatttcacaatctcctccttgataaacacattggcaacatcttcacaatgcaattttatgtttttgaaaaataaaaaaaaatcacaagtgaaaagaaaaactctccccctttttaaaagaaagaatttctcccatcaattttcaatcaaagcacaaaattgactattttaaaatcgaaacaattcaattctccctctttcaagaagcatgcattttgtatatttctctccttttgataatgatttcatcaagaatacaaatgaaaaataataaccaataaagcaccaatgcaatgatgtcatgattgtcacttgtaataaccattttttttcgagagctttgaaatgtacctaaagcaattcaaggtcatgttttgcaagacaagggagataaattaatcaactagttaacaagcatgcatcatagtataaacatgaatcaaacatattacaattatgctcaaatcaacaataaggattcatgatttcaaatgatttataatgcaatatattcacaagcacataggttgaaaaataaacactatacatatatacctattgcatttatcactctttctcaaattagctttagcacaaaacaaccaagagaattttttaacttttatttgagcctttttgctcactttttttctctcaattattccgggtacatccttgtcgtcaagactgtttctaaggattcggcacctattatttttgctcacatcgaatacgtccttgtcgtcaaagactgtttccaaggattcggtattcatttttttcatattttttattctcttttcacaatgaacaattaaagctatttgaagaataacaattcaataaagcatatacataagcatttataaatcaaaccatatgctagcatcaatattgcatattttcttaattcaagtaacgaatttaagtgtcatgcatcatctcacttaaaagaaatatctaatcctcatataaagactaaaatgcatacaagctaacatagaaacaaatagacctcaattattttgctaccatgcacaagaatatactagaggtataaaacaaatctcttctttttcttatttttatttattttcagatttaaaagcaatgtatgaaaataaacatgaatgcatgaaaaagcattaactccccctcaaattaaccttcaattctacccgaaaataaatcaagaagaaatcaaagattttgaaaaagacatccaattgccaatgacatcaccaaggttctcatgaattgacatgtatccacttgtattaaaaaaactactacctgaaatactagcatatgaaaagctaataatcgagagagtagaaccaaaaatatgtcaatccaaaactaaattgatgttacctttaaaagcaatcgtcatctcaacgttgaacactcatggggagtatgccaccaaaatacctacgaacgagaagatgtcgaggcctccgtgttggggttagaaataagaaattttggaatccaacactgagtcacacgatcagtagaaccagtaggtacatatgcactaacaaaatcagaaccagacttacctgaaaacttaccttgtcgcttcacaaaagcatgatttgaattatatgcaaagttgccctgaggccggtctgaccgctgctgtcccagcggtctaaccgggctcctcgaacaaaaacctgatttttgccaccgtcgttttccaaaagaaatttctgtttcctttttctgtttgcgggcaagtcgaaaacaaaaaccaaccaaatgtccatcttttccacaaaaagaacaagtgtacttctcacgacaagtttgtgaagtagatgtttttgaaattgatggttttgcaacaacagaaggttttgcattcacaacatttgatttcgaagaagatgcattcaaagaagacatgatgccagcagatttaaacacagtgttcttaggctcagattcaatcaaaatttcacctctcctacagtaggaggatgtctagcatgataagcataagaatcaaaacctaaaccacgattgtgtgtgctaactttagattgatcaagaatcatgttgaggttctttttactatcagaaaatctttgcaaagaacttttcaaataagaaacctcctgagtaagaatagcacaatctttgcaaacatccaaaagacctttttgttttctacaagttgagcaaataaacacctcatcttgtttaataatttcttccatgtgtttaacacgccctaaagcatctttcaacttcatctcattcagaatacactttgaacaatcttgagaaatcaaaacaccattgttttgttttgccttatttgcacatgaagcattgaccaaagaacttgcacaaaaagcaactttgtattttttcaaaacgttcttggtcaaaatcaactcatcaacaacacgagcatgtaaagcaaatccaagagcaaaagaagattccaactttttagattttttaatctcaaattccaattttttgcaattaacagaattgacatctcgcaaagcattaatttcagaaaataaaacttcacaagattgacaattatcgtcattaggaatcaaagattttaatctagcaatttcagcattaagaatctcaatagtatgatccttctcatcaagaacaatagaacatgtttgaagtttcttaccaaatttgtaagcagtatattctaattgatcataactaagcttttcttcattatcatcatcagattcatcaacatcagaacttgcattacgagcaataaaagctagatcaacaacttgcttacctttgctctcatcttcatcttccgattcatcaaaagcttttatgatttcttggattaaccactgcatgcaatgtttcttcttctcctttgtgttcttcttcttgttcacgtcatcctctttgactctcccatcatcttccttcttgcctctcctaagcttaggacaatgtgagcgaagatgatcaagtgctccacactcaaaacaacaattcggttctcctcttttcctgttcctaacatttttcatagctcgagaaaatttgttagataacaaaaccaagtcctcctcctcgaactgttcgagttgatcatcagacatggcattaaataaagcaagaacagaagacttcgacgaagaagcaccaacgtccaaagaagtcgaagacgaaaccaaagcacttgacttagaatcgactttacgagcaagaatattcatctcatgagttttcaattttgtgtaaagcgaatccaaagtcaaagtagacatgttaacaaactcctgaatagatgtaactttcatctcccaaatagacatgtcaagatcattcaaaaagtgacgagaaatctcaaattgtggataatttgcatcataagaagaatcaacagatctaagatcactcaaaattttattaaccgagaaagataatcatccaaagcttctccaggtttcatcttaaatttaatatactcctttttgaaaagatcacgatgaagttctttaatgttatttgttccctgatgaaaattactcaaagcaatccaaatctcatgggcagtttgaagatgaacaacacgatcataatcagaacgagaaatcccactcaaaagaatattgcgagctttgcaattttgttcaaactcaatttttgcagcatcagtattaataactttaggaatcacataaggatgagaaacttttctccaaatatcataattctcacccataatgtaagattgcatcctactacaccaaaaaaaaaaatccgttccatcaaaaacatgaggcttagttgaaaacctaacagaagtagccatggcaaaaactttagatcgataaaaatccaaagaagaaaacgaggctctgataccacttgtaggatcgaacacaagcaaccaagcctaccagaggggggtgaatggtagggaaaaccaaaaacccaaaaacttttagcagaaataaaagttaccctcaaatcgatggaaatctcgacgtagtcctgtcgccgccggtcggaccgctcgcacgccgccggttagaccgccggtatgtcgtcggttagaccgccgaacccgatgaaacacaaatcgaagaactctcaaagtagatgacaactttattgcttctctttgtgtttacaaagtgcaacaacagcactccttacaaaaatctcgactaaactcgaaaccctaactaaactatcaactctacgctctccaaaaaccgataccgggaggacacaccctccccctctatttatactaaaaatcctcctactcaaagtaggagtacaactcctagttccactaggactctatctttaattatcaaatcaaattacaatcccaaattgtaattctctcaaactacagccgcagccaaccgcatcggactcgatctcctgcgcttgctccttcttgggcctatcgcacgtgggccgacgtgctactgctcctggaccggctcggcctccagccagctgccaccgaagcccaccgggccatcacacatgcatggcacaacatgcatgcatcaatcaccatacatacatgcatatgctacgaccagcatacacacatatatgcatacacgacctgctacagtaactcgaagcactgtagcaccatatacttctctctaatttcttccaatctccttggtgaacactggcacttacacgcacacctcgtaaagcccgttgcgaagatcactcccacacggtatccatccaccgtgtgccatctcgtatccaacttcgtcacccggtattcttgaccgtctggacctcaactcctccccgagtttagtcccgatctccaccgttgaccgaagttgacctccaagaatcctaactctagtcaccttctcacatggtatcccgaccacagtagacctctgctcctccctgagcatagtcccggtcctcaccattgaccaaggctgacctcaagtcacctacacacaatcagacaaaacaaccgtttctgggcacagatatcacaacctgacccacattagtcacacgcactcacaccaacatccacacatctttttaaaccaattcatcgattaaatcatttgtaaagccaattgttcatcacaaatattaatcatgacaatgatttcacataatgggacggaggtagtagtttttttttataaaaaatatattttcttaagttttggacgagtaggattacttcaagatttatgctaaaatattaacctcatccgctcattccattaccaactcaattgatccctatcttgacccgtaacacgcggataagactcccctagctttgtgaagcacaactacaaactgcacaaagtgaaggatctgtttccatagcacgtagtgccgaagtgcgccttccgtccctccccttggcccgcaccaacgaggcccgtcgatcatccctttcctaccacctccctccttctacaatatatattattacacatttacctccactttttgctcaggtccgacggaattctcctaccctacctctcctcccttttctctggcttctccgactaccagattcgctgctcctatggtcctaccttcctaacaacaaggcttctcatatataccatgttgtcaatcatgtccaacgctctctctatcttcaggggactgatgctagcactattgtcaccgtcgcatcactgcctaccactagtctttcaccattccgaccatcccaataaagccaccctcaccaccctctagccacctttaattagagtaagttttatcctaacaaagtaaaataggctctatgttttgtgatcggatggactaatttattttcgattggttgatgtaatgtaagtagctagcgaggtgacatgcgtttgggagttgctggttcaaaagaagaaacgtaggtcacatcaaaattaagtactcagcttaggtgcatgacatttgattaattatatgcactcctaccaaggagcaatatcatatgcttatattacagtgacaccaaacatagattacgtactaattaaatgcactgtgcacgtcacacacagcactgacgctatatcactttgctcacgagtcgcgcatgcatgcacccggccattaaatcacatacataatacacgtacaatacacacataaaaatatacatacgtgtgtcgatcggtgtgcatgtagatataatatatatgtaaaaaccgatcggaaaaaggaaaaaattagaactcaataagagtatatatcagcagccagcagaaattaatatgcagtgacgatggccgggcgccgggggagctggatgggggatcacgaggaagggtggtggtggtcgtcggcggtgggcggcagcaccggcagcaagcccttgtcctggaggcttcgcacggtttcgtagaggcactggcggacggggacgaagtccatgccgaggtcacggaggcgctggttggagaagaggtaccccttcaccggcggcgccgcctcgtccttgcacctgctcgggacggggtactccgggaaaagcttggcgagggcgcggcagaggtcgccgcggtgcagggtgctctcggcgcagatgtaccggccccgcgcgccgccgcagtcgtacacgcggacgtgcgcctcggcgacgtcgcggacgtggacgtacgcctgcgctgcgttcacgtacgtcttggccgaccccgtcaggtacttcatcacgtgctccgtgctcgcgttcaccgtcgcctgcagcagcggtcccagcaccagcaccgggttcactacgaccaggtccaccccacgccgccgcgccacctcccacgcaccctgctccgccaccgtcttcgcgtagcagtaccagttctgcaaaattatgaagtattatatatatatatatatatatatatatatatatatatatatatatatatatatattatatgatcatgtttccaactgattattaaggtcgtgttccttattatactgaaaatgaagacgaagctagctagagcacggaaaaagaagaaaatcattagcgtataattaattaaattttaatcgttacaaacttgaaacccatataaatttatctgatattagttttagagcaactcctatatatagttataaaattttctatattccatatataactatttattcttagaagttctgcacaagtttatactattaattggagaactatagatcgattgtaagaaaagttgtagttgttagaagcgtttcaaaaagggctgaacctatatacgttattattattattaaaaagagattgcagattattttcatgtaagatgaactatctttcgtaaatatgagtaattatgaaaataatcctgctctgtttggtctcaactacagaggagtaaatgacaattctggatatatttgcgcggtagtaggtggaggaaaagtatttggggtagttaagaagagctcctcaaaaggaaatggcttggtctttgtcaacttgactacgaaacaccgatgatgaccatggaagatgagaaatcaacgtcacctctttttagccacgtttggtaaaacttgacatgcgttaaaagctttgacgaaattaagcagacagtgacaaaccatgagcatgaattcagtaatcatcatatattagtatacataagttgatataagtcgtagtttcaaagatttgaagccgtaaagttatataacctagaatcttcccagtctcgtttaattattcttttcagatgaaaactaattacttagtatataacaagttgatgatctttaattattagcttgttattgaaggcgtatatatatattccctccgtcttaatttaaactcagttatgggtttgtgagtttaaagtttgaccgtccgtcttatttaaaatttttatatgattagtatttttatttttattacatgataaaatataaatagtactttatgtattgcttttttctaaaatcaactttataaattttataaataagacggagggtcaaaagttgaatacagaaatttataactgcacttaaaataaaagctaattaatttgcatgcatgttaattaactatgcatcggaggaaagctaattaagccagctactaggtacacacatgacatgacacgacatacctctgtcctcttgcagtattcgaggtcactccagcaggtgtcgtcgacgggcttgttggggtccctgtaggggttcatgtagacagtgccgatggaggacgtgaacaccactcgcttgatgccggtgtcggccgccgccgttatcacgtatctcgtccccctgatcgccggctctatcatcttctcctgaatttgatcagatcaaaccgatttgttagttactagttaattatactgcttgctcgatcgagaccgttaattgccattgaagtacatgcatgtagtttacatacaggatcatcggtgacgggggaggcagcgtggaagacgccctcgcagccggtgaaggcggcgacgaggctgtcggggtcgaggaggtcggcgcggaggaggacgaggcgctcgccggcgccgtccagggctctcaggtggtcgttcttcgggtccactgccaatatcgtcagcaattaatggagttagtactaaaactagctatatatatcaaattaattatacactcagcaattaaagaagatcgatcaagaagagtatgtattgcagtgcgtactagggttccggacggtgccacgcacggtgtagcccttctcgaggaggcgcttgacgagccacgacgcgatgaacccgccggcgccggtgacgcacacggtgcacccatggccggagagcgcggtggtggccggcgccgccgcggctgtctcgtcagtcggcatctcgatcagtcgatctcctccctgaatttcttcgagctagttaatttaatttccctgtgatatatgttatcacgccccctgcagggacgacgacagctacgcgtgtacagttgctagctagtttgctaggtacacctgtgtcgtcgtctgctagctaagctagggagcaagctgcaggtttttgagtggtgggtgcagcggatgcaaggagacgaggcacgcaccgtggctgtatttatagaggaaaacaacacgaatatggcaagagagacacagaccgagagcgag

SEQ ID NO: 37874 - DNA, 11215 bp, Oryza sativa
tcctgcagcccatgaaaaggtaggggaagtccccacaaaaaaggggaaaatggtgcatgtggtatccccttaagatataaaggaggaccttgcccacttagagaggggggactggacttttccagattaggaacccagaacaagggagaggctgactcatactttgtagcttcttcatacgcgaatccaccaaaaacacaggagtagggtattacgcttctcagcggcccgaacctgtatacatcgccggcgtctagtgtgcttccggtctggcgaatcttccacagattgggagcttagagtctcacccagggtccccggccgaaccggcaaaggggggccagcgcggtctcccggtgaggagccccacgctccgtcatctggcgcgccaggtagggggctctgcgagtgatcttctgagctctcgcactccttcgtgtgcgccaagcttttcctgttcagcccaatggccgagccagcaaaggcgcgcgacctctccccgagtatgagcggtgacgacggggagcaaaacccacgccaccgagctcgtactccaccgccccctccacgccaaagtcctaggcaggagaaggcgctcgagagggctgaaggatccgcgacttcgacatccacaggaggtggagaagggcggcgagatggggagcgtcacctccttgtctacggcgacggcagcacgccccagggcgcgctccaagctgcaggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgccaccaccggctccgcgtcgtcgagacggagggcgcggcgagcggcagccgctgttcgccattcggccgccactccttcgtcaacgcctccgacccgggatgatctgcgtggggaaccggatgcccgcgtcagtatcgagcgccggcgtaatggccgacgtgctccccacgcaacggagggcacctcctcgtccggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggtgcggggttggctaatgaacttgccacccgcatctgtccactcttgggaggatttgtgccaacagttcaccatgaactttcaaggcacatatccgcgcccaggtgaggaagcggacttgcacgcagtacagcgaagggatgatgagtcacttcgctcgtacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggtagcttcgaccgcccccggatccgctgctcagacagggcggcgtgacaggaggaggaagaagaggtcagcccataccgacgacgagggtcatgtcctcgccgtcgaggccgctttgcgggccacccgaaaggggaggcctgcgggcgacaaaaagaaggaggccggcgctcccagcagggagcgcccaaccggcaagtggtgcaccgtccacaacacttcccttcacgacctcgcggactgccgcgcagtcaaaagtttggctgagcggacgaggaagtgggaggaggagaggaggcaggagcgccgagagggcaagtccccggcagttccttccggcaatcgacgaagtgaggctaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccgtggaggacagatcgcaatggtggtttcccccactgtttgcaacgtgaagctggggcgtgtcctcattgatggaggagcagccctcaacatcctttcccccgcagcctttgatgccatcaaggccccggggatgatgctccgaccgtcccagccgatcatcggtgtgacgccggggcacacttggccgctaggtcatatcgacctcccggtcaccttcggtggacccgccaacttccgcacggagcgggtgaactttgatgtggcggacctcagtctgccctacaacgcggtcttggggaggcccgcgttggtaaaattcatggcggcggtccactacgcctacctccagatgaagatgccgggccccgatggccccatctctctccatggcgacctcaaagtcgcgctcgcttgtatggagcagcgtgcggactgcctcgccgtcgtaaccaagcccgagggtggcgatgagaggcttggcacatccgcccccgtcgccccgaggcagcggatagtcacgtgcgatgaggtcccggtcaaggaggttgccctaggcgacggcccgtccaagaccacacggatcggtggtcttctggatggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaacgaccttaacaaggcatgtcctaaggatccttaccccctgcctcgcatagatcagattgtcgactccacagcggggtgcgaccttttgtgttttctagatgcatactctggttaccatcagattcgcatggctaaggaggatgaggaaaaaactgcgttcattacccccataggaacttattgttatacaacaatgcccttcgggttaaaaaatgcaggtcctacttttcaacgtactactcgaatttctatgggtagccaaataggacgtaatgttgaggcttatgtcgatgacttggttgtaaagacgcgcaaccaagaaaccttactctcggatctagcggaaacttttgaaagtctccgctccgcccgcataaaactgaaccccgataagtgcgtgttcggtgtacctgcgggcaagcttctcgggtttttggtctctgcccgaggcatcgaagccaaccccgagaagatacgagctatagagcggatgcgcccccccagcaagcttaaggatgtgcaatgcgtcactggttgcatggccgccctaagtcggttcatatcgaggctgggagagaaggcgctacccttatttaagctcctcaaacgctccgggccgtttacttggacggaggaagctgagcgtgccctcactcagttgaaggcgtatctcagctctcccccggttctggtcgccccggagccaaatgaacccttactactctacttagcggcgaccccgcaagtggttagtgcggcgttggtcgtggagcgcgatgaggacaatcctcattccgcgcacccccaccctgtatagacttggcccgggagagagcagggaggagaggcccccgagccgaacggtggcccaaggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggtctaaggcccctgacgaccggagttggccctttgcccgcttgtccgacgatgccaggagcccccgacccccaggacggccccgaagccactgtgggaaggccgcccctgttatcctccgaccccgaagtcatcagcacagaagacaagtgcgccccgcgagactgcttggacgaagattgccccagggatgcggcccctagcgaagaggatcggcccaaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtaatgcagttcgacggctccctgtctcttcagggcgccggtgcgggggtcacgttgacctctccgagcggagacgtcctcagatacttggtccgcctcgactttcgagcgaccaataatatggcagagtacgagggactccttgccggactcagagtggcagctggactggggatccgccgcctcctggtgttaggcgactcccagctggtcgttaaccaagtctgtaaggagtaccggtgctctgacccgcagatggacacctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatacgcctgaccggcccccaaggcctgtcggagtccaggcctcgggacccgaggggagtgctcccagttcccttagattgattgcttggatcgccgagatccaagcatacctcacagataagactctacccgaggaccgcgaagggagtgaacgcgtccatcacatctccaaacgatacgtgctggtagaagggaccctctatcggcgcgcggctaatggaatcctcctgaagtgcattcctcgggaacaaggcgttgtgcttcttgacgatatccatgaaggcgaatgcggagcccactccgcctcgcgcaccttggttggtaaagcttttcgccagggtttctattggccgacagctctcaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactacggcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgacgacctcgtcctacgccgcgtccaaacgcgtgctggattgagcaagctttcactaatgtgggagggtccgtatcgagtggtcggcgtcccccggccgggctccatacggctggccacgggcgacggcactgagctacctaacccgtggaacatcgaacaccttcgttgcttctacccctgaggggggggtcgggtgtcaggtttcgggctcgggccaaccccgcaccccctcgggcgtgcagggttggccgggggctgccacacatgcacattcttatttctttttttcagtatttcaataaaagcagtttcaatttcctaaaggctgtatctgtgctgttttttccttttgaagaatcttgacttgaaataggtcactcgcgctcaatcctgccctcgggggctcgggtcggctaaaatcgccaagcggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgccttttgaggactgggacctgggcacgaacccttaatcaagctaagacacaaaaggaccacggcacagatcatcctcatctcatacacacagcaagatgaaattgacacaaaaatttcctcatttttgattacagattaagttgatctatacaaaaaagaggcccgaaggccttagaagaaagaaaagaagaaaaaactgaagaatggcgggggtctgggggctcaatccgatgcgcccgggtcgccggcctcgtcgtcactgtcgtctgcaccaccggcattgccctcctcgtcggagttgggggcgaacgcgagccgaggggccgagccctcgaagctgtcgacgatatggttggcggcatcccagacctgcgcgcgcgcgcggtcctcggtcccaggagggaactcatccagcgccatccatggagaaaaattggggtccctggcctggtaactcgccaggacgagctccaccgccccttgggcgaggtccctcgaggatgacttaattgtcttctcgagctcctcggggagccgttggagagccccggccatcttcgagaggcgctgggcgagacctccctggttggcggcgtactttacggtccgccctctccagaggcccacttgccgaccggcgcaatctaggcgggagacggcgtcccaaagcatgccgggcccaacctcgcctgccaagcggagggcttcgacctccccggcggacgagtccagcgcgccctgcagatcggcgatggtgtgttcggcagctgcgaggcgggcggctaagtcgctttcgcccgcggccgccccgccgctgcgcgccctcgcgtccagctccttcgcccgcacctcgagctcagcggcccgttggttcagtgcggccctctcggcgcgggcaccttccaggttatggcgcgcctgctcctcctgcgctgcctcgcggaggacaggctgtccgccagctgttgcgccgcggcctcggccccctcgagagctcgctcccgctcggtgagcgcgtccttgcggaggcggagcgcgagctcttcttcggcgcaggcagcctcgtgcgccgccagcgttgcttcccggatggtgacggcggcctcgcggtccgccagatcgctctccacgacgcaggcgcgctcttccagcgccatggcgcgcgcctcaagggcctcttcgcgccgccgggacgtcgcttcggtctccgccgcccgctgttctcgggcagcggcagcgtcaagcaccccttgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcatcgcccctcttcgacacgcgcccacgcggcgtcgagctccgcccgctctgcctgcagggcctccacctgggcacttaacccatccaacaccgtggtgtttgcggcggccaaggcctgcagaaggggctctgcgttcagtggggcgatagaaggcgtggggaagagccgccttggaaaggatgccatgcggctcgggccaccgatggaagtgccggactcggggatgttccccggacccgtttggccctgagcgtcgcccgagggagtgggcccaagcgacgtgcccgtagcctcgtcgccagctgccccgaaagttgtcgcttgagcgtcgcccgagggagtgggcccaagcgacgcgcccgcggcctcgtcgcgggctgcctcggaagtcgccatcgcctcgtcctggcgaaatccggctttctcccgagcggcttcctcggcctggcgggcccgggcggcctcctcccgagcggtttcctcggcctggcgagcccgggcggcctcctcagcttcccgtaggcgatccgcggcctctcgccggtcagattcccgcctccgggcctctgcggccgccggatcctcggcctcagactggccggatttggaatggcgggagggacgcgacgggatctcgctgaaacaaaagaaaagaccagaagacgaacaagatgggttagtgaaaactcatgttgagagaatgaatacagccacgatggatgagagacgaacctgcgagggggtcggttaaacgaccactttggaggggaaatgaggtttccccgagatggttctgtctcccccatcttgcggaaccgcttcttcttgcgctccccctcgggctgcggtgtcggcgcggcccctccgggcgcctgctgttagcacgcaccgccccgccctctcggggaggagatgggggaggtgttcctccctgcttcctcttcccccgggcgtcggcagggcggctgctccccgggcccctgtcgcgggacccagaagcacgaccccctcccggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgaaggacacctccacggagttgagattcagcacccgttggaccaatatcttgaagtcctcaggagcccagtcccatctcactccctggtgggtcctcatgaagtcttcggacccggtgtactcccaagcgccccgagcgcgccgctggagcggcgcaatccgacgacggaggtagtcgccgtacaccatggcccctgtgagcccctgggatcgcaggcccgccagacggtcgaggatggcgtcatagccatccctcaaatctaccggcgcccgccagctggaggcctgcgccgggggctggctcggaagtcggtggcgcgcttcgtcggtgaggggggtgtagaaccagtcgctcttccagtcgtcccacttcttgcggagggcgcaggggatgtagcgattcagcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactctagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcggcagcccagcctgcctctcgctcacgatgcaggaaggcggcagcacgctaccatcgagcagagcggagcctcgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcctattcgcccgcttgcggcgcatgaggtggatatgcggttgtggcagtcgagatagatcatatcgtgcgcgcggtaattacgctcgccgaccgaagcgacgttaccatatctccagacgaaacgaatcgccatgtccagattcgtatgctactcgagtaatgtggcagtcttgaagagaccgctcattattgacagccgagttaccactgccgatgtgcgtgatttgtgaccgttgggtttctgcccaattgtggagaccggtcccacctgtcaccaggccttaggagtggcgtcacgcccgaccgcttcccttaaagagggcgatcgccctggcataacgccgggggctactgtcggtgacatgggatcaggagtatcatgactagaggtttgaggcagacacaatcgcccacgtggcctggcaccatcgggggatgtcgggcccgagggtgatgtgttcgccctcctcttagtccccccgagggggtcggg

SEQ ID NO: 37875 - DNA, 3047 bp, Oryza sativa
tcacctaaccacatttattgcgatttggctgagcgtgtcacgccgcatgtaacgcagtgtagtgcactcatttatccggtctgtgaccagtcacagaccggtcagatcgcgggttaggtggcgacaggcgatttgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtggtggacaagaatgaccgacgtgactggtctgactccggtcatgtcgtcagcagacagtcacgattccacgtcgcatctgctcccggcgaaagtggaggtagttgtgagccgtcccatcagaaggtgactcggacggcaactatacaaatctccgtccatttatgaaaaggtaggggaagtccccacaaaaaaggggaaaatggtgcatgtggtatccccttaagatataaaaggaggaccttgcccacttagagaggggggactggacttttccagattaggaacccagaacaagggagaggctgactcatactttgtagcttcttcatacgcgaatccaccaaaaacacaggagtagggtattacgcttctcagcggcccgaacctgtatacatcgccggcgtctagtgtgcttccggtctggcgaatcttccacagattgggagcttagagtctcacccagggtccccggccgaaccggcaaaggggggccagcgcggtctcccggtgaggagccccacgctccgtcaaaatacatctcatagtaaaaccagataaccaaagcaagtcataaatcaaaagttcaaaattaaaaaaaagaaatattggtagctagccacgcaatctacgtaggccaccatgctagttaacttaataaagtaacagaaaaaggagtctccacatttgctctcatggtctagaaattctcacattaatcaaaagaaaataagagaaatagaaaaatcgaaggagattaggattaggtagaaacgaaaaaaagaaataaaacatctcacgacacgggaaacagacaatgtctttgaaataagtgtgaactggaatactcctataaaccaaatgtaatcaataagtactcgtcatgccaataaatacatctcatagcaaaacacgagataaccaaagcaagtcataaatcaaaagttcaaaattaaaaaaaatatattggtagctagccgtgcaatctgcgcaggccaccatactagttaacaacataatagatatatataccatgccaataatagattcggacaagtacaagttgcatagaaaccgtcaagcagcttcctcctcccagatatcaaatatacatacaaatgtcatgtcaatgcagtgaatctggttcctgtgtttctgactttcaggtgcaactactgcttgacgtttgtggccacccatcagcttacatgttctagctaagatgatcgagacatcaacgaaacagaagtcggcgaaacgtgagaactcatgagctgaacgaatcttctcttgaatgatcaatcagcagtcaaatgctaaataagtaggagtatcaaggaaactgcatccagatcagtggagtagtttggatggaatcctcttcttcgagatgaattaatgcattgaatcttttgtttgctgatgtcatcaactgaatctgaaagctctgccagccagtcgatcacctttgaattaatctttcttcacacaattgacctgaaacttcagtcaataaaaactgtatttcctcgtaggaaattaagcatcactgttgtgtgatggaggtcagcagttctgaatattcggtgcagtgcaacgaagctgatcaaccacacatgccatgaatatatagtcaagctttcaacgagctagctacgacctggcttgctctcagatcgatcgacaaacttgaatttgtaaggttttgggtggcgttccgcggatcggaaccaccaacctattttggaatccaaccgtctctacttgcgtaaattcaaagaggatctcgttgattttggttggacgtatgtgtacattcaatttacccgatgatttgtgcaagcacattttcaacgttgctgtaagatgcggtcgggaaaaacgaatagtaacagctgatcatacctaagacttataatttaattttgtcatgtctgggaagcttccaacatctagcagttacagcgctttcagaacctttagcccccaaacagtttacatccttacgagcaagatcatgataaaatgaaatacatatacataaggatgtaattttaggggcacatgacgtcgagtttgcccagggccctcgggccctcgggccctcgaaaatatagagtcggctttggtgggtgcatcacttgaaatccttgttcattatccatgcatagatctgaattttgaagtccgggtaatgaggtatttcttatttttagcaatggactgcataacaactacacagattgacaaatcccacagattcttgtgtaaaatcaaaggtgtttttaattattattctgtgatgaacaattgggcattggagattattggttttgttatttggaatttattcacgaagtggttttggagatgattggattcacatgtgatcgtaggattcaatatgttatgtgaccagtcagaccgggctctggtagccggtcggaccggcggcatgcgcgcggtcagaccggccaacccgcggtctgaccggccgacactgtgtcggtttcggtttcgggttgtttgtttggatatccgtgattattttatgattatgacttctagatggatactatacgtatgtaatactgttgtttgctactaatgaatcaagttggagatagcttggtctcggaatatggtttctttgtttgttccatgtgtaagtgactcgatgtctcgggagagtatttgcggtgatggaccgagagttggcttgggga

SEQ ID NO: 37876 - DNA, 8705 bp, Oryza sativa
atgtaaactgatctccattctcattgatatatttcgtccttaatcagtactccctctgtgttatattacaagtcgttttttatatttgatcaatttttttagtcgtttttttatatttgatcaagtttatagagaaatttagcaacatctacaacgccaaattagttatattaaatttatcatttaatatattttgataatatgtttcttttgtgttcggaatgttattatatttttctataaatttggtcaaatataaaaaagtttgacttgagaacaagtaaaaaaaacttataatatgaaacggtaacttataattataatatgaaacagagggagtaggtaaccctaatttcttgggcatgacttaggcaaagctgtcggggcaaaaaaaaagaaatgatggttgcttcgtagagagtagggtagaattacgtagctagctcccggtcaactataaatgtctcgtccttcacccgcaatattaatgagcatgtcatctttccgtttcaaatcatgtacacttagagtagcctaattaaccttccaaaaaaatgatttctccgggccatatatgcaaaggatccaaaatattgttttcttctatgtattgactttttgtatcggtctttcgaagttgtccgaatgtttgctctttgagaatacgataagcaaaggccgggattgattcaattatctaaaatcagtggcgaagccagaagggttggagggaggaccaagccgttgcttcccctcgagaattcactcataatcacgttgattatgtgatggacttaggtgtattaggcctactttgacttagcaaaccattttctagcatgcatgcttggtttggcatttgcctctattgttaagcacctatttgccaatgattttttaaaactttttatatgcaaaaggttttttttttcgaactatcaacccaaacattttattatttacaagaggattgaaatcaatatttgcttattattatgttttatcatctattcttatatagatacaatccgccaattgcatttaattgcaacaaaagagctgtcgcatttagccgtgtcatcaaacgtatttgcgattggattaaagtgtgtatgagttatcaaccattagatcaatgtttcttatagtaaagtagtttaaaaaccccaatgcaacgcgtcatattcactattgtttttataatcgttatcactcagcaagttggccttcatcaatatcttaattctggcttagccactgtctaaaatatgtgcaaaggatctagaagacctaacaacccacatgacaacattcgtggatcacgagaaccaaaagatgctgtaaacaaagaaataataatgcaaactatacatgtgtacgtatgtcggacataggagacatgaaggcagcaattgtgcgatctttcaggaattgaaaattacatgttttaatcttaatcaactaccattttaacaaattaataaatataagctcaattggttatgtttttttatagtgaaatcgtggctagatttaagttctagactcacaagtgcttacatttacgaataattatttttttagtgacaggtgacacatcagtcgatggtgatatccgtagtgatttcatcaatctcaagatatattggccagtctttcaaaaatgaaatgttgttataggtaggatctacgtatatgttttcatagtagtgagcattcacacgttgtgagcggttgtgtttatgctgtgtattaaaaaaaactaattagtgaaaatagcaactgcaaataaaaatatttcaaggcagttctgtgcacaatggctcggtgcctggcaagggattttggagtctgcttatttcagctacgggctgtaagccaaaaactaattttaaattttagaattatttttagtttttatgttgtttttgttactcggactaaaattaattttctttcatcagttacatgtacatgtcataatttaatttaaatcttggccgagaacaccggggcgtgcaggttggatgacagacaccggtgtttggcgggtcgcaggagcaggagacgacagacactgaagcgtgtttgtttaaaataaaattgagaagctgatgcaagaagacaggaacaaaattgttgcttgtgcccctcaattaggccgtgtacaaaataaagagtccgaggtggactcttaatcatttagagacgaaatagtaaagaccattatttttattaccattctttcctttaattttctccattctcatgcaatatgattaaattttaagagtcaactttgagtggttgttatgtgtagcaactattttttcttttcctttccaatctctttcatatcaccaaatttacttgcatgataacgaagagagcccgttattaaacatcgttttacatgctctagtttcaatcgtatatatatatatatatatatatatatatatgatgaggtcaataataatatgtgggttcaaacttttcataaatatattagttggaatctttctattttaaggcatcaatgagttatcccatccaaagattccccagcttacgctctactccatcggtagtgctttgcaataccacatttagcttgaagtattgccagttcttagttttattttaacaccaagtcttaatagagtattagcaaattggctgaattgttttgttatttagtgatgatcagctaaccaactaactttggtcagagttgtggctagtgagtctatattttgttttctatcgtttacctgagtcataagctagcgcgtttttgtttcgcttatgtttaatataaaaaaatggcttataaacaatttaaaaagataatagtttatagaaattttgcatacatgttcatagcaaaataaaaggaaatgttaaaaaataaactatgatataaaaaccttaaaaccaactgaaaattaaaattaagttttaaaatttaaattcccgattatgcatataagctaaaggctaaaggatgtggatgcagaatttagagccagagaggaggtgcagagaggagggacgcccaatatttctattgccaaactgaaaaccctaaacgcgagccagatcgatcacaagtgctggaagggactcgtaatgcgaaacctaagattggcatctcaaataagcaaaagaggacaaatcagaagaaaagaccaaggtggtttcagtggcatctcaaaatgcttaattttaataccaattatgcataagcaagaaggtgatctcgtaggataaggctcactttacataatttaggctcttaacacatagtacatactaacttttttaagttcaaatatacaaatataggtgcgtcatcttaattgggtgtttttctgataactgcttggagaggttgctgatattttatttatattgacttgatatcgtggaagagtaggtagaaattcaaaatcagcgtgctcatcgtccttactatctctaggacggcctgtgcaaaataaggccatactacaaaaacaaggacaagtccttggtttaattcatagggatggtatttttactatgcatggttctgcctctcatagtgttttcttaaaaatcctaatgcatggttctgcctccgagactgttttcttttttttaaagaaaaatcctaatgcagattccagaaggaaagttaaattgaggaactcttagtagcagagagttgacgaaatgaagcacgtaaaataacaagttaattgaaagcccatgttaggagcccaacatactgcagatgggccagctcagttgctcaaccaagccacagcccaatcaagtcaaggaatgcaatacaaaaggcagtagcagcaagacatccaagtatcgagcagatcgatcagaacgacggcggcggcggcgatgtcctggttccgggctgaaacctcggcgatctctcttctctacatctcctcctacctccagcttcctctccaaggtctataagctttcagaacttgtattccatagtttcttcctttcttttcccccaaaacaattgttacttgtatggtgtatccttgctattgaattggaagaagtgggtttctaacaatctggtatcagagctgctcggttcatgggatctcttgtcatggaggtgttgggatgacagcaaggcaaggtgggggaagattcaggcaagggaggtgctcatggcattagcgcctgcaacctgttcaatggaatgtctagtcagtatgaggtgtccaaggaagaaattcttcttgtcatgaatgagaaggtaactaaggaagaggcactgcatctaatacaagggttgagggatgccaagcgtcgaatagatgagaagctagatcgattattggagatgttcggtgtaaaggtagacggggaagcaatggggttgaggaattcaatgcctctactaaggagctcaaccccaacacagaggctgcaatatcttcatcaccccaggtaacacgttctccgatgcccaccaagtgttcgacgatttgctccaaccacgacaccatgcctcaccgtggctacggtggttgcatgcgccactgcttctgtgtcatccatggagttggtggttagtgaggacgcaatctttgatccctacattggcatctctaaccatcctaaggagacgcacgccaagtgttcaacggtcgtactcaatagcaacaatggcattgtccagggtgtgttcccactcttgcttggcacactagacattgtttcagcaccggggaagtccacaccagtcatggcattgaagacatcaatggaagatgtcaagaattgtccagggccacatcctcccataatagaatcgagagctagtagatgtgagttacaatcagcaccttggccaacaaataggactggcaccaaggtgcaattgatgtctccatggccacaccccaagcaaatggatgttattgtcagcaatattgatcttcagccaatgccatggccttcattcaatttttatttgatcaaaggtcatcaggatttctttgatgcaataggagaatcttatcatctgcttgctatcaaggaactatggaattattctttgcttgggatcttactgtgcacgagaatcagcacaaagagcttacaacttgaaatagcaagtatgttaatggagcttgtctggtttcaagaaggagaggtgctacagtgattctatttgactggaagaagtggaaatttgtgaatcttggaggatatattgacagtgcaattcctatcatgcaaaggtgcctggctaagcaaaaactagatatacatgtagggctgtcaaaaaagctcgaggctcgtgagcagctcgagcttggctcatcctaggctctattcgagctcggctcgagctccatacgagccgaactcgagcctgagcaaaagctcgcgagctttaccgagccgagctcgagcttctactgagcctggccgagcttgactgtgtataatttatattgcatgttcaccttattaatataataaactaatagataaatatatatatatcactatctatttacaaaataaattagcatgtgttagcacaatatatttattttaatcattttatactcttttattagtgtgattagctagaaaataattatacttatcaagatattattattaaaatatatattatactacttatggccgagctcgacaccgagctcgagctcgactcgagcttgcctaaaagctcgaaggtgcaataggctcggctcgagcttgtgtcgagctcgagcttaggcaaacgagctcgctcgagctcggctcgttgacagccctatatacatgggccttggattgcaggtgatgagaatggttcacttgatttattttgggattgctggccccaatttttttcctttcaatggcagcaaaaatggattggtgtgcatgtgttcagttttgtgtatcctgaaggttccttactcttggttaattttatgcaagatgttagcaagaatggcataatttcttatgacattgaaggaattgcagaatgtactcaaataaggtactttgcatcattacttcttgatattgcaatattgcccacagaaataatgctcacagtaaggcattgggcagtgcatttgatgctgccatggcctccaccccatgagaatagcattgtgctcttgattgatgtgcatgcatttgccaaattagggatagcaaatatggttgaagcaaaggaagaaatgaaattatttgttgctaagttatatgtactggacctgagttgtgcaactccttctattggtcactttggaaatcatggtccctttcaactcttagtgtgcaagatttggcctcaattcctgttatggaagatatggtcctctgaggcagaaataaagctgttaattgttgggcatcctaaacagtacatcgaagacacgattctggtgttagtggaagttagtttgtatgatttgggtggtaattgctccttctttgaggcagaaaggggtgtactcactggtaacaagcatttttatggggtgcagttagaatttctatctgacaagctggtgcaactaattttgtctcttggagaagtcaaggacatcctttttataattatgttgtttttataattatgttgagttgtaggggccagctaccatgtaatcattttggtcatggaattggctttgcaaattctgagactttgagcagcctgcttagtgttagaattgccaaggttgggtggcatgagaagatattaagtgaagggagtatgtcttctattactatgacagcaatgatatggaacatgcagaatgatatggaacatgcaggagcttagaaagaaacatatgctaaaaattatagatgcttgttatgaaagttggtccacaaggaagtggattgatgtgacaagaaaatggctgcactggatgctgggaggtggtgaacatgcaagtaatttcagttggtatctttgttggactttgaaagttgatattaagctgaagaaattattgcaaggggcaaacaagattagcagcaagctcaaaaatggaggggacatccgtgaagcttttgagcagtaaaaaatacaagagaaatcaaaggtggaagtttcaaatttcaaaagttcacttgacatcaacttggagacaagtcgaatttgaaggagagggaatggttaggaactcaacaggctacacatgggccggctcagttgctcaaccaagccacagcccaatctagtcaaggaacgcaatacaaaatgcagtagcagcaagacatatccaggtatcaaacagatcgatcagaacggcaacggcagcggtgtcctggttccgggttggaacctcaacgatatctcttctctacctctcctctcagcgatctctcttctctacctctcctcctacctccagcttcctctcaaagtttccagaacttaacttgtattccatagtttctttctctctttttccccaaaaagattgttacttgtatggtgtatccttgctattgaatcggaagaagtgggtttctaacagcccatcacgtggcagagcctcggcgaaattcaaaggtgtgtggagagcccatttaatttcttattttcccctgttttgcgtcaaaatagtccctaacttccagagcttcgtcgctagtatctagcagtagcaggtgaaaatagtccaatttaattccctcaaacttgttcgaatctagtatcctgaacaccaaaacaactctctggcagcattgaaggtgtcgcacgtaggttgagggagttatgttggagtttcttcgtagcagagtacaggccgaaatctccctaaggtttggctgtcgtgcggacctcagggcccaggccgatggccgagcgcgcacgtcccttttcttctaagatcctctctctgtgccacactgccacacagcaactaattaccactccttaaccgtaaatactgataagcatgaaaggatttattttcacaactaattaaccgtaacatttgcatcatatacactggaatgtaaattaacacaacgtctttatttttattttctaccgcttgtttaaccatacaaaatcatcaaaacatgcgtgcatacatggttgatccacgaaacaaaacggcaccaaaccaaagatgtgtgaaacgaagcagcacacaagaagaagatcatggatcgggtgatgggctagtagaaaacaaaagcaccacgtacgtcgatcttctgtcagtggatgagtacagtaactagcagctagctagctagctacttcccttggcgtgccgcagccgcagcagcagccgcgtcgtcgggggtcttgtgggcgtcacggccggcgacggggtcgccgtgcccgacggcgaccttggcaacctcggtggcgggcgtgccgggcctcgccttgtggtagagcaccaggtagccgaggacgccgaagatgccgaggccggcgagcgccatggtcccgggcccgtacggcatccggccgcgctggtgtagcacctcccctgggccgtggccgcgtccgggcgggcgcatggaggcctccaccccggccgcccggacctcctccgcgctcatcttgtgcgtgtcggtgttgcgccgccactcctccgtgccgctcttcgccatcgcgtacgtacgaattgcactctcgatgtgtggttttctcctgg

SEQ ID NO: 37877 - DNA, 5429 bp, Oryza sativa
  unsure (1)..(5429): unsure at all n locations
ccgtgatttgtttacgttgcgttgagatcgatttccagaacgtgacacgacgcccaccggcccacgtaatcccccgagtttccgtctggaagtatccatggatgggcctcgttgccacccgccaccactgggctgtgtctccactctccagttttattaatttccaaagtataagcactctgctagtgtataataatatgttatagatatcaatatgctagtatggcttgtttctttatttaaatacatagtatttctcatttatttgaatcaattaaatattagactattacatactatcataaaatattgaagaatagtttatagaaaatattaaaagggagaacaccctattcacgactagtttttatagtgtggatatttcgtccgaatgtgtatgtacacaaacagcatcagcaataagaaatttcacatcacgcagcctcaagtaaaaaaatcttgcaacggctacagttcatgccaaaaacagtaggaaaaatccattaacatttctggtaacagcgtaattgcaaagaacacatctcggatgatgtcccatgtgggatgcacctcacaattgcgtcaagggtttgaccttgtgctggtttctgatgtagtttcaaagttccgccctaagcacaacattgtctgagacagagtttctactccctgtgcattttcaattttgtctaaattcagaatatgtttcctcctaagttttagttttgaatccttccaatgctatttagtttagttaaactaaaatagatcacctgttacccacgagtcgacccgcgccaatctttgtcgatagctgtgctcctctattgtgcaagcttgtaagaaaaatatattatctattataatcatactataaagataactcagaaattaaccaccacgtttgcttgaaacactataaattcttgtattaagacccccccgtgagtttggccggaggagatggcgcgatgatcaagagcgtacttccgcttaagatctaactactggatcgctcaccagtttgtgtggaagacaatggattatataggtttggactaggaagcgtaacaccctactcctgtgtgtgggattatgatgagttcttacaagaagtcttgagctcctagggaaacctagctgttcttcctctagagctcaagctatcgagagtcgtccctttttcttggtgggcgatatcctccttttatagttcaatgggataccacatgcaccgtctatacctacccctccatgggagggggacccaccctgcctcgattagaccaccattcgtgccttcaaccggaagcaaagtggtcgctcgtcctcgggtggggccagtgccgtcccccgcctgacacgggggacacccctgtcattcatttccctttaaatgtatggagactttggtggctcaccacgggcggagggcgtccctggcagtgcatcgaccgcctaacacagggcgggacatgggggacactgccgcccgtccaatcacctgtgaccacccgattgacgtgggtcaatcgagcggcgccgcacgtccacccacaccgtattaaatgcggtgagggacagggcgccgcgcatttaaggcgttgagcggcgccttccgccccacccactctccccgccaccactctccccgccacgtggtggtcgggcgagggcctcgggggagcacgccccaagagcccgaggggtgtgacgtggcaccccgaggccctctggccacttcagcgctatccaaggggcgagggaaggcgaggctgcgtggccacgtgactagacgggaagggtactttcctttactgtgcgtacccccgggccatatcaccgacagtagcagatctaaattatagtgtagattgatcgatatatttgtatttacatataactatatatataatacaattttacatttaaatctaattctaattttcatatatactctttactggtcataactgaaacagatagtaagagttctttatgaaatccaaatctatttttagttccagataaaaatcttaattgtatttggagacaaaagataagagctacatatcaaatccaatttcacttttatgtagctcagcaaaaaattatgctgtgaaatccgcttgttaagataacagcgacaaatgacgaaccatccaggaacacgacctcaatttgcaatgtgctttgaagtaagaactcacaattcctcggtgaaatatttcaccatcaaaaagtctattctaaacacgaatatttattctgaaatgctctgacatgaggcatggccgatatatatccattcttctagccacagctgctcaaagtagttaatttacataggcaagatgaggttccttggtatcctgagcctggtcttggatttgcacacttttttgtatgaactattaaatttcaaaattttgcacaaatgtaatggccttctctgatcacaaatcaaatctaacatcccatttttccatccatgtaagcattaaaggtccaattgtttttcctgagctggaaataaggcatctgcaatcgaatacttttttatcaaaaattattaccagacatgataaaatgtagtgtaaaaatgacataggtatgcaccaaaaaacagctcatgagattatatatgcaccaaaagtgccccgttgtagatatgctggtgatacaattttagatttaatacataaaatttagtttagagaacaggttttgggtctctcttggagatgctctaaggataccaagaagagggtaactgatgcatctcttgtcttcaataacagcaaaatcctctaaataataaactatgcttgtattaccctagcacaatccacacacgtctggattgaaatacaaaattaagcataattggttaagttggtcattggcaactgttacattcacggacctagcatagttactagtgaaagtaaacaccacgacaccgaaaatttaccctagtgaatcaaacattggtacataaagtctgagcgtaggattttcatgagctgatcaaaaagtccttgagcatatatcaagtagcatatatcaagtgtaacaacagtaaacaaaaatcaagaagggaaatggggagaaagtgaaataaaaactcaaccatgtataatacttatttccttacaatcagtacagatcatggtaaaatatatcatagcaaagtgttgagagacaagaaagaatataagggagttttacctagcgccacttatctcaactgcgtaggggagcagaggaggcctgaagcatctgcaccaaccacagcaagctcacatatggtacaaagctgcccttcgatggaaggaacaaaccgggatccacagtacgggcaggaaacatccttctggccacggtaaattggaacatatgtggcaccacagacgacaaatggatttctgtagtcatagttcagctcacagctatccttctttccactgcactgttgctgcacctgtcgggccctctttgcttggctctcattagggttgttctccagcagcatccttgcaaagtgctctgcagtagcaaagttcttttgcttgtagcacaaacccatagcacttccaagcacaagcctcatatgaactctctgaagcttgcagttagtgaagtaagctgccaattcttgttggcggttgacatcatctctcaattccttcctcttaagttccatcctcaggccaaggacatactccctcacaatctcgatcaactctttcacttcatccacttccctcctcgagtctaccacgataagagggatggtatgcaagatgttaaggaactgcctcagggcttctgggaacttaccttctgtggtggccttgtaggcagccttgagtctgtcttccatttgtgagaaggtgaaaacaagtgcaggagggcctctcacattaggacttgcagactcactccaacctttctcaacagcaaccggaataatgggggcagttgcaagtgcacgaagatatgagtggctgcccatgtgcagatcgagaaataggggcttgagaggagcaaagtttttgatgcccaattgacggctaagcaatctcattgcagtgtcaaagtttcctgctgctgcgtgctccccagcaagagaagatttctgagtccaaatctggctgacaggcatgcctggaggaggagcaacaaagaccactgagagtgcattaccggcgtttttaggggtctctgcttcaggcggaagttccaggtcttctaggtcccagccaccttcctcaccatcctcctcatttgcttcaccctcctcagcatcaaaaccatcaccaccattcgccatcgcttcgcttgcatcaaccatatccaggtcctcatcaccccagtcagcaccagcagcttcatcgtcttcctcaagttcagccttcccagtagcatccagtccaccctcaaagataccacgcatcaccctaagcaatggccaatcaccactggctgtgagaggtgcaggggggatcaaaagagagcgagtttttccttcaggtagagaaggaatattttcacccaattcagcagcaagcctatcagcaatttctgtgagtccatgggtggcagcagtaatataagcaagaggtagctgtccagcattctctaggatctcaactctcttcatagcatcaccaagatacagagcattgtggaattgacccatcaggttattgttctgtccagcaattttgcacatgaaccccaccttgtccatgtaaccagtaataagatataggaaagcaagcctctcaaaattctttgtacgttggtacgcatattccacaataccaacgtttccctgcctcagggcctcgattcccaaccggtaccagtgatctttgtcatcaatctctttggcagaagcaactgcaatttggatgttaccactctcaagagctaggttaaatcttgtcttctcatctttcacaaagtggagggcaacttctggaaagcctttctgttgcaaataagaaatcacagcctgcccacacagctgggaattcttaatcatactcatcacatgatcgtatcgtttccgtagaagggccagcttgaaaatgtattcagaagcatcaactgtgatcagcttgttctttccatcacgatctaggcagaaaatattattcccaatagcccttgttatgtaaataggaacgtcaagggttttaatgatcccactatctccattgggaagacaatacttgatatggttcaaagtagtgtaaataaacacaccattctcatcccaggcaccacttttcacacggatggtttcatggagcgtacaacgatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37878 - DNA, 638 bp, Oryza sativa
ttgatggagattccatatggcatacgatggagttattgtgtgcgtatggaatgcggagtaaaatttggaaggagtccaaatttggtacgattggttatgtaaagtttctttcttgtactagagggtttcctaaggtatctaggactcttagtatgagtttagttcgtggctttaggctgcctacctcatgtataaatagagggggagcgtgaggcttcccggtatcgcttttgagagcaattgagttgagttttgagttagggttttgagtttactcgaaatttttgttaggagtgctgttggtgcactttgtaaacacagagagaaacaataaagtcattatctactttaagagtttttcgatttgtgtttaccgggtttcggcggtcagaccggcgggagcacggcggtcaaaccggcggccgcgacagcaagcagcagctgatctcggcggtcggaccggagatataatctctttcagaccgacggcaaccaggcggtcagaccggcaggacaactttggtcagaccgcgatccgtcgatttcgagggcaactttttttccgctaaaagtttttggtttttgggtatactaaccattcattcccctctggttggcttagttcttgtgattcgatc

SEQ ID NO: 37879 - DNA, 661 bp, Oryza sativa
gtagagatactcagtgtcggccaactgatcactgtagcgatcgcggagctctcctatggcgatccttgccacctcctgacatgcatggatgtagtttcttcctccagcttcgaacatcactgaggggatatcttcactattactgttcaaggtgactttgactcggcacttctcttcgtgacgatcatgaggaatctgggcataaaaaggggtagtcccaaatcctatggcaaaggacatcgtacgcaactcctggacaaatccctcaacaccaaacaagtactcaggcttgtagcacggcatctaaagacaagtgaaaggagggagttaagacatttatccaattaatagcacaagtttttggattaatttgaataaagttagaaaatcaaagaaaaaggtaagtaaataaagtaaaccaagcttgcaagataagttgaaacagttggaaataaggtcacaaattttgtacttttgaacaacaggttccaaagaaataaaagaaagttataaaatcaacatgctaaatttattttattgcagcaagattaaataaaaccatattgtaaaacttttgctggtaaatgagccattagtacagtaatagatgtacagtactaataacgctggaataaattttgaacgagaaccactaaaagag

SEQ ID NO: 37880 - DNA, 636 bp, Oryza sativa
gtcattagaactactatcggaccaaccatttctggccttcaatctcataagctcaagcaccatccacaacaatgtgaaatccttctcacagccctttgcctcattgtacaatagatcattcaatgcctttttcaatgcatcaaagttatccaacccacgggcggacccagcaacaatcttaggttcagcatgacgcaacatctcttccaaatctgcaaaattaccatcatctacgctgacattaccatcatcggcatcatcaactgtactgtgctgaccattgccaccaacaacatcatcatcatcaacaagttctactgcacttcttcttcttcttcttcttcttcttcttcttcttcttcttcttcagctactacaatgacatcctcgtcccagctcaacacttcgtcgtgtactgtagcctggtttggaacttgcttgcttgggatctttccatgatgtgaccagtttgtgtatccctcaacaaatccatgcatcaccaagtgttgctcgattacagatggatcattccaacttttctgatttttgcagtgcacgcatggacatctaatatctttggtcttcttagatgcagcattcttcttagctgctttcatgaatatgtcgactcattca

SEQ ID NO: 37881 - DNA, 3870 bp, Oryza sativa
gtcttaaagctggagcaaaaggttatcaaatctcaacactcaaatttcaaatagtaatgaagttctgacaacccttgatgatctggaagaacaaagacctctagctctgcaggaatggaatttcagaataattctcaaagaacatattctcaagcttttgaattacaaaaatgagttctggaaaaaaagatgtaccatcagatgggtaaaatttggggatgagaacacaaagttttttcaggcctcagcaactgatagtcatagaaggaataaaatctcgcatctcagtttggatgatggaagtatagttactactcatgctgaaaaagaacagattttatatatggcctacaaaaacagaatgggaactcggggctcaatggacatgatcttaaatttgtctgatatggttcgtagaatggaaggcttggagtgtcttagtgagatcccatctacagaagaactggacaggatcattaaaaacatgcctactgatagggctcctggaccagatggtttcaatggcttatttttaaacaaatgttggagtatcataaaacaagacttctatgagttggcttttcagttctttaccaacaatgtctccctcgagaatttgaatcactccttcataacgttgatcccgaaaaagccaactccagaaacagcaaatgatttcaggccaattgcacttcagagttcagcacttaaattcattacaaaaatcttggcaaacagattgcaggaagtaattctgaaactcattcatgataaccaatatggtttcatcagaagcagaaccatacaagattgcttagcctggagctttgaatatattcatcagtgtcatcagtccagaaaagagatgataattttgaaaattgactttgaaaaagcttttgatttggtggaacatgaggcaattctccaaattcttcaggccaaaggattcaattctacctggttagactggatcaaaaatatcttgtcttctgcatccacttcagttctgcttaatggaatccctaggaaaagtttcaagtgtttgaggggagtaaggcaaggggaccctctttctccattgttatttgttctagctgcagatttattacaatccataattaataaggcttcctcaaatgggttactctcaactccaatcccaactagcggtaattcttttccagttatccaatatgcagacgatacattaataatcttgaaagcagatcagagataagttttttgtctcaaagctcttcttaacacatatacaatgtgtactggattgaaaataaattatcacaaatcaaacatgattcccatcaacactgacagtcaaaaaatggaaattttagctggcacttttggatgttcaataggtgccatgccttttacttacttgggtctacctcttggcacttcaaaaccaaatgtcagtgactttgcaccattgattgatagagtggaaagaagacttccttcaacaacggtttatctaaattatggacaaaggctcaccatgatcaattcagttctttcttctttaccaacatattatatgtgctctcttaagctgccaaagaaagtaattttgcacattgatagggcaagaaagcactgtttgtggaggaaacataatgagtcagaaactaggactcattcacttgctgcatgggatctagtttgcaggccaaaaaagagaggtggtctgggaattatcaacctagaaatccaaaacacatctttgttgcttaaacacttgaacaaattcttcaacaaaaaagacctgccttgggttcatctaatatggaataaatactatattggtttggacaagcctccacatgcgcaaattgagaagtgatcattctggtggaaggatattttcaggctaatcccgttatttcaagctatcacatcggtgactgtaggaactggagattctgctctttttcggaaagataattggagcaatcacaatttggaaaatgaattccctgtcttgatttcttatggaaggaatgaagatgtcactgtacaaggatttctgtcagccacagatattggtcaaaactttcacttacctctgtccaaccaagcaattcaagaatggggtaatttaaacaacagattacaaagcttacagattgtcactgaatcagacaaatggtcatatgtatggaactccgattgataccaatccaaaaaagtttatttgatgttctttcagcatcttcaggttgctagaccgatatctatactctggaaaagcaaatgtacaatgaagcttaaagtttttctctggctcatgttgatgaatcgactcaatacaaaggaaatgttgcagaaaaaaacaattcaatatacaaggtggtgtcaactgtttgctatgcagctccatggaaacagagaacatgatacacttatttttcagttgcccttttgctcaacagtgtttgcaacaaattggtattcagtggaatgtaaaccaggaattcttgaacatgatcacttcagctcagatctcttttcaacatactttcttctttgaagttttggcaataggatgctggcacatatggagtagaaggaatgatctcatctttaacaatgttgctctcagcttcgacaaatggaaggatgattttcagaaagagtttgccttgcatatgcacagggcaagagagagggacaaaacagattggcaatcatggatagctaactttacttaatacttctcctttttccctttttgtaaattcttgcatccttgtaactatgttttatttatttatatttaatatagcacagtaggagcctctcctgctgttttcagtcaaaaaaaaaagagatcggtattctcgagccagtgtacctacacaacatgtttcctttcgagaggtacatgggcgttctgaagaagtatgtttgtaaccgtgctcgtccagaggcaagcatcgccaaggggtatggaaaagaggaggtcattgaattctgcgtagaatatattgaagaccttcgcccaatcagggtacctgaatcacgccatgaagggagactacggggaaaggggactcttggaaggaaagcaataatgacggtagacaacaatttattccgtaaagcacatttcacggttctgcaacaatcttcattagtggctccttacatcgaggagcacttggctctagttcgcaccagaaacatcggtaagtccgatgcatggattacacggcatcacattgatactttccccgcgtggctgcgacaacatctcatgggtaacgagacgattaaccaacaactggccttcctggcaaggggaccatctggctcgatcgcgacattccagagatatgagatcaatgcgtacacattctacacgagagcccaagacatgaagagcatgaaccagaacagtgttgttcatatcgatgccatgggacacgatggtacaactggcacgtattacggtgccatcaaggacatatgggaacttgactatggacctctcaaggtccctctgttccggtaccaatgggttaggttgactggtggaggcgtaacgattgatgacagtgggatgacaacggttgaccttaacaaggttggatactcagacgaaccttttgtccttgccaacgatgtaacgcaagttttttacgtgaaggacatgtctagcaaaagaaagaagggcaaaaggcctgacaagccgaagcgccacgtggttctcccaggcaaaagaaaaatcgtcggagtagaggataagactgacgaggattacgatcagtttgatgggcaaccccctttcacggtgacgattgaccctagcatcctcctattaaatgaagacaccccttactcaca

SEQ ID NO: 37882 - DNA, 3751 bp, Oryza sativa
cccgcgccgacgccgccgtcgtctctcgccatcatctcgctgtcgtcgtcgtcatcaccgccgccgccaccgccaccatatctctggggttgccgccgctgcctgcgcgaactctctctctctctctccaaaccgccgccgcctcgtcgtcgtcgtcattgctacgcctgccgacgccgaccccgactccgccttccgccgatgccgaccccgacgtcgacgcggccgccactgccgacgacgcccccgccgcaccgcgccatgccgccgccgctccttttcgctgccgacccatcaatgccgaacgtgaacgaatgcgaacggacatgaacgaacgcgaacggacgcgaatgaaacgtgaacaaaacgcgaacgaacgcaaacgaacgtgaacgaactcgaacttaacgtgaacgaacacgaacgaacgtgaacgaaacacgaacgaacgtggaggaaacgtgaacgaacgcgaatgaacgtgaattcacttgaacgaaacgtgtgaatgaaacgtgaacgaacgtgaaggcacgtgaacgaaacgtgtgaacgaacgtgaaggcacttgaacgaaacatgtgaacgaacgcgaacgagacgtgcacgaacgagataattaaacgattattaaacttagcatatatatatatatatatgattatatacttgaaaacgtgaacggaaaatatatgttcctttgcgtttagactaatacatttttttgcatgttgcagataagagacttcgtcgtcgtccctcaagccgaagtggtagctaaccctcggaggaatttgcgcaggcaagtgatataaagatatgattatctagagttctaatatacgaaacttagacttagcatatatgattgttagagttttaatataagattattagagttttaatatacgaaacttagacttagcatataagattattagagttttattatacgaaactttgacttagcatatataattatttgagttctaatatacgacacttagacttagcatatatgattgttagagttttaatataagattattagagttttaatataagattattagattattagacttagcatatatgattattagacttagcatttctgattattagagttttaatataagattattagagttttaatatacgaaacttagacttagcatatatgattatttgagttctactatatgattattagattattaatatataattattagacttagcatttatgattattacagttttaatataagattattagaattttaatatatgattattagagttttaatatacgaaacttagacttagcatatatgattatttgagttctaatataagattattagagtttttatatacgaaacttagacttagcatatataattattagaattagcatatatgacctatagaattagcaaatatttcttgtatgaatagatggttgatcgcgatgacgaacagatactataccatacaatcgcagagggaagcagccagtactggaacgaagaagaggggaacgaggatccaaaccagtacttgaacgaggaagggaacgtggagagggatgcggaggggaacgaggatgaggaggctagtggaagtcaaccctccgctagacagaagagggcacacggacaacgaggtgccgcgaagaagatagagggttggcacatcataactgaggtggacgaagacggctgacctagtgccccggcagaagcagccaagaattttgtacgacatagcggttgggttgtaagggataacgtgcctgtcagcaaggtgtactggcgcagaacaagggcacgcggggattatgacagctttgtcccagaatcagagaaagagatgttgtggaccacaatgctcgagatgttcacgctccctgcgggtacggagaacatagtgaaacagtggactcttaagaaaatggcagaacagttccagagcttcaagggagatctctacaagaaatacatcctgaaggggctgacactgaacttcgacgtattcccaaagctaagggatcattgggacgagttcattgcttacaagacagggcaacaagggcaagcgatgatggacagaaacaaagaaaataccgccaagaagaagtaccatcaccacctggggtcaggcggctatagcgtcgcaatgccgaagtgggaggagatggaagcaagcattattgagaggggtatcgaacaggccaccgctaaatggccgtatcgatcgaagttctggtactatgctcacggtggaacgcttaaccccgttgatggctccctgatgttcagcgatcagatacgcgaggctgccagtcgactaacggatgcagtggaagcctcttctcagggcatgttctgacccgacagagagaaggacgagctgtcactcgccctgcagactcccgagcatccaggacaaacacgagggaaaggcgtggttccttggaagattggattcaaggaggacatccacacatacaggagtcggatgaggagcaagagagataccgaggcgaagattgcagatcttgagtacagggtatcgagctacgaggcaagaggaggtggcaaggaaggtggatgaacgcatggccgcacatcggtcccaggatccccagctgtacattcctcctgtaatggttagcccctcaggcaatcgtagcagctgcgcctcaacggggcaggtaggatcacagagcatggacgccatgcaaactcaggatgaaaccacctgccccgttgatgagatcacgcagcggacaccatgtgagctgcatattcccttcaagaacttatcaatcaaggtatgttcgtagttttatgatttatgctcgtagttttatgatttttgacttgtacattccgcaagttgctacttaggttgattactaatagataacctctcatcacgtgaaggtggcgttggaaatggccatcccaacggacccttcagggacttaccactgtaggccggttccagcaggatactcaagggtcgaagttgagctggtggaagccgcgtacgaggacctcgagttggactaccctggaggagacggtgagacgcatctacgagacacaagccacgccattatactatggcgcaagcggtacatcatcctccctaggcgacaagcggcgtctcgtgcaccatctcctccggctccgccatctcctccgccacctcctcctgcaccatctccttcggctcctccggctcctccacctccactgtgtccacctgcacctctcaagacaaggtctcgccaagctccaccgcctgcccgcacaagggcaacgaagaaggcgaaagttgacgccaccaaaaacaaggagtcgccgtacgattgcagtcaagaggagcttaatgcttatgtggcaggagaagtgaagaggcaactcaagcctcggagtcctgaaaagaagatacctgttgacccgagcgtgaagaacttattcaagaaaatgtccacaacaaacaaggaggtcttaaagctatcggactatgaccgaacacttaagaaagcctattacaagaagtccaaactagtcccttagcttggagaacaaccataccaacaggtcgagccgttggtgactggcgaagaaattggcatagcagaattcatttctgacaccagtctaactgtggatcagttgattagaggcgcaccaatcctgaaggcggaagtggcatacaagtttgaactcggtaa

SEQ ID NO: 37883 - DNA, 2195 bp, Oryza sativa
ttgtttcgttcaataattaactccttgcatatatgtaaacaataataacttcctttttatcgttgtagaatggagattaaaagggctcgacggtggggggtttacgatactgggttcatcgaccctcggaaaatcaacgccgaaatgatcgacaagtacgagaaagacatagaggacaatctcgtccatctcctgacgcagcagcatttcaagacgttcatactactgccgtacaacacagagtgagtttttactatcgttcgaacaaatttcattcccatacatataacatgtacattttcatatatatatcatcacacgcatattgcagattccactgggtcctgttacttttcgacttggacgcatgcagagtcaatgtctataactcaatgaataaagaggagaagactttcgacaaggttttccaacggatagacatgtaatataattgcatctattcaaaagtcacggggatttttcctattgctattatgcgtatctcggataataattaatcatagcttgcaactgcatgtagggtttgggattggttccgtcaattggtccccgggacttggaaagaaaaacttggatggaggtttaattttctagtgagtacatgcatgatccaaaattatattgaattgaatctctaattacagttaatataagtgtatattaaatctctcgtcctttctcatgtactgtgtaaagcaggactagggaactaacttgtgccgctactacgtatgcgagtatgcccactgcctatcaacccaaatctacaccacacgagagcttgatgtacgtatatataaaccattcaaaatttcattgcgtatcgatttgttgtgtatatatatatatatatatatatattaatcagatttgaaccgaggttcatttgcaccaggaatctccaccgtagatgtgtttcaggattcacacatatgtatcagttggttactgcaggaagtgtctcttcaaaccatttaatcatggtcaaaaggtggtatggtcagatggagaggacagacatgcatgtgctgtattttctccgtgccagaaattcattatgttcacagggtgtctttttttttttccaatcggcacgttaaaacgatatatacaaattaatgatgaatcgagtaatctaattagccttttacgtcagagctataaatgagaaaatcattatgtgtgccatacgtatatggtacatatactatatatatgtatgtgtgatgttagtatatacgtgcagtttctgctgatcactctgtggtgtcatgtgggctgcagggagggcataatcgagaatgcaacctgtaccattcaacctaccaacgcacagccctatatagcagctcaatgaggttggtacatcttgatgctcattagtcacatgatggaacatgtctatgcatacacgcgtcaatcaggtgattggggtgcatatgaactgtggtctatattatccatgtcatatatatatatatatatactagcaaaatgcccgtgcattgcaccgggtaatgccgcgttggataatgtttaactgaatgattttgaaaacggtctaatatgacaataataatcacaacagatttctttttgtttggacaattattccacatatacgtgtatgatatgaacgatgttcctaacacgttagcgtaatgattgtaccatgggaggaacaaatggtgaatgcattaggttactttcatgcaagaatagatggacgaaaatttgtatgattaacaaaaaattctatatttaaaataggtaagtttatcataaaactaatgacaatcacgacagataagattacttttgcatatttactcagtctcatagtggtgatgcatgctttcttaagctgtcaactctcgtgttgcaagcgtgcgatctggtttccaaaatcatatgtcgactcacatggaggaagcaaggcgagtggaagggagatgtccattcagcgccaagcggagcgaagcggcggcgacgcggcctaagcggcatcggcggtgggtggggctccatctctcctcttcctcctacgacagatggtgagcagcacagagcggcctaaacggcaacaggaatccacctctcctcctccaaccggcagcgagcggagcggagctctggtggcgtggcccaagcggtgcctgggagtccacctctct

SEQ ID NO: 37884 - DNA, 2291 bp, Oryza sativa
tccaccactctatgacacatccaacggcttgattgtctagatattattcttcttttcatacttatagctgcattagttgagtttgatcttatgagtcgtgattagaatctcaatctctagcctgcctttgattgccgattagggtagtatcagggtttcagccgatcttacctgatttaactacatttatcttatatgccttattgacatgttaaattcgccctttatgttaatatcttgatgcatttaagtatattaggctttcgtttggtatattttacttgctgtgatatcttaatatagagtggtatcgaagtattagccgatacacgctagatctatcttatcagctatggtataaacacatatagtcttgttattaatatatatttcgatctaagtgatttatactgtctcggcatggcgaccgatctatcgcaatcacttgatttaagtatatatcgatataaggactatataccgttaatatctacagccgatcgagtatatttagttctttcttacttattaatgattgccgatcgatgcatatatgacatcggctcaaagataaatgatatgtcatcggcatctagccgatcagctatcatttatagatttaaccgtggtttctttgtctttgtttcttgttgattgcaggatcaaatcaactggcacgctcgcatacccaaaggcaagttttggacctgcattggagttaagcagatctctcaggcctcgtgttttcacatcaacacgcttttggcacgcccagtgggacccattagaagtcagagtcacaacagcggtctctaatggctgagaaaccaccagcatcactgtcctcagctggcaaagaggggactcctaaatctaaaatcccgaaacctggtacatctgaagttaatgagagtaacatcgtgcccatcactccggactggttgacacccgagcagcagaaggatcttgaggctatgatgcagtaagcacggaaccaattcttgaactcattcatggagacccgcaagggaacagttgttcagaagtataaagtaaaagtaattgctgatgttcccggaacaggttcttccaaggatgcagaagtacaacaggttccagatggtacaactcaatcaagtgataaaggtgttgcagatggttttcaagggattcaaggtgatggctctcaaggggttcaaggtgatggttctcagggatttcaaggtgaaaatcttaaccaagatggcgacactgcatcgctacagtttaacaacttccaagatcggattgactatgccgtgcaacatgctttgattaatcaatctggagtattagtcaacacattatcaaacatggtgaagtcgatggttgatggcttgatagctgaatatcaggctacaggaccggtttatttgccaggaggtgttttcccaaactatcggcccttaatcactaataatcaaccagttgtctagccaattcctcccaatgcaccatcggctcaaccgacagcaccagtatcggctcctgcacctgttgcaccatcatcggcactgggtcaattaattaatcctcggttgttggtgagagagcagccacagtatagtggacaaaatgtgaatcggctaactcaagatcaagttacaactatgttcctaccacctcaacctactgttgacacaatccagcaacagccgattcaacaaacaccaccaaggcagcaggttgtgcagccgattcaacagacaccaccaagacagcaggttgtgcagccgattcaacaaacgccactgaggcaacaggttgttcagccgattcagtagcaaggtttgatgaatgcatcggctgtgtttggaacacctgacgatcagctaaggtagcacgctgcgaatcaagttgtcctagagcatttggtccataacgtgcaaccagatcaaactgtggtacctcaggttattcccgaacatttggtgcgcaatatacagccgaactttcagaattaccattggggcaatttgaattatcagtattagcctccatcgccgtaagttcaatatcagcagggaggaccggctcagccccagtttgttcctcaatacaatcaattcgagaccgtgccacaacaagcacaaggagtgcctcagcaacgaccatgggctgtatgattgcagatgtgatgagagaacagtttaggcttaagccgaaagatgctgaaaatttgtatcggcatccttaccccgagtggtttgagagagttcctctgcctaaccaattcaaagttccagattttt

SEQ ID NO: 37885 - DNA, 530 bp, Oryza sativa
atgtgttaggctttggagacatcgggatcatggttatggttatgcctgtatgacatcgtcatggtgaatggaagcatagttgttttggttcgtgataatcatgtcaggtaccttttatcgtcttggtgaattttacgagatgttttgatcgatttagaagaaacaaaattcatagtttttgcaattactcctgaaatagcttcaaattccaacaatctcattcactgtagcttgttggtaccaaagattaaagaaggcacaggacaagcagtatttatgaaacttatctattggttgaaattaaggcgacaatgtggctattgaaattaagtgaaaagtaaaaactgaattggctagcagagagtgcagtggagttggtaacggtcttgctagctgtgcttgattctgtaacacagttcgatggggggaattcctcgtctagtgttcgacagaaaaaatcctaagttaatatgtaaatatttattcatttaataaaactctcttttccattaaaagaaaggaaaagcacc

SEQ ID NO: 37886 - DNA, 3646 bp, Oryza sativa
aggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgtgaagaagatattcctaagaccgcattcaccacgcgatacggactgtatgaattcacggtgatgtcgttcggtttaaccaatgcacctgccttcttcatgaacttaatgaacaaagtgttcatggaatacttggataagtttgttgtggtgttcattgatgacattctggtgtactcacaatcagaggaagaccatcagcaccatctccgtctggtgttgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcaccgattggaagcaacccaagacagtcactcaagtccgcagtttcttaggttttgcaggatactaccggaggttcatcgagaacttctccaaaatcgctcgacccatgacacagttgttgaagaaagaagagaaatttgtgtggagcccgcaatgcgagaaggcgtttcaaactctcaaagaaaagctggtttcctcgccggtgttaaccttgccagatactcgcaaggatttcatggtgtattgtgatgcttcgcgccaaggattggggtgcgtgcttatgcaggatggtcatgtggtggcctatgcctcacgccagctacggcctcatgaaggcaactaccctacccatgatttggagttagccgcggtggttcatgctctaaaaatctggcggcactatctcattgggaatcgcagtgaaatatatactgatcataagagtttgaaatacatcttcacccagtcggatctgaatcttcggcagaggagatggttagaactcatcaaggattatgatgtgggaattcactaccatcctggtaaggccaacgtggtcgccgacgctctaagtcgaaagagccattgcaacactcttaacgtccgtggcattccacccgaacttaaccaacagatggaagccctgaatctaagcatagtgggtcgtggattcttggttgcgttggaagccaagcccaccttgctcgatcaaatccgcgaggctcagtgtcgcgaccgggaaaattgccttttcccgaacgccagtgtattaatccccgtcccaggaaaagccggggtacaccacacaagcatgatataaaagacacatctttattatatcgataatatttacattattacaaaggcacttcaggcctgacaaacaaaaataaacagcagcggacttgcgggcctacggctccatcttcacaggcgctcaactggggtataagccaggactcctcctaagacatcttctccgaagctgctcttactgagggggggaaagattgagcaagaatgagtacaaccacagtactcagcaagccacaccggagatgcacaattaatgcaagggagtacaaggggataataacatagaggttaagttttgcagtaaacagcatttaaaagtcacttagttgcccaaagccattttataaagacgatcctagagctacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattataacactgacttgggtacattgctcggcttgcccataaccgagggcgcggctattcgaatagattatactctgatcagaggtgtacatctttacccacaagacacatcttcctcacgtgttaccacgtgccacataccaccacggtatacagacggaagacgtgacatagtttccaacccatcctagccatagacaagagtaccgacctaatcccgcctacggccggaacccccgggacaggcaggcgagactgagcccctagcagcagggcaccaaccctctgccatgacatctcgactaccgggccgcagctcgtgtagccttcatttgccctggagaatgtccatcgacccccgacttcatccatctccaatccgtgtacttttgtttataactagactgagccacaaactaagccttacccactagacatgtggaagtacgtagtgctttgcaacagagtcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccatatgatatgagaattcccaaagtctaaagttataaaaaccacctaatgttgcctaattaaccagcgaagcatctacctaagttcatactagtggaaccatgagtagagtgtccactagttgaggttttgtttaatctagggtgaacaaggtaataataataacaataacaataataaggtcataacaaaggtaaataggcatggctaaataaaacagtgataacgcgggaatttaaataaagcggtaatgcaataatttaaatcaaaataattttataaactgggattcaatatgctcaaggatgatgtgacttgccttgctcagagagaacggacttccgaaccttcggcgacgaccgcgaaccacgcttcgggaacctccggaacgacagaagctacgcgaagcacacaagcaaagctacaaacctataaagaagcaataacaatacataaaaagaaagcacagggttctttaggttataacaaacattaggagacttgaacgggtcgattcagagttcgtatgaccaagatatgatcatccgaagtttaatgctgttatatggagatttgcggattattataattaagctttgcaactataaaacatgtgtaagcgctagcctggaaaagacaggaaggctgcgccgttgacatgcggaccccacatgtcaacctaaaggaccgcggtagaccgggtacacagagacggtccacgggtcgacggaagcggaccccgtgtgtcaaccgaggcgagtggccaacaaacggactccactagacaccacacgggatgcacacgtagaaaccacgcggctaccgagcgggcacactaacacggacaccacacgcacaagcgaacgactaccgacaccggcacacgggtaccggtgtcgacaaccgcacaacgggtacggggcgacaccgaaaggacgagggcggggaagcgagaggacggatccttaccaccacgcgacgaggcgtgggaacgccaacgacgaacgggcgcggcggagacagacgggcacaacggagacgaacggcgaggggacggcttcggcggcgatccttggacaaaggcgagacgcggccggcacgaggcttgacgacgcggagccgaggacggaggcgaggacggggctgcagcggctcgcttgacgaacgcggacgacggacggaacggtt

SEQ ID NO: 37887 - DNA, 1281 bp, Oryza sativa
aacgagctagggttccacaggagtcagaggacccggacaagagaagaaagacaacgcccgcctgacgcgcgggccccacgcggtcgggcgacggcgtcagcgcgcgcacgcgcgcggcacgtgcgaaaggggaacggctcgggggctggggcggcttgggccggcggccggcccaggaagagaggagggagaggcggcctgggccgggcaggccgggaggggaggggaagagagaggcagcccgggagggagagggaagagggaggtgggccgaggggaagggggcccaagaggaggagggagagaaaaaagggaggagaggaggacttcggactgggcttggcccaaaggaggaagaggagggatttttaggttttctttttattgaactttgataattgtttttgttgtttaataattatttccggtgctctgaaaattcaagcaaaatttgagggctcctttttagaccaaggagaatttaacaaaaattctccgggccacatttgaatttttcttgcacgtattttagtgtttgccaatttctttccgaattttaattaattctattattccttttagaaaatggattttaatttggaatggatttatcaggacgtgacaaatccaccccccttacaggaatctcgtccccgagattcgaggaggctagcaagaagataggttgggcggtcttctcttcttgtccgacttcttccgtcgcgtcttttataacaaacttgcctagcaaaacttctccactctggactgcttggctcgatctcctattgcagatggaatcttctcttcacctgacttttccctggttgcacctctagctgacttcgactggattatggcacttgaagatgggacttccgttctagaacttctcataattcatatctttggcgtcaacctcatacaagttacccacttcatgtcatgcgtcgagatcagctcgtcattactaagataccatgcttgtcatcatttagcattcaaagtattcctttacacattcagccctgacgtattctttttagatttctcttatcaatcacctttcgacctacttcttggttcgataataaacacctttgctggtatcttctatcaatcacctcttaaactttgtcaaccaagtactcttcactccgagagttgtggatgcttctggtgacgatggggtcctttggcttgctgcctttcagtgaaaccttgaagtgtttcgccaaaagctatactaactgtcgttgcctttgatccgaaaagactcat

SEQ ID NO: 37888 - DNA, 1991 bp, Oryza sativa
gagtcttggcatataccccagttgagcgcctgtgaagatggagccgtaggctgctagtccgctgctgtttatttttgattgtcaggcctgaagcgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacaagatggtatcagagccatctcgactgtaggataagccaagtggataaaacctaaggacatattttataaatgaaactatttgcgaaagctcctctttttctccttcccctaatgctatttgcaaaaggtttactcttttcttccttcaaatttcaactagtactagatggtcagctttgctaagaagaagatatcgccaattgtttgccgaagctccggaagactgcaggatccgctagcgaagcaaaggaagcagtgaagccagatgtgaagcaggagtgaagatcttggaaaacccatcgcagaacctaagccgtcctctagggtagagtcgtttgtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctttctctcccctttgttttccctctctccctctccaaatctttgcaacagatggctgacaatgagaaaggcaataaggtcagaagtcaggacattggtacctcaagctcccgagtgaatgaagcaccagacaccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaaggactcatggtgacgtgccacatgttgacccaaaagaagcaagtaacatttgctttatgtgtgatgagcaagggcactatgcaagggagcgtcctcagcagaaaagaaaaacaccaatgcgaaccgaagatgaagtccgtaagatgatcattaccagcacagaatggcctccaccaggaatgacaagacgtcagagaagaaataccttccgaggtgcaccacagttgacagagcatcttttagctagtggaggtagagtgtctgatagtgaagattcagatcaagtctcctcagatgatgaagatgaaatggaacgtaaggcatgctctcgttgtggagaagtcggtcatgttgccagctcgtgtgccactacatgcgttcattgtgaggaagaccatccacccgacaggtgtccaacgagcaggatcacttgtttcttttgtgaaggaactgatcatgtaccaaaagattgtcaattcagttttctgctgacgaagaagatggccaaccaacccgccagttccaacggagagaagcatcaaggcaacacaaatccccgccaagattaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcagcaaattgtcatccatgcatcccgaagcagtcctatagcccgcgttgcaacagctctaactccagcgagtgcattactgtcgcgaccgggaaaattgccttttcccgaacgctagtgtattaatccccgtcccaggaaaagccggggtacaccatacaaacatgatatgaaaggcacatctttattaacatcg

SEQ ID NO: 37889 - DNA, 9898 bp, Oryza sativa
cgagagttgtggatgcttctggtgacgatggggtcctttggcttgctgcctttcagtgaaaccttgaagtgtttcgccaaaagctatactaactgtcgttgcctttgatccgaaaaggactcatctgtaactcttagtccaaacaaatgtctctttggttaatcacttgatttttcttttccatcctcaggttggttattagctcgaggttagaatatagttcctctgacacgagaccctaggtctcctttgtcagtaaacaattatacacatgatcacatatccgcatcttccaaaagaatcctcttagaacttgtttttattaccaatttctcccatattacatgaatacaaggcactgtcttaaacaaaaagggaaggtgcttaacatcggtacattgtttctactatgggttatgattaacacgaggcctcacaggtatgacgtttgctccagtgaccacaaggcgagtgacttgtcttcttcttgcataatggccggagtgatgacgcaggttacgcttcggctgtggacaatctctcgagaaatgacctggttctttgcagttgtaacaaatcaacgtcttctttgctgagttgtccgcctgggaacgatcgtcctgactaggagttggaattggtggttggaaatccttgctaacattggcatcagtggtaccattattgctatcacccttggagtctttctcagagtcaaaattgctagggttgccattctgggtgccttcattgatactatcgtcgatatcttggtgaatgatgttgttgttgtctacattgcgttcatcttcttggggcaggaactcgtgatacccaacagaagatccgatgatctgaagtggctcagtgcgctgtctttggttaccacctggaaatactgggatgttgacaatccttctcttgcagttcgtcatccgattatgctcactttcaagttgcatggctttgtccacaagtttctcaaaattttcataatcctctaggagtagttgcactgcaagctcatcttttaacccctggagaaacttctcttgtttttcttcatccgtttccacatcttctggtgcatggcgagccaaacgatagaactcgtgcaggtactctgtgacggtcaaatccccttgcttcaggtagcgaaactctcgttttcttagtgtgatcattcctgcgggaacatgtgatctcctgaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgatggtgcgcaaccactcactggcttccataggatcgacggcaatggcaaaggttggaggctcagttttgagaaattctgataacttgcactgttgctggactgtaggcacttgaacgttggttgcccctgctgggttgttccaattctgtaatagttgaaaggctgttgccaacatgttggtttggttaaccacaacttggattagctctggtgaggttgcgttgatgcttctctcattcccattggcttgggttcttgagtcatcggatccatcattcccatagccttggttaccaggattatccatctgtcacaaggtagaggttgagaggggaagcatacaaggagagaatagaccagaactagagacaagaccttaaaggaactaactcttttttttgttgatgtgttgtttgttttgcttattctgcaggttgattaagcaaacaacctagcatggttacatcaccacccaccgatgcaaaccacgcgctacacacacaagcaaggaaacacacgacaaacgaaacactagagggtggcttaggttctgcgacgggttctccaagattttcactcctgcttcacagctggcttcactgcttccttcgcttcgctagcggatcctgcagtcttccggagcttcggcaaacaactgacgacatcttcttctttgcaaagctgaccatctagtacttagttgaaatccgaagaaagaaaagagtaaaccttttgcaaatagcattaggggaaggagaaaaagaggaactttcgcaaataattttatttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccatacaaacatgatatgaaaggcacatctttattacatcgataatatttacattattacaagggcacttcaggcctgacaaacaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggggtacaaggggataataataggggttaggttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccatattttagttgttgagcaaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcccacctacggccgggatacccgggacaggcaggcagaactgagcccctagcagcagggcaccaaccctctgccatacgacatctcgactaccgggccgcagctcgtgtagccttcatttgccctggagaatgtccatcgacacccgacttcatccatctccaatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagagaaagagaggtgtatgtccaattccaccataatccaacaattccatagtgtccaaatgatatgagaattcccaaagtctaaagttagaaaaccacctaatgttgcctaattattcagcgaagcatctacctaaatttatactagtggaaccatgaatagagtacccactagttggggtttttattttcctagggtgaacaaggtaataataataacaataacaataataaggtcataacaaaggtaattaggcatggctagataaaacagtgataacgcgggaatttaaataaagcggtaatgcaataatttaaatcaacataagtttacaaactgggtttcaatatgttcaaggatgatgtgacttgccttgctcagagagaacggccttccgaaccttcggcgacgaccacgaaccacgctttggaaacctccggaacgacgaaagctacgcgaagcacacaagcaaagctacaagcctataaagaagcaataacaatacataaaaacaaagcacagggttctttaggttataacaagcattaggagacttgaacgggtcgattcggagctcgtatgaccaggatatgatcatccgaagtttaatgctgttatatggagatttgcgaattattataattaagctttgcaattataaaacatgtgtaagcgctagcccggaaaggacaggaaggctgcgccgttgacatgcggaccccacatgtcaacctaaaggaccgcggtagaccgagtacacagaggcggtccacgggtcgacggaagcggatcccgtgtgtcaaccgaggcgagtggccgacaaacggactccactagacaccacacggactgcacatgtggaaaccacgcggctaccgagcggacacactaacacggtcaccacgcgcacaagctaacgactgccgacgccgatacacgggtaccggggccgacaaccgcacaacgggcacgggggacaccgaaaggacgaggacagggcagcgagggagagggaaccttaccaccacgcgacgaggcgtgggaacgacaacgacgaacgggcgcggcggaggcagacgggcgcaacggagacgaacggcgaggggacggcttcggcggcgatccttgggcgaaggcgagacgcggccggcacgaggcttgacgacgcggagccgaggacgaacacgaggacggggctgcagcgatcttgacgaagcgaggacgacgaacgagaacggcttgacggagggacgaacgccacgacgatcgggaacgacgagaggacgaggacgacgacgaccggggccggcgaggaggctacgagggcagccggcgaggagacgacgagggcagccggcaacggctgcacggaggcgaggacggcgtggaacacgccgcagcgatgacgatgacggaggcggcgccgcaagacgacgagccgggcgaccgatgggacgtcgacgacgagaacgatcggagacgacgatgaaacgatgatggcaggcagcagcggctgagcggaggaggggacggcgtggaacacgccgctgcgatgttggtgaaggtggtggtgcagcggggcgacgagccgacgaggaggaaggagaggccggcgcggagacgacggcgttccggcgaaattcgggcgaggaggaggtgatgccggggaagaaggcgatgccgcggtgtcgaaggaggagacggcggcgtcgatcggcgcaccggcgatgaacagcagccggctggagggagtacagtggcaccaatgccactggttgccggcgggggcaccgttccggcgagtttccggcgaggagacggtgaggccggtgaaggggacggtgttgcagagccgagggaggcgacgacacggccggacgatgctccggtgaggagggagaggcggctggaggccggccggcgtcggagagggagaaggagaaggcggggagaggtgatacgaccacggggaggctcgggaaggggctaaaacgatagaacgaaggatgaggatcccattttataggatgggggagagagccggccacgggaggagcgggaacggcgacgggaatggcggccggcggcaaaggaaggcggccggacttggcgcggccgttcccggcgattgggggcaccattcaaggggaaattaagggggaattgaagaggagggaaaggggattaattccccctaattaatttggaaggaacggttggatccggggcggatttggaggaggaaacgagctagggttccacgggagtgagaggagccgggcgggaggaggaagacgacgcccgcctgacgcgcgggccccacgcggtcgggcggcggcgtcagcgcgcgcacgcgcgcggcacgtgcgggaggggagcggctcgggggctggggcggcttgggccggcggccggcccaggaagagaggagggagaggcggcctgggccgggcaggccgggaggggaggggaagagagaggcagcccgggagggagagggaagagggaggtgggccgaggggaagggggcccaagaggaggagggagagaaaaaagggaggagaggaggacttcggactgggcttggcccaaaggaggaagaggagggacttttaggttttctttttattgaactttgataattgtttttgttgtttaataattatttccggtgctctgaaaattcaagtaaaatttgagggctcctttttagaccaaggagaatttaacaaaaattctccgggccacatttgaatttttcttgcacgtattttagtgtttgccaatttctttccgaattttaattaattctattattccttttagaaaatggattttaatttggaatggatttatcaggacgtgacaattaccacaaggtgtcaatgctcactttcagccccagccatcagttgacaagacagaggccagtatcggcattgtacctttggatgttccagcacagcagccaagaaatcaagtaccagatggagaacccgagcataagaaagttattgtctgttacaactgtggtacctgttaaggaagcggacatgcccatcgccaagtggtcactggagcaaatgcagtacctgttaagcctggcgctaatcagaagcaaccataatactcttatatcagtgttcaaatacttttgttttatagttgttccccgtcaatcatgtaataacagagaaacatgagataatgaatgagcttgataagtttattgagggatccgtgttaggattgcaagtgctgtgagttgtgtacattttgttgctgattagggagacctagggtctcatttccgtaagctcataatctattatgaatcaaataacctagcgattgatggcgaagcaaatcaagtgattaacccaagagacatttgtttggactaagagtttcagatgtgtcttcttcggatcaaaggcctacacccgttgtggagaaattggacacgttgctagcatgtgtctcacactctgcactcactatgaagaagaccatccaccaggggagtgtcccactcgcaaggtgacatgttttctgtgcgaaggaacaaaccatgtgcccaaggattgccaactcagtgtgttgttgaccaagaccgcagaaatccaacgaacaatcctacgattgtctcgtcagctagtcagctccaacaacaacatcgatgatatcatccacagcaccaatgctcctcttgctccacctaactctgcaataaatcatggcaataatacctacagcactaaccattctctgcaccgacagccccagcaaagaattgtcgtcgatggaagaagttgtgtctctccccgacctactccaggccaagcaaagggcaatcgacctccggagggcgataccaagcagaagaccgtcatccgcttcaaccagcaatcagaaggaagcttctcctgtgaatgatagcattatgcagtcctatcacatcatcacagaaccaatcaaggatgcagtcactagaacaataccagctatatctctccagaatcaaaatgagcagccatgtttgtggtttccagttcgctacttatcatggtgtaatcgaaagtttgcagcaatcatgtaatacagaaatatattcatgtctataaacagtgagcttgctatgcttatggatgattcatgttgaggatacaatgtaccgatgttaagcaccgtccctttttgtttaaggcagtgccttgtattcatgtaatatgggagaaatttgtaataaaaacaagtcctaagaggattcttttggaagatgcggatatgtgatcatgtgtataattgtttactgacaaaggagacatagggtctcatttcagaggaactatgttccaacctcgagttaataaccaacctgttgatagaaaagaaaaccaattaaactgtgttgggttaaaaagccaatgagacagtagttgggggtaggagtttggatacgccttttacagatcaagataaggattgttggatgaaacccataagggtacctgccatgcctctacattgataagttcggatatacctgcaaacagttaagaagatccaggagacatcaatgtttgagaacatagtagtcgatggttggtaattagtctatcaggtatcagaagagggtcaaaggtgatatggcagaagaacaatttggatgctccccatctcgaggaagcactaaggatgatcatcggcaattaaaccctagtggcatagatacagatagcaagcaatgtatttccctgaaggtagtcagtacagctttctgacaaaccacatcaaggtgtcactgaaaggcagcaagccaaaggacctcatcatccccagaagcgtccgcaatccacattaaagaataccacctgttagagataagccgaaagaagattgataaaagagattggcaaagatgttctctagcatgaaagaagtaggccgaaaggtgattgataaacagaaacatgctctgcatcgctcaaggaagacccctaattgtaattgccccgcaacagtcaccttgtcattaagtaagcaagatgacctaggtaaaagtgtttttatgaaggcaaagagtgaaatcttcaactcggtatcagatgctacacggagtgaaaagtacaagcaccggttaccaggcaatgccatgacttgggagatgatccaatgggaaagaacacatcaaggttaaaggtgtaaaggaatacgttgaatgctaactgaggacaacctgaagataataaggggaagtaaactgaatgtaaagaaagtgaatccgagttgattgttcgtgagggctattcccagttatgaatcaagtgatatgttcgaagataatctacaggggtcagattaaaagcacatctaacaacgaagcctcagatttgacagggtaatgattagacaataacaaatccagcaataaagccattggagaagacgtcaaagtatgtcaagtgggataaactggttctcttgggaagcataacttatagttagagtggttgacccttgcatcgaatagcagaagtacctagcaccggagaccaggaaagctaatatgagacagttggtggcaagttagaagtgaatgacaggcatgatatccttatgatgacaaacctggtaccctagtaatgacaagctagtgttgacgcatgacataaagtggtgacttgtatgaggttgactccgaagatatgaatcatgagaagttcgggaacggaagcatcattgaactaccgcaacctagtctgagtcagccaaaaggtgcaccctggtccaagtcaggtgaagagaagattccatccgcaacaggaggtcaagccaagcagttccgagtggtgaagttttgctggaagtttgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagtcttcttttccccccttcctctcttgggccggctcggcccaactctccctccctctctctcctctccccgcggcccatcggcctcctccccgcgggcgcgccgctgacaggcgggcccgcccgccaccctcgctgacgggtggggcccacctgtcatccctgacctcgcgccgcgtccgccgcccgcccgtgccctagcgccgccgtcgccgcctattccgccgtctcccgccgtccccgcgcgcattaaagtggggggaatcactcc

SEQ ID NO: 37890 - DNA, 1158 bp, Oryza sativa
atgcatatgcaaccacttccccatctggcatcagaacacaaccctaacccaagttgggatgcatcacaatacacttggaaacccttctttggatcaggtaaaatcaaaataggagctgatattaagcgattcttcaactcttgaaaactctgcttacattcttctgaccacttgtacttcacatccttttgaagcaatcgtgtcatgggcttagcaatcttggaaaaattctctataaacctccgataatatcctgcaaggcctaggaaactgcgaatctctgaaactgtctttggttgtttccaattggttatggattccacattactaggatcgacggcaactcctcctgctgagatgacgtgaccaaggaacttcacttcagacaaccaaaattcacacttgctaaacttagcatacagttgatgttctcgtagcttctctagtgcaaggcgaagatgttcttcatgctcttctttggttcgggagtagataagaatgtcatcaataaagaccaccacgaacttgtctaggtattccataaacaccttattcatcaagtttatgaagaaagcgggggcattggtaagtccaaaagacataacagtacattcgaacaatccatacctagtggtaaaagctgtcttaggtatatcttcctctttgatcctcaactggtgataccctgatcgaagatctatcttggagaaaacgatggcacctttaagctgatcaaacaaatcatcaattctgggcagcggatacttattcttgatagtcacatcatttagtgcacgatagtctacacacatcctctgggtatgatctttcttttccacaaaaataaccggagctccccatggagatgaactcggtctgatgtatcctttctgaagcaaatcgtctacttgcctcttgacttctgccaactcattggctgccattctataaggtctcttatggatcggagtcgttcctggtaccaaatctattctgaactctatatcccttttaggcggcataccaggtaaatcgtctgggaacacatcgggatactcccggactataggaatctcttccaaagttatttggttcagtcttgaccttaaaggctcagaagacaatgcatgaacagttacaactcgaccatcattactg

SEQ ID NO: 37891 - DNA, 428 bp, Oryza sativa
aggagggcgacggcgggaaggcagctccgggggtcacctcgcgaaacggagggcaagccggggtggaggaggtggcggcgacgctggaggaggcgacggcgcggccggccggcgcacggtcgaggcggcaccggcggctggaggcggccggcgacgtgggagagagagggcgacggtggggagggagctagggaccacggggaggctcgggatggggctaaaacgagagaacgggggatgaggatcccattttataggatgggggagggagccggccacgggaggagcgggaacggcgacgggaatggtggccggcggcaaaggaaggcggccggacttggcgcggccgttcccggcgattgggggcaccattcaagggggaattaagggggaattgaagaggattcaatggggtttaatttccccta

SEQ ID NO: 37892 - DNA, 1984 bp, Oryza sativa
  unsure (1)..(1984): unsure at all n locations
aatatcatgcttgtcatttacttctaacttaccactattcacttcatgttgtcctcagttagcattcaacgtattcctttacacctttgaccttgatgtgttctttcccgatttctcttatcaatcacctttcgacctacttctttgcctggtaataaacatctttttcgatacctcctatcagtcatcttttgacctttgtcactaagtactcttcactccgagagttgtggatgcttctggtgacgatgtggtactttggtctgctacctttcagtgaaaccttgaagtgtttcgccaaaagctatactgactgtcattgcctttgatccgaaaaagacacgtctgaaactcttagtccaaacaaatgtctctttggttaatcacttgattttcttttccatcctcaggttggttattagctcgaggttagaacatggttcctctgaaatgagaccctaggtctcctttgacagtaaacaattatacacataatctcatatcgacatcttctgaaagagtcctcatagaacttgtttttattacacctttctcccatattacatgaatacgaggcactgccttaaacaaaaagggaaggtgcttaacatcggtacattgcatcctcaacatgaatcatccataaacatagcaagctcactgtttctagacatgaatatatttatttattacatgattgctgcaaactttcgattacagtgataagtagcgaactgaaaatcacaaacatggttactcattctgattctggagagatatagatggcattgtcctagttactgcatcatccttgattggttctgtgatgatgtgataggactgcatattgctatcattcacaggagaaaaattccttctgattgctggttgaagtggataatggtcttctgcttggtatcaccctcctgaggttgatttcccttcgctcggcctggagtaggtcggggagagaaacaacttcttccatcgacgacaattcattgctgaggctgtcagtgcagagaatggttggtgctgaaggtattattgctatgatttattgcagagtcaggtgcagcaggaggagcattggtgctgtggatgatatcgtcgaggttgctgttggagctgactagctgatgagacaatcgtagggttgttcgttggatttctgcggtcttggtcaacaacacactgagttggcaatccttgggcacatggtttgtaccttcgcatagaaaacatgtgaccttgcgggtgggacactcccctggtggatggtcttcttcacaatgagggcagagtgtgagacacatgctagcaatgtgtccaatttctccgcaacgggtgcatgcttttaattccatctcttcctcgccgagacgtcggggggactcatattcataatccgaggagacttgatctgacccttcactatcagatactctgccaccatggcttaggaggtgctgggtcaactgccgtgcacctcggaaggtatttcctctttgacgtctaggaatagttatccctgctggaggccattcggtgctggtaatagtcatcttacgtacttcttcttcagttcgcatcggcgcttttctcttctgattcttactcttcttgcctttggcgtgcttagtacgtgaccccacgtggtacgaaaggctaggaggaaagcaattcccgggattcaatggattctcttcattgggctctctgctttgcacactaggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37893 - DNA, 15207 bp, Oryza sativa
gagggagggcaaatgggggggaaagagggagggaatcacggggaatatttcccccctcttgattgcacgcgggacggacgggagcggcgggattcgcggcggcggcggcgctagggcacgggcgaggcggcgggagcggcgggaggaaggggatgacgggtgggccccacccgtcagcgagggtggcgggcgggcccgcccgtcagcggcgcgcgcgcggggaggaggccgaatgggccgcggggaagaggggagagagggaaagggatgggccgagccggcccaagagggagagggggagggaaagggaactttttagggtttttctttttataaaaccattttaactttgtttatttcttcttaaatattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttcaaggatgtattttagagtcgttttgggacgcgacattcgagcatatcggctttgcatcttctcggaggttgttgatgtggtctaacccctcgtttgataggtagctgatgttcaacaatcgatcggctgagtcctggcatctcataatactcccaagcaaagcaatatctgaattcctttaacagctctatcaacttggttctaaattctgaagataagttcttactgataaatctcggccttggtcgatcacctggaccaatgtcaatctcttccaaatcatcggccgacatgaaaccctgtccttgcttgtcatcgagatcatctactatgtccttggtgtagacgtttgaaccctccacgacgccctcaaaataatagcttgggctctccatcttcaattggctgtttatcacaatcggacacttttagaaaatctccatcccaaacttttctagataagcaatcgagaccatccatctcccaaagagctaaattggcactggcaacgttgactgacctgtcggctggcacgatttcaatcttgtcgccttgccactgaatcaagcattgatgcatggttgaaggaatacaacaattggcatgaatccaatccctaccaagcaacaagctgtaagaacccttcccaccgatgacaaagaatgttgtagggacagttttgctaccgactgtcagttccacattcaaaactcctttggtttctgatgtattgccaccaaaatctttgagcgctgttgtcgaaacaacaactgcatacgttgaaagacgtggttactcaacggtggttggaaagaaagtaaagtgtattgaattgagaatttttcttaggatccccctgttacatgaccctaggagactatttatagccttattacaggttcttgctactagggtttaggttatacaggggaatttacttggctgcccttatgaaagggacatttatgtgggtatacagtgtaattgaggtacatgggctcctaatgggccgtcaggcgattgttggctcaaaggccactgggccttcgtgaggccgaacttgctatggcgaagtcgtctcccttcgacatacactcttcgccttacatccttcgcccaagaggtctttggctctgcgaggcacccgcgctattctccgcccttcgcggtctttgctccatagtcttcaccatgggggcttcgccccaaccgatcttgacgtcttaggcttgaatccttactggtcgcatggtttcggcaggtttggtcgaagggcctcatgccataccgccaacaagcccctcacgggcaagggtgagataggagcttcggccgagaccgtgcagaccatgtggtatggtatgtggctccccctttcgaccgatgctcctgccgaaacctatcttattcgtgcaaagaaagtgtgttgtgttttttcggttggtattgttttgtagctttcgcctcttgcggatggtggagttattttttttatttttcccgggccgaaaggaacagtaatgggctttcccttcatgggcttattactgtgcggctcggtcgatggaaatttaccgtttcgcctaccctcgcgacacgtgacgctttattactggtgggtaggcgaaccattgcctgggtgggctatatattctctccctcttttcccttttcactgccacacttgtcattttcactgcgcgcgctctcttccaccgttctatcctttcacggcgccccttgacccctcatatctttcgcccgttctctttgttcgccactgcacacacccttcgccatggctcctcgcaagccaaaccacgggccggattgacgacgacaccacagcctttttggggatttctctcatagatgacggcgagctggcgaagttggtcagctctggggtgttggttgaggggcaggctttcgcccctgggaaggccgtggtaccgaagcccgtcgacaaccagacgtggtgttcgccggcttttttgagcggggcttcggtttccgtgcaacatgttgttgccggagatccttcaccttttccaggtagagttcccacagttgagaccgtcggcgctagtccggattgccatcttcgactaggcgtgccggacctccgggtttgaacccagcgccgaactcttcggcgccatattttttgccaccatgaattcgaagatggtggtgaccccggccggaacgaagaagacggtgttcgggagcgtgaacttcaacgttcgccccaagcgctccgatctctggcctgtgaatgccgccatgtcgaagtgcgatcgccactagatggcgaggtggttctatcacaccatccccttcgaggctgggtccgagtcggcgaaggccctccgatgtcggcgcatggtgattgcgccgaaccggaaacccaagatcgccgtggacggcgcaatggaggcacggttcgccttgctacgcaaggtctgctcccgcctcagctgccgcgacttggtggaggagttctgtatgcttcacatttttcccctctccctgtcgtggcaagtcacggttgaccaagacgaagaggtcgacggtttgccgaagctggttcttcctgaggggacgaatggtgagaccacgctttcgctatgcacttctgtgttttgctattttcccggttcaacgcttaatatggctacaccttttattttcatagtgttgactctcgatcaggccgacgctgaagcctggaagatgatcggcgatgtgtcggtcatcgagtacagccagctgctcacacgacaggctgccggtcgggcgaaccttgtttatgacggcgaactgcctccccgggcgaacccccacaaggccgacgacgatgcagggccttcgcgaaagggacgcgtggacaagtgaaactggcccctagaaagcgatgggtccctgcttgctccgattctgacgccgacgacgaggatgacgtcgaagagcgtgacgacgaggaggaaggggaggaagaagagggggcggaggctgcggccggaaaggctgcgaacgaggcggttgaaaaccgcgccgagacccctggctacactcctactccaagtccagggcataacgagaccggggtggagtcgaatagctcccaccttgatcgaaaggatttggagggagcgaaggtgctggttgcgttttcggcgggcaaggtggcgaagggggtagtccggttaagaaggccgccaagaagaaaggactcgtcgatgttgctcgtgtttttagcgacgacgagtcttttgacgaaaccccgacttcgcccgccagtcgcagcttagatctttcgaccgcccccgttgtttcgatcgacgctggcggcgcaggtggcagtgccgccgctggggcctcagcctccgctgatcgtgtcgtgaaggctgcagctagggttttcggaagccctttgcgtctgccagttgtttcgccgctagagaagccgaaggggaaggggggggcccatcgaaacatctgcctcggagtattctctcgcggcgccccacttcgcccccggcgattttgagacccgggcggaacttattccctttgttgagggggtaagcaaccttgtctctcctgccggcaccccgagcctattcaccgagctgaatgagttcgacgaagggtgttctgctattaaaagcttggcagttcgggtatgctattcgctctctcttcttgtttgtctttattttcatattacagatcccacaactaacatttgctctcttcatccgttttaccttacatccaaattcttgcggctcattgttcgacagagcgaaccgtgcgggcccatcttgacggatttaggaaccatcttcgggccaaggatgatgagattggccgcaagaatttggagatggaggccctcgccaacaccctcaaggaggcaaaggtggaaaacaagcgactccaagccgaactggagaagggaagagaggctagagctgaggtcgatcgcctcaaggccgagcttaaaaaggaaaaagcccattccgccgcgctaaccgactattacaatcttactgagccgaagatagaggctcttcgcctggaggttagcaaggctgaggcaagcgctgcagaggagtcgcaacggttttcgtgggagatggcgaaagccaccgagtccgcaaaaaggcatgccaaactctccgccttgccctttccgacatgggtgcgagggtgcgaggagtccctgccaaagatgcctctatctttgacttttcggagtggacgcaataggccggtggtgcggtttcggactacgccactgcgtacggtgattcctgtgcacatgtatcggcggcgttcactatgggccttctacagtagtttggctgtgagcatgtcgccgagttccctaactatgcgaagggggactgggaggttagtgcacaggacgtttcgcctacgctccatgcgtggcagaagcagttctggcagaaggatggccgatccactgctaaggcgcgccttttggagcaactggcgaaggccgaggcggcagaccaaggcgaaggcaaggatgcggcagaaggagggggtggaggcgatgcccaggatcacccagagttgtgaggccctccgccctttccttagatttttgtagtttttcttcttgcgtttgccgtgaaaggcgaacaatgtatatttggctgatggccccttacccttcttattgtagccgaaaatgaccttttggatatttggaatgtatgacttagtcttagtcactttttatggtcgatgcctttggtgcatgtgcttgcgccattttcgcattacgtaatatttgctctttttcgcccattcttactatgcaattcaccttttgccctatctgcactgtttagcagggtgttcgccgaaaattgtgcattcggcccctctctgggaattggcaaagcaaaaacgagaaattcgtggtgttgaagggtctgccaaaagtgcgatgctcgtttcggcctgtttatcgcgagatggtaataaatggccacagctataaggtttttaaggttgctggctggctgcgggtgcaccccgggcgaaccttagaagattacgatcgtgttcatacaaaatgtttggaggatatggttcgcttttggcgaagtcatcagaagaccgatcgacaggaggcgatctcccagcgtcgttacagtctagtctgtgtttcgcccccttctccacttagggtcgtgtatgatattagtagcgatgatgatcctagttcgcccaaccattccttagagagtgaggacggttgtgggggcgaagatataatttatctgtaggctgggctgcagagccatcgcttttctttacttgtaccatgttgtatggtttgtattcttggatgtgtattttcctcgaagtcaataaagatgtgctttatttccttttcactattttttgcattgtcacttctcgtgctttcgttaggtcggaacatgtcggcccctttgcgtgtattagcgaaataggtctatgacttttcagctttcggcttccgttttcgatctgttttattctacattgaaggaagcacttgtgctttcgttttgatcgaatgtaacggtgttcagttagttgtttctcgaaacaagatgttgcggtttcaacgttcggcgagcggtgcttcggccgattcgtttcgccccctggcattttcgctgatcaggcgtttgccttagggtttttccacagattatcaatcacacaaataagaaggcgagagacacaaagattttatactggttcgggcctccagggtggataatagccctacatccattttttttgtcttttttttcattttcctcttttttttgcatttttgtgtcgaagggcttacatagtgccgaaaggcttacataacaatatgtacatttttacatgttggcgatctgggtgccacccgttctacacatagaaacgctggagagaggcagcgttccaggaatggtcgaactcttcgccttccagtgtcgccaggcgaaaggagcccgtcctggacttgtgcttgatgaggtacggtccttcccacttcgattcaagcttgccaaccgccactgggttcgctttcttccttaggacaagatggccaggcaacagctccgtcggtcgaacttttttgttgtaagttgccgatgtgcctgtggcgtatttgcgcatgtgttcaagtgcttcgactctcaccccctccaagagttcgagcgacacttcgcgcccctcttcgcccccagagaacatcacccttggtgatgaaagatctatgtactagaattgccttgtaaggggagattggaatatctatgatcctaagagtgtggtgattgttttggtgattaatgacaacccattgttggaactaactatttccatgagttggtgagattaggttattccggcatcaagttaaaagattgaagctagaagatggacattataccttgatgaggagtaagtgaagacattgatgatgcgggggtatgaaatggctatctatggcaaaccggtgaagagaaagaaaggctcagctagaagatggacattataccttaatgaggagtaagtgaaggcattgatgatgcggagtatgaagtggctatttgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagtcttcttttcccccttcctctcttgggccggctcggcccaactctccctccctctctctcctctccccgcggcccatcggcctcctccccgcgcgcgcgccgctgacaggcgggcccgcccgccaccctcgctgacgggtggggcccacctgtcatccccgacctcgcgccgcgtccgccgcccgcccgtgccctagcgccgccgccgccgccgattccgccgcctcccgccgtccccgcgcgcattaaagtggggggaatcactccccgtgattccctctctcttttccccctcttttctctctctctctccctcggatccgtttggaatcgctcccgcaatcttcgccggcgtcttcaatggcggccgagatctccgcgcccgtttcctccctctccggccgcgctctccccctcccgacgctatataagcgttccccgtgctctcctcctccgtttccgccactcgccgcctctcctccccgtcggaatcgagcccgcaccgtcgcaccttctctccgccgtcgccaccgagctccggttcgccgccgtcgtcgctccggacctcctccccactcggcgtcacctccttcggcttcgccgcgtccccgtcgacctcggccacccctccgcttcgctcgccgaccgccggagcaccgtcgtcctcgccgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctctctcggctgacgcaataaatgagtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggggtttagtagagtaaaagccttttcttttccgtcggtcgtgtagatgctgcagcttcggaagatccgctcttcgtggaagttgaagccggcgtttgggaaagcgagcaaggcaagtcacatcatccttgagcatattgaatcccagtttacaaaattatttttaatttaaattaatgcattatcgctttgtttaaattcccgcgttatcactgttttatttagccatgcctatttacctttgttatgaccatactattattgttattgatattattaccttgttcaccctagaataaacaaaaccccaactagtggaccctctatttatggttccactagtatgaatttaggtagatgcttcgctgattaataggacaacattaggtggttttataattttagactttgggtgtattcatatcatttggtcactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcttgtcccgggtgtcccagccgtagggggattgggtcggtactcttgtttatggctaggatgggttgggaactatgtcacgtcttccgtccgtataccgtggtggtatgtggcacgtggtaacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaatggctttgggcaactaagtgacttttaaatgctgtttactgcaaaacttaacccctttattattatccccttgtactcccttgcattaattatgcatctccggcgtggcttgctgagtactgtggttgtactcattcttgctctatctttctcccccccttcagtaagagaagctttggagaagaagtcttaggtggagtcttggcttataccccagttgagcgcctgtgaagatggagccgtaggccgctagtccgctgctgtttatttttgattgtcaggcctgaagcgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacactatttatggcaaaacggtgaagggcaagcaaggctccgctacaatggaccatgcgtggggtgaaggtcaagcaagaggcttggcgccgatggaccgaatccggtggtgaagggcgagtgaaggctttgtcatgatggtcgtggtggaccgtgcgaggccatttgaagctatgagtaatccgtatcaattataagaagaccgcaagatggaatgccgaggatcaagaggatttggttcttcgatgaacatcaagtcaaaatccaaagtgggcattgatcaaagcaaaggtataatttatttgggactaatatgcttaatgagtgtaggtgagaatagtcccaatagcgaaatggaattgacgttgacaaccctcaaggtgaagcaagaagatgacattcttagtggtgtattagtcccaggttgcttaggagtgggctaggatgcttggagaccccccaaaacaaagcggcaagaagacttggagccgagttagactagtttactttttcgctttgagtttaggaaaaaccgtactattaagaggggttccaagtgtggttctgagataacacaagtgctcttagtggtgtccaagtgttgaaatatttttaggagctgtttttgaaaatggctctactcgggacagagagtcccacctggaggttctgtccggaacttcctggcaccaaggtgaggttgaaaaatttcataagtgctgcccagaagttcctggcacttttacccggaagctcctggcaggtttccagttcaaacttgtgagtaacggctagatgacgtcacctagccgttatatatatggatctcgtccccaggtcaccctttggccattccactttagttcttgtgttccctaacttgttctagcatctcccaatgtgattttgcttcctccacccaaatcttgtgtacttcttgagtgagagagtgattttgagggtggtggtgaggattggagaaggttttgaaggctaggatgacttgagcacttggggtatctcgttgggctatcatttgaagcttgttactcttggagggtgacctcctagatggttaggtgtcgcccgcgagtttctaacaaggttgtggattgacccgggcaagtttgtgagggtgctattccacctccgaaaggaaacgaaatactcggtgagtggaatccgaggtgaggtttaggatgtcgtcttggtagagcaagcctcacttgtggtgttcttttggtgttcaagttggggatcttagtggtcacttgaaaccaaagagaagtacctaggggtgttggcttgaagaccagagacctcttcctaggccttttcttggtgaggtaaggggttaatcaagacccggctctttggagctcctcaacggagacgtaggattctcggtggagaatccaaacttcgggaaacaatcgtttgtctcctctcactctctttatctttgtaattgtgatgcttatctccttatttgcctagttgtgctatcatgtctcccattgtatgatcacttgtgctatcttgtgtattttcatgtgtattactcttgtttgagacatgttgtacctctctatggtttaggcttccttgtgatttaatttacttgttgtgaggtgcttgaaatagcaattcacaactgctaggaagttcctaggaagaacctcggaagttccgggtagctttctctgcttgtgagaaaaagctgccaggaagttccggaccttttgccatgaagttctgggccctgattttaaccgctgtgatttgaattaaattttaggagcgcctattcacccccctctaggcgacatcaaggccgtttcaattggtatcagagcctaatctccggattggcttaaccgcttggagagaagatgttgggggatggcgagaaaagtgtgaagggtaacatggttgatagtcaagatgctacaatgtcaacacgaggtgaaactttccttgaacttctcatgctagatggttcaaattacatgtcttggagtactcgcatgctttatgtgtttagggtcatgggacctcaaatatagcgagttgtagatgtgagcatttctcctcctagtgatcaaatgatatcatttgaagcataatagaaatgcatacatctcaatgctcaagctactaatattttgtttagtgctttgagtgaagatgtgttctaatccatcatgccacttgaggatgctcatctcatttggaacacactcgaggagagatatgacaagtccgagtgtgatgaggcaaagctcgctatagaagaaccacttgtggagtgctcaaattcatcgacaatttgtaaagagcctcaagtgattctatccaatgagcaagatagtcttgccacattcacctcctcaccaacacatgtctccattaaaggtaatgaaatggtgagtagcgtcaatgtggatacttctacttcctatagtgcttgtcgaactaatcttttgaaggtagaagtatgtgggaaaaaatggccaagtgaagaatttacatctccaagatgctcatcttcacacttggatgaatattcttgcatcatggagaaatcatatttggagaaagaaaatctagagcttaaagctcaacttgtggagctcactagcaagcatgtggacctacaagaaaaatatgatgagcttttgtgctctcatggaaatcttgtggattcacatgccatgctagaagtaactcatgaggtgatcataataacggtaaaatcctatgtgcctcatgttcaagttgactttacatgtgctaactcttgttgctctcaagcaaatatttttctgcgcactacatgtgacttggattatgtagggaaaaaggataaatacatcgatcatggatttgtttgcaatgctcaaccttctcaagataaccgtgaaagcatgctgaagaagcttgagaagggatcaaccgtagcttgcaccaagttctatcaagaagataacaagtccaacaacaagagcaaggggcaagatcaaagcaagaacaaagcttccattacttgcttcaagtgcaagaaaatgggacatcatgtgagagattgcccttggaagaaacagaagaagttgagcaagaatgaggatcttgctcacagttcttcaaatccaccaaagagggacactttgcctcaagttgtccttgcaagattgatgatgaagccacacttccaagaaagacatcaagaatcaacagaaggaagtgctacggttgcattgagaaggggcatgaaattggattttgtccgcacaagaaggatgatcatagcaatcgatcaagcaagaggcaaaccggcaacaagcaagtcaagaagcaagataaaagcaaaactcaactttgctacaattgccgggcaaagggacatattggtaaaaattgtcccattggtaaaattcctaagccaaacctctcatttcatcacaatttgcttaggaaggccaaaaatggcacttgtgctactagggtgattagttcgctacatgctagcacaaaggccatttgggtccctaaatctcttgtgactaacatccatggacccaacgtgatttgggtaccaaaatatgcttagattgtcaattaggtacttggaggtgcattggaggctcaactcatccttgaagaactaactttgtgcaatgagcaaaaaatggaatcaaggatgtgaataattgttctacattaagaaccaatgtcatctcggtaacaagtatttacattgaaatttctatatcctaaccttgtgtaggttattacttgtgtataatgtctatcctttaatggtgcttaattgattggcaaatttgatcttgagtaatgttttggttatctcatttagggggagtgttataacttctcatatcatttgcatcccttaaatgtgttttgattaaattgatgctataatagtcttcaaaattctattttggttaaaaagtaaaaatctataaagttagttgtgaaaacttggttttgtttgttcaaaagggttccttcacctaattgagaggtattttaaaagttgattcaaacaaaaatgagttttggcaagaaaattgtcacgaccggaattaacccaatgggcgttccttacgtgcgtgtattattccttgtcccaggaggcaaggtacaccaaaagttgatacatttcagagtttatcaagcggaagcgtaaatagttaaattattacatgggcagcgaaggcccagcacacacaaagacaaacgagaagcagcggaagactagggcgacgaccacatgcgcttgacggctggcacgagctagacaccaaagccttcatcttctaggggctcctcttctgggtttgggaaaaattgagcaagactgagtacaaccaccgtactcaacaagacacacccacaagtacagaataaatgcaagggagtacaaaggagttatactataaagggttagggttgcagtaaacagcatttaaagatatttagttgctcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacgaacgga

SEQ ID NO: 37894 - DNA, 6968 bp, Oryza sativa
agcacagacgctgcggacctgaagcgtccctgcggccttgaccagactgcgcagctggcgtaggaggacggggcacacgggtcccttgctggctctgctgttgctgcggctgtgggacgcgcaccacgaattgaggtcggggcgcggagcgaggttgttgctgctgttgctgctgcgaggacgatccccctggatagggattggtgtagcggaccctttggttagcaccctgttgattgcggacattcgccaagcggcgcttgtgcgactccagttccttgtgcttggcttccaagcggatgctcttgtccaccagacgttggaaatccggatagtcaccggagactagacggacggacagctcagggtccattcctgccaagaacttctcctgcttttcctcatcttcccgcacatcctccagggcgtaacgggccaggttgttgaactcatgcaaatactccatcacggagcggttgccttgcttcaactctcggaattcccttttcttaagggccacgactccggcgggcacatgggttctccggaaagcggcggtgaagcgagcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatccacggggttattggagctagagaaggttggtggacggatgcggaggaactcggcgagtttacagtgttgtgggggtggtggaggagcattctgttgtggcggattttggaggtggtggaggaaagcagtcatcatgttggcctgctgggcgaggatttgggtgagaatagcgttggtgtctggtggtggtggtggaggcggaggaggaggtggaggtggactgccatggttgttgtggttgctgccttcgggttggttgccatcaccggtattagcacttctcctggtcgtcaccatctgaaaaccccacacaggaccagcaaacagagagagctgacaattaaagctaaccacccacgactaccataattcttgaatttattactgctattaaattagttcattaaagttcaagttgcttaagcaaataaaataaagacaggctccgacacagttataccacacaccggcataaccatgccccacacgactccaacaagaagacaaacgagaaagaatacacgcgcaagcctactaactgctcgtctaccgctgcgacgggccaggacggaaggtgagcaacagcgcatcctccgtgctaccaacgccggaggcttccccctcctgaggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcgacagacctctccctgggcgatcttgagctgatgcagctgcgcctccactgcgtctagttccttcttcagctgcagattctcttgacgcagctccaggatcttcatgttgttctcgaccatcccacggcgcaccatctgatggaagtcgatacgagccgcgtcgtacgcctccaccatgcgcgccaggtgcatgatggtagcgtcatcctccgagctagcatcccggaaggtggcgaagtcgcgggctcctccgcggcgagggtggtagcggtagggcgagtgctgcaactcgtccgggtagcgctggtgaagagtgccgatggcgaggagagcggcgttctggcaagcggcggggaaagaatctccacccgcggtgactgccaacgaagtccgctcgggagagccagtgaggatcactgcagtaacctcccaagcagcgtggggctctgcatcgtcaccctcctgctccggaagcggcctgccctggtagtccactccatgtggataccccaggacaacgcacatgccccgcagctccaagacgaaaccagtcaggtccagaccacgacggctgatgctgccggccatctacaaacaaaaacaaaaagaaaaacaacattttaaaggtcagattttggcgataaatgaagcaacaggacagagagagactagaggattttcacaaataagacaggatttttttttatttttgaaaatattgctaaggcttgggatctacggctcgtcctagggtcaaaggtggctctgataccacttgtcacgaccggaaataacccaacgggcgttccttacgtgcgtgtattattccttgtcccaggaggcaaggtacaccaaaagttgatacaattcagagtttaacaagcggaagcgtaaatagttaatttattacatgggcagcgaaggcccagcacacacaaagacaaacgagaaacagtggaagactagggcgacgaccacaggcgcttgacggcagacacgagctagacaccaaagccttcatcctccaggaactcctcttctgggtttgggaaaaaattgagcaagactgagtacaaccaccgtactcaacaagacacacccacaagtgcagaataaatgcaagggagtacaaaggagttatactataaagggttagggttgcagtaaacagcatttaaagacacttggttgcgcaaagctattttgtaaacacgattctagaactatacaatattatttatcaaggccgtgaacccacatgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccacctacggctggaaccctcgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaactattttggggattttgaatagaaggagcggtgtgaagccaattccacaataaccaaaccattccatagtgtccaggtgatatgaatattcccaaagtctagagttgaaaaaccacctaatgttacctaattaaatagcgaagcatctacctaaaatcatactagtggtaccatgagaagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaaggttatatgctctttaaatgaatatttgtgaatttcttcatttaaattttaatttaaaattggatttattgcgtcagccgaggggaggggcgcgcggaccgggtccacaggagtggggcccacgcggcagcctcacggtccacggtggaccgggtgcacccggctcacaccggccggcgccgtgggtcccatgcgtcagccgcatccgagggcgcgggcggctaacggccgggccccacatggcagccgcgggacgcgcccgaaggcggccacgccggcacagccgacgggaggtggcgcactcgtgccccgatggtcgccgccggcgaccaccggcgcggcggagcggcgcccgagagaggggagggaagggggaaacgaatcggcggtccacggctcaccccgggtcgacggcgacgacgggtacgacgaccggagcggagagaggcggcggcgcggctcgggtcgacgggcacggcggcgttccggcagtcggcgaccgaaacggagaggtggacgaggtcggcgaggttgcggcgaacccgaagaaggcgacgccgaagcgggagaaggtccggggcgacgacggcggcggaccggagctcggcggtgacggcggagagagagagcgacggcgcgagcttgattccggcggagagagagagcggcgagtggcggaaacggcggagggaggcacggggagtgtttatatagggttgggagggggagagagcggccggatgagggggaaacgggcgcggaagatccggccgccattgatgcgtcggcgaggttagggggaaagtttccgaacgaatccgagggagagagggagggaaaaatgggggggaaagagggagggaatcacggggaatatttcccccctcttgattgcacgcgggacggacgggagcggcgggattcgcggcggcggcggcgctagggcacgggcgaggcggcgggagcggcgggaggaaggggatgacgggtgggccccacccgtcagcgagggtggcgggcgggcccgcccgtcagcggcgcgcgcgcggggaggaggccgaatgggccgcggggaagaggggagagagggaaagggatgggccgagccggcccaagagggagagggggagggaaagggatctttttagggtttttctttttataaaaccattttaactttgtttatttcttcttaaatattatttgtgctctgaaaattccactaaaatttatttacgcattttaggcttttaggaaatataaaaaaaatcctccaagccttatttgacttttaactttgcacattttaattgttggaggctttcacaaggattttaattattctaggcataatttcaaggatgtattttagagtcgttttgggacgcgacaaaaatgattttagcctctaaatctagatgctaagatcttgtttttgcttttaaagtgtgtttatgtcaaaatgtatctgaaaaggtttttgcaaataatccttttgacaagccactagagttggtcatttcaaatctttttggtatttatatctattttatatgataaatgatttgaaattatttgatctcaaaattcacatgaaaatttatattgaccatatttggtcctattatagcatcgagtgagtttagccactagaaccatatattgtgatttatattggttcatggacgtatttcaaactcataaaaatcaaattgtctccaaaacatctcattttgctcaaaattgcatttgggtcattttgttggaacttcaactttttatctttcttcgagcaaggaattaaacatgaatcctttaaaagtgattttattgatgctaggtcaattgtgaacgaacatatggtgatcctcaaacaaatccctcacacgagcaccatggattttgatggttttccaaaaactcggtttttacctttggttttccaagttctttaaatttggtgatgaaatattaaatattttggttatttcttgtttcatctgatttcccatgttgttgtgagctcgtggttcaaatttcgtgaaattccgagtttgtttgggtgattttgagcaaaatcttgaaagttctcgcgtgctgattttgtctgctaggaagttccagacaaagtacaaggaacttccggtcaggactctctgtggagacaaagagggccgataggaacttccggacaaattggtaggaagttccggtccaacttgcctcaaaacattgttttaaaatattggtttaaccttaaagtttgttttggcccaaaaacgtttagctcaagcttccaaaatttaaaagttcaaaagtttagatgacatgttttctaaaagggtctcttttggtaaaaattcaaaattcttatttgacggtccaaaatttgtgaaaaatgtttcaaagggcttcatcttttatttcaaatgttctaaaaagcttttggagtgaaatttttgtttttggaacaaaatgtcatttatccaacatgttgttttgatcatatttggtctatatttgcatatggtgggtttaagcaatttgattaatgttctttgtgaacattggctcaatttggtatttctaacccatcttaagtctttccaaatgtcaaacttcataaaaaatcttttggttgaaattcattgttttaaaagtcattctctttatcgaaaactcatttagtgaaattaattttggagaagtttctctcaagttcaaagatcttttttgcaagcttgaattatttcagactttttctctcttttctcaacttgtagaaattttcagtaaaacttgactttgagctaatttgtgatctttatatctcaaaatgggttgtgttgttgtgatttggaaagagcttacattgtgactttcgattctctatagttggacttcactgccaaattttgtctaaattatcaaag

SEQ ID NO: 37895 - DNA, 5439 bp, Oryza sativa
  unsure (1)..(5439): unsure at all n locations
aactaactatttccatgagttggtgagattaggttaagttccgccatcaagttaaaagattgaagttagaagatggacattataccttgatgaggagcaagtgaagacattgatgatgcggggtatgaaatggctatctatggcaaaccggtgaagaaaaagaaaggctcggctagaagatggacattataccttaatgaggaataagtgaagacattgatgatgcggagtatgaagtggctatttatggcaaaacggtgaagggcaagcaaggctcggctacaatggaccatgcgtggggtgaagggcaagcaagaggcttggcaccgattcaccgaatccggtggtgaaggacgagtgaaggctttgtcatgatggtcatgatggactgtgcgaggccatttgaagctatgagtaatccgtatcaattagaccgcaagatggaatgccgaggatcaagaggatgtggttcttcgatgaacatcaagtcaaaatccaaagtgggcattgatcaaggcaaaggtataattgatttgggactaatatgcttaagtgtaggtgagaatagtcccaatagtgaaatggcgttgacgttgacaaccctcaaggtgaagcaagaagataacattcttagtggtgtattagtcccaggttgcttaggagtgggctaggatgcttggagaccccccaaaacaaagcggcaagaagacttggagccgagttagactagtttactttttcgctttgagtttaggaaaaaccgtactattaagaggggttccaagtgtggttctgagataacacaagtgctcttagtggtgtccaagtgttgaaatatttttaggagctgtttttgaaaatggctctactcgggacagagagtcccacccggaggttctgtccggaacttcctggcaccgaggtgaggttgaaaaatttcataagtgctgcccggatgttcctggcacttttacccggaacctcctggcaggtttccagttcaaacttgtgagtaacggctagatgacgtcacctagccgttatatatatggatctcgtccccaggtcaccctttggccattccactttagttcttgtgttccctagcttgttctagcctctcccaatgtgattttgcttcctccacccaaatcttgtgtacttcttgagtgagagagtgattttgagggtggtggtgaggattggagaaggttttgaacgctaggatgacttgagcacttggggtatctcgttgggctattatttgaagcttgttactcttggagggtgacctcctagatggttaggtgtcgcccgcgagtttccaacaaggttgtgaattgacccgggcaaatttgtgagggcgttattccacctccaaaaggaaacggaaaactcggtgagtggaatccgaggtgaggtttaggatgtcatcttggtagagcaagcctcacttgtggtgttcttttggcgttgaattacgggactttagcgctcactacaaaccaaaaagaaggccctgggggtgtcggctannncccacatacctattcctaggccgtttccttgatgaggcaaggggttaatcaagaccccgctctttggagctactggtcggggacctaagaatatagacggatactactaactctggaaaacatatattttgtctcctctcactctctttatctttgtgattgtgatgcttatctccttatttgcctagttgtgctatcatgtctcccattgtatgatcacttgtgctatcttgtgtattttcatgtgtattactcttgtttgagacatgttgtacctctctatggtttaggcttccttgtgataagtacgataagtccaaccattgcccatgctggcttgtggtaagtacgataagttcttctagggcataccgcgaaccggtccttaattgccatgggtgcgactagcaaaaccatgcacccacagcccaccattcagtcgcattttagttggataattacgaccatgaagcatggctagatgtctcgagcacgcagctcattctgatactaaaaaggtctaatactgtaattatcccatcaactgagctagtggtaattaagcatggctaagcatataattctagctaggtcacataagtaacatgagctagtcgatttattacccagggttgacaaaggacagatatcaagtaaacatggcacaagcaagcagataggtaatacccggatcccatgtaattagcaagacatgtatgtttatttgcaaatggtcaaacatttataaattgggatcaacatgctcaaggggaatgtgtgacttgccttgcttcttcaaaacaatcttccgaactcttttcctcgcgaccgtggacttccgaaacgacggattctacacgctagcacgcaaaacgaggaaaaactctaataaaaaccaaggaaacagtacataaaaagtaaacaaacatgtagatctcaattttagatgaattttgcaagttgaatggcccaattcggagttcgaatgaattagatatgaattttagaagttttgagccatttaaatgaatttctagaactaaatacaatttattgtgcaattattatttatttttacaaaggaaaaggggactgctgccgtcagcaaggggtgaggcgcggaccgcgtccacgaaggggcgggccccatacgtcagcgacacaaggggtaccggcccaccgtggaccgagtccacggtggcgaccggccactcggccgcgcacccaatggcccggatcggccgagaccgctcggacggccgagtggcacggccaggcaggaatgcacacaggcggcagcgaccgccaagcccagaccaccggcgacgacgccagcgacgagcggcgacggcatgagaggcggcgaaagagaggatggggaggggatgctcaccaagcggcacggcaccggagagaggcgagatggtgacggcgctcctcgggcttgcggtggaggggttaactggcgccgattttcatggggagagtgggggaaatgggtgcggggtggatgtggtctttcggtagtggattggggaagatgagcgatggacggggtgtgacaacgcgcggcgaggccggcggcgcaaacggcgcggcacggggacggcggcagcggcggcagcggccgactggagggtcgccggcgagcggcagcgcttgggctcgtgtgaggagagcgggagagagcgcagggagctcgggaaaaatgaggaaatgggagaggaggactcggggatcatttttatagcgcggggagctcgagatcgaggacgggaggggcggatttgaaggaggaatgggtgccggcgacgtgggcgaggtggagctcgaattggcacaaaaatttggggaaaaatgggggagaggatggaggagtgggcggcaaccacgtccgcacggtcggacgtgcgcgcgggaggcaggaggtggcagttttagcggtgacgtggggcgacccgggtttccatgcggttgccggcggagaggctggaggaagggggaggagctgacaggtggggcctcaggtccacctgtcggtgagggaaggagagaggaggccgggaaggggttatgcagacttagggggagacggggggccgagctgggccggcccacgagaaggaagggggaaatgagggagggcgagcggaccaaggggaggaggagggggattgggccagggcggttcaaaaacaaagagggggaatttttattgcttttatttttattttaattgatgatatgaactttgtgactttaaaattaactattgagcttcgaaaattcgcgggaaatttcagagagtatttagggcacaaagaatattacaaaatattctcggccaatgatttttaagggaaaattttaatttcccccataatttcacttgattaaattgctttaacttttatttaatttctagaaaatcgggggcgttacaaatctaccccccttacaggaatctcgtcccaagattttgggatggctagaaagaaagctggtgctggcgggctgtctgactgatctgctgacacatgctgcctctttctgattcaactgactgattgctcgatgaaccaaacctgcataagcttgctgttctgttgcttcccatacactgaatagaccgactccgattagtctgaccttgaccaaaattgctagtgctcatagaatttcttttctttggactgaaccactagcattgtctcccttagtaacctgtgagctcaccaagcatactagaaacttgcaaagctttcatgaaaccttgtatgtggacttgcatgaatgacagattctgactttattttaacctacttctgacgggaaccacaggtatcctaagaggctgcttgattggtctttcggctgaactgcaactgttcttggcactgcttgcctaagctgaacagttgacttggcctcacgggtttaccctggaatccaatcagataacctgagaccggtgtaattctgttgacgccctataattggcttcttcaaatattacccaaatggctgcactgagttgaacctccaaatgaaacgacgacgaggtgagccaacactcatctctgagacctaccccccttacagagagtagtcttactttcgcctgactgggatcaattgaactgttgtctttgaaatgtaaccaacacttttccgatttacaaagagccctggctttgaaaactgaaaacttcatcgatcaatcaaaatagagcaatgacgatgcactttcattctagcaagacttggaacttaacccttagctgaggataggaaagtccacataaaagagactctcacttagctcatgaacatattgactcttgactaactttcccatcagttctaactgctggcttgattgtcctgcttctggcctgacttcggtgtcgagttgcatagttgatttctgaaaactaacctgaccgactctgcattggaactgatgtaacttgaggagctcgagatcgaggccgggaggggcggatctgatggaggaatgggtgccggcgatgtgggcgaggtggagctcgaatcggagcgaaaatttggggaaaaatgggggagagggtggaggagtgggcggcgaccacgtccgcacggtcggatgtgcgcgcgggaggcaggaggcggcagttttagcggcgacgtggggcgacccgggttgccatggcggttgccggcggagtggctggaggaagggggaggagctgacaggtggggcctcgggtccacctgtcggtgagggaaggagagaggaggccaggaaggggttatgcagacttagggggagagggggggccgagctgggccggcccacgagaaggaagggggaaaggagggagggcgagcgggccaaggggcggaggagggggattgggcc

SEQ ID NO: 37896 - DNA, 4675 bp, Oryza sativa
cagttagaacttgggacttgatagcagtgcgagtgacaaaatgcaagtcgaagggagatagctccgccgcccatttgctgagccgcccagtgacttccttgcctcggagtacttcgcccaaagggtattgtgatggcaccgtgactttgtgggcctggaagtagtgtttaagcttgcatgaagccatcaccagggcgtaagcaagcttctccatttcaatgtatcttatcttcactccttgcaaggcttcggagacgaaataaactggtttctggcctgactctgtctcttggacaagggcagcactgactaccactggcgaagctgccaggtatagtagcagttcgcttcctggcgccgggctgatcaaagcgagcagactttgcagatattgctttagcgcatcgaacgctgcttggcattcgggtgtccaggtgaattttcccgtgccccggagggtcttgaagaagggcaaacctcattcggctgcctttgagaggaatcgattgagtgccgcaattcggcctgcgagcttttgtacttcacgtactgtcacgcccggaatttctatccaaaattccaaacgcttacatgtgtgtgaaccctcgtccaggaatcagccgaggcacacaataacaaattgataattgagtacaattattactctaattaataagcgaacaaaatgtcattacagaggtagatagttcctctcaatcaataaaaatctaagcagcggaaagataagataaacggcgcagacgactccactccacaggcagcttgaccagggctacaccaaatcctccacaccatcagcatcactgtagaacctttcctctgatgaatgattgaaaggtgagtatatgacatactcagcaagccacgcagcaaatatgcaagtgcacaggataacaaaggatggcatagtagggtttcatttgcataaacagcatttgataaacatttcagaatttaataaaacagttaagtaataattaaacaatattaatccaacgctatacaacataccctgttgtataggcccaaccattctgaacaaccatcccggctgtacagttctatctccaaaccaggaatataccattccaaaccaggagctaatcaaattattaccagttatagcatcttttattaaggtgagaagtgtgagactaatcatgaaagacattgttagacccgcccataaccgcgggcacggctattcgaatagttttactctggccagaggtgtaccactgtacccacaagacacagccccacatcatgtctccatgtgcctcaataccaccacggtacctcggaaaggagctgtgacaatacccctcgcacaacacaatccaccgcagcgcacctttcctggatcataatcacccccttataaacaaggcatggactccccagcgacccccgtgggcttatctccgccacttctcagtctggtgctccgcaatgaaccatgctataccaaaggtaaagccgttgcccacgctggcttgtggttggcacggttaatgtttcacaaccgaaactcgtgaaccggtccttaattgtcatgagcacgatctctcaaaaccatgtgctcacaacccaacattatcaggttttaattggcaaataattaattaaccaatcacgattgaccatcgtgaactatcagtaagccatcattaattaatagtgaatcataagttatcccaatagtgtgctaatgtttctaagcatggctaagcaatcacatctaatatctagctgaaccaatatatatagcccaactagtcgagttataaacacccaaggtatcaaggaataaagtaagcaagaacaaaggggctataacaaacaataggttaattccacccaatgacattcgaaaataaatgcaatagttgaatagaaacagtagctttaaacgggatcaacatgctcaaagggttgtttggaatctgtgtgacttgccttactggccttggaactcttcaaattcttctcctgcgaaaacggactctccggaaacgtcggaatctaagcaaaaaagagcaaaatcaccaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatgggttttaattgaattatgacgcaataatgaattatttttgaaaaggaaaaagggtttattgcgtcagcggctagggtttgcggtggaccgggtgcacggcagcggttcgcgggaacgaacggtcgggatcgatcctatccaaaacggacggctgagatcgaacggtccacgaccgggccacggcggacggtcccgatgacgtcagcggcgacgtcacctccggcggcggctcgggagcgcaagctcgccggcgaacgacggcgctacggcataaacggagggcaccaggacgtagagcgcgacgcggcgaactcaccgatgaccaaaacgacggcggaagatgaacagacggcggcggcgtcgaggaaaaggcggcggggtccttcggcttgacgacgacggcgatgctccggcggtctacagcgacggcgaaggggcggacgaggacggcgacgcgatgacgaccacgatggcggtctccccgagcgacggcgacgactggaacgacggcgaagcacggctggagcgacggcgacgacaacggcacaaggtctcacggcgctagggcgcttccgacggcgagagacgaaggcaagggtggcgacgggtagcggcggacttggggatccttttataggggcaaggaggcggtggcgaaggcccacggcgaccagcgacaagaaggaaaggttagggttcggaggagagagaccgatccgaatcgacctcgaatccatggatttccaaacgaaattagccgatgattccaaaagagaaaaggtggaggagatcccagagatcatttcccctctattgatttcaccggagaaggaaaaggcgcggccgaacttggaaggagacggcggcggcgcggcgctagggttcgggcggtggtggcggcgcgaggaagacgaagattgacaggtgggacccacctgtcagcgacagcgagcgcgcgcgcgcggacggctgcggactgggccgacttgggccgggggaaagagagaggaggttttgggccgactttcggctcaaagctaaaagagacttttaaaaacctttttcaatttaaattattcatgaaatgcaattccatttattaaaaatacttccttagctcaaataaatcgcagaaaaatctaggaattatagaattaaacaaagtatttaatgaaattttatctggccccattttatattggaatttgttaattaaaattaaattttctcttctagccttttaaaaataattccaattaaacaacaatttatatatttaggatttgtagggtgtgacaaacctaccccccttaaacagaatctcgtcctcgagattcggaagaactggcgaacagatgcggatgagctgacttcaattcatcttctcgttcccaagttgattcttcttccgagtgattactccattggactttgtaaaaacggataactcgatttctggttcttctctcttctatttccaagatacggattggtttctgaacataggtcagatcctcttggacttctatctgttcaagattagcttcttcggtaggtacccttaaacactttttcaattgcgacacatggaacacattatgaactcctgccaaagattgaggtaactccaactgataagcaacctctcctcttctattgacaatcttataaggtcccacaaaatgcggtaccaattttcctttggtgtgaaaacgatgaactcctcgaagaggcgtgacacgaagatacacataatctccttcgtcaaaacttagatctctacgacgattgtcggcataactcttatgacgagactgggccacacgcaacctttcttgaatgattttcaccttctcttctgcttcccttaggatgtccgtcccgaaaacctgacgttctcctgtttgatcccacaaaagcggagtgcggcacttccgaccatacagtgcttcgtaaggagccatctgaagactagcttgataactgttgttgtacgaaaattctgcataaggtagattcctatcccaacttccaccgaagtctaaagcacaagctctcaacatatcttccaaaatctgattcaccctttcggtttgtccgtctgtctacggatgataagcagtactaaagttcagcttagaacccatctcttcctgaagcttcttccaaaaatttgaagtaaactgactgcctcgatcagacactattttcttagggacgccatgcaaacacacaatccttgccatatacaattccgccaaccaacttccggaataggttgtctttactgggatgaaatgagccactttggtaagtctgtcgactaccacccaaatagagtcatggcctgatgacgttctgggtagaccagtgatgaaatccataccgatttcctcccatttccattcaggaatcttcaaaggctgcagcaaaccggcgggtttctg

SEQ ID NO: 37897 - DNA, 8046 bp, Oryza sativa
acgagtggaacgacggcgaagcacggctggagcgacggcgacgacaacggcacaaggtctcacggcgctagggcgcttccgacggcgagagacgaaggcaagggtggccacgggtagcggcggacttggggatccttttataggggcaagaaggcggtggcgaaggcccatggcgaccggcgacgagaaggaaaggttagggttcggaggagagagaccgatccgaatcgacctcgaatccacggatttccaaacgaaattagccgatgattccaaaagagaaaaggtggaggagatcccggagatcatttcccctctattgatttcaccggagaaggaaaaggcgcggccgaacttggaaggagacggcggcggcgcggcgctagggttcgggcggtggtggcggcgcgaggaagacgaagattgacaggtgggacccacctgtcagcgacagcgagcgcgcgcgcgcggacggctgcggactgggccgacttgggccgggggaaagagagaggaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaaacaaagtatttaatgaaattttatctggccccattttatattggaatttattaattaaaattaaatcttctcttctagccttttaaaaataattccaattaaacaacaatttatatatttaggatttttagggtgtgacacgtacgctcgacgggggattcatttgctgaatggcatcgattttctcggggttcgcctcaatgcccctttcagaaacaaggaaacccaacaacttgccgcgcgaacaccaaaaacacacttatcaggatttagtgtcatacccgccgcgcgtaagttgtcgaaggtctcctacaggtcggacacatggtcgaaagccttgcggctttttacaacgatatcgtcgacataaccctctacatttcaccccaactgcttgtaaaggaccttgtacacctgcctggcgaaggttgccccggcattcctcaggccgaaaggcatcctgaggtggcaaaaggtgccgaatggtgtgatgaaggatgtcttggggatgtcggccgggttcatgtggatctggtggtaaccggagtacgcatccaagaagctcatgagttcgtagccagctgtcgaatccacgagttggtcgatccgtggcaaggggaaatcatccttcggccatgccttgtttaggtttgtgaaatcgacgcacatgcgatatttgtcgtttgatttccgcaccagcaccggattcgccagccactcggggtggtcgatctcttgaatgaccctagccttgagcaatttttggacttcggcttttgctgcttcttggagatcaacggacatcttgcgtagcttctgtttccttggcttggcatccggcatgactgccaggtgatgcatgatgagatctgtcgaaacacttcccacctcatcagggccccaggcgaagttatcaatgtttttcttgagcacctctaggatgttctcaacctcttcttcgcccatgtcgccccccagcgatacaagctttgtgggatcggtatcatcaatctgtatcttgattaccttgccgtgaggggcgggctttggcgcgtgcttcgccggatcatgtggttcggcctcaacattatgcacagctctgttgattatggccaaatcgccctttgaagcggccgaaggctggagccccttgaccacgatcactcctaccgggccaggcatcttgagcttgagataattgtggtgggaaatggcttcgaacttattgaaggtcgcacagccgaagatggcattgtagttgtacgggatgtcgacaacgtcaaacattattttctcttcgcgtctgtttttgcctgtgccgaaagctaccagcaattgcgcttggcctagaacttggactgactcaccgccgaaaccacggagcgatgccgatgcttgggtaagggctagggtcggtaatcccatcttggcatatgctccagcgaagatgacatcggccgaactccctccgtcgactaagattcgttggacctcgaagccagctatctcggccgagatcaccagagggtcttgatgcgggaacattactccttcggcatcttccggcccgaaagagatttgctggttcagatattgtggggccccttcgcccgccgaagtgatgttgtggaccatttgatgctgcatcttcttttgtcatttcgacagctgattcggcgggtcggcccttgtaatcacttggattactcgacgctgcacatcttggcgctgttcggccgggggtgcttgttcttgaacgtcttcgcgaggtgcttcgacagctgctccctgctgcggccttggatcttgcacgttgccacgctgccgaatgtttcagcattgctccgtggtgtgcaaagagcgtccgtggaaggcgtagtaaaggtctttttggaccttcttgcgaacgggctgctgatggttgcttgcttgctgggaatcgaactccttgcggagggcttgaacttcttcgacagccatcacagccttgcccgcacggtcggttctgaacttcctccaagttatgggagcttggccttgccttggcggttatccttggttcgccggctgaggctggcgaacagcgagaggaggtggttcggcgacctgagcttgtacttgggctttggcagcggcgatggaggctttatcatactcagcttgaattgcttgccatcgcttggaatcctcttcgccccatgcgtacacgtcaatgatgcgaagcaggtgttcaagcgtctgcggctctttgttggcgattttttttgtgagttcgccctcgagtatcccggccgaagcggcattgatgacagacgcctcggttatgtcttgtacttgacaccgggcttgcaagaagcgacgcatgtactcccttatcgattctcccgacctctggcgaatgccgagtagatgttgctgcgtcttcggctcctcgtaggtgactcgaaagttaaggacaaagacatcgcgcaattgctcccatgagtagatgctattagctgctaaattgaggtaccaagaacgggcgatgctgtttagagcaagatgtattacctttgccttggtattttcgtcgccatgagccgcttcgatcgcagactcatagatagagaggaattcctttgggtcaatttcgcctgaatagcgtgggacgggtgggaacttgaactggggtgggattggacgggtcttgattcccccactcagcagtagccccttttcgccccctgccctgttcacggcaccttgctacggatacggtgtggcgaaaggcgaagtcacggcctgcgcgtgaggttgggccacggtgttcggctgcccagctccgattggtgatgcttggtgagctgccatggatgggtcgaatgttggctggggccatgccatggcggactggtttggtgcttggtttgccacgaagcctagtgttggtgcttgcggcggaacggttggtgcctgagcaatattgttgaagtcgaactacggtccttgactccaaggcaaagcccccagacccggctgattcgacgacaaccaactaggcgcaccatgacctgtactcccctccggctgggccgaaggggctatacctgaaatgctgtggggttggctaaattgttgaatgaaagcttgaagctgcgcttgcagagccgaagccccttctgccatcgcttgtgacacttggccaggcggttgagagtgtgcttgggtagtgaccggctgagcttgcagttgcacgtgagggcccggatgtactgctgcggtcgaaggctgcccagcgaagtatactagcgcttgcgtggcttgtggtggaaggggttggatcggtgcttgtggatagacttggggtgggatgtagcctgccgaatactggaggattggggccgaagcggccttggcccgcctcgctgcctcgtacgcctgctgctgttcttgcatctgccgaagcatgtcttggagtcatgtcatgttctgtcgcatggcttccatgtcggcttcggcttgtgtttcgggatcagggttgacttgtacagcggtgagcgcagtcgaggccgctgccagctgcgacggagcggcttggggcaccagcagtttgcttgtcgaaaggatctccgccctggtttggagtgcccttgccgccgctgccgccttcgctgcttcagccgtgttcggcacctgccccaacgaggcggcaggagccgaagacggtagtagcggcgctggtgccgaagccggtggcgctccgccatcttcggcgatgggcgccgaaggctctgctcccttttcggcggccatcccccctccggcttcgctttcctttcgccttgtaaccttctccttcacgactctcttcggtggcattcgctctcagtggtttcgcttggaggtctccacggtcggcgccagctgttttcgaaacgacaactgcatacgtcgaaagacgtggttactcaacagtggttggaaagaaagtaaagtgtattgaatggagaatttttcttgggatccccctattacatgaccctaggagaatatttatagcctcattacaagttcttgctactggggtttaggttatacaggggaatttacatggctgcccttatgaaagggacatttatgtgggtatacagtgtaattgaggtacatgggctcctaatggtccgtcaggcgatcgttggcccaaaggccactgggccttcgtgaggccgaacttgctatggcgaagtcgtctcccttcgacatacactcttcgccttacatccttcgcctaagaggtctttggctctacgaggcacccgcacgattctccgcccttcgccgtctttgctccatagtcttcgccatgggggcttcgccccaaccgatcttgacgtcttaggcttgaatccttactggtcgcatggtttcggcaggtttggtcgaagggcctcatgccatactgccaacaagtaccatgtttgtcttgatgaaatcctcagcatttctacctagcttcctaaatgtagcataaggcatcaaatttaacgcagccccaccatcgaccatcatcttagaaatcggcttcccattgacatagccgttcacatataatcccttaagatgccgattctctatcccttctggcttctcaaagactgcttgttctggtaataaaatcaatttagccgatttttcttcaactttatcaacatcggcttgtttgactccaaattcagcgggcaacgtgaaaaccatgttaaccgatgcagtcaccacactttttcctttagccaatctttttgcttcatcggctgtggcttcatcggctgcaggaacttgaatcttaacacgccactcctgctttggcttcgtcttctttagctgatgattgatttcttgctcaacttcctgaatgtcacgcccataaattcactagtaatttccgaactaatttgtgcataaaaccctcgtccaggaatcagccgaggtacacaaactgacaatttaatatacagattcatcaataatacaatgttacatacttaaaaaagaaaagaaaactgcagcggaattacggtctagcgaagctccggctccactccctcaggcagctcaactggggtataagccaaatgtcttctctatctggattctttttcttccactgaggtttgattgattattacaatgtgagcatatgacatactcaacaagtcacacagcaaatatgcaagtgcacaaggataccaagaatggcataatatagggctcatttgcaaaagcagcatttagcaaacattttagaattataaaacagtagagtaattaatcatcaattttaatcaacactgaacagcacacccatgctgctcaggcccaaccatcctgaacaaccatacccggctgtacagatctatctcaatccaggaatgtaccattctaaaccaggagctaatcaaattattaccagttatagcatcatttattatggtgagaagtgtgagactaatcacaaaagacattgttagacccgcccataacctcgggcacggctattcgactagttttactctggccagaggtgtaccactgtacccacaagacacagccccacaacatgtcaccatgcgcctcaataccaccacgatacctcggaaaggagctgtgacagtacccctcgcataacacaatccaccacagcgcaccgttcctggatcataatcacccccttataaacaaggcatggactccccagcgacccccgtgggcttatctccgccacttctcagtctggtccccgcaatgaaccatgctatacaaaaggtaaagccgttgccacgctggcttgtggttggcacggttaatgtttcacaaccaaaactcgtgaaccgatccttaattgtcatgagcacgaccatcaaaaccatgtgctcacaacccaccattatcaagttttagtcggcaaattaattaactaaccaatcacgattgaccatcgtgagctaccattaaatatccatcattaagtaatagtgaacattagttatcccaatcgtgtgctaatgtttctaagcatggctaagcaattatgtctaacatctagctgaaacaatatatagagctcaactagtcaaattgtaacccgaggtaatcaagaaatagggtaatcaatgcaaattggccataacaaaggaataggttcacaccacccggtgacattcgaatttaaatataggaccaacatgctcaaaggaattgtgtttgggatctgtgtgacttaccttgcaataatcggtcttcaattaatcttcttgaacacttccggcgcactcgcgaaccttcgaaacgacagaaactacatgctaacacgcaaaacgaggaaaaagactaagaaactccaaataaacagtacatataaagtaaacaaacatgtagatcatgattttagatttattatgagacttgaacggcctcattccgatttcatatgaattagttacgaattttacaagatttaattccaattaaacctattaaagaaaaagactattccacattaattaaacaatttacaaatgatttataactaagataaaagattggaaacaacctccgaaaaagattagattatatttggtagatgatatatattaaaaagaaataatatgccactaaaaagagggaacggatatatattggttttggacggctgagattaatcttgcaagcgaagctcaagagatactgactcaacgagtcaattctacgtgacatgggatcactcaaatgatcaaccgaaaccggcgaacggaaccggcggctctgaacggctctaaactaaaggacgacttaacatggacgaacgaacgaagcacggggaacacctcattaaaacgaacgagcgaacgactcaacaacggctgtgactaaaccggtgagctatacacgattcacagtaaagccccggtacagcaaacaataggccggtaggaattaagggatgcatctacggctagacaacttggctaccgagcaacggctaaagcggcggctaggttaaagcggcacacagctgcgacatggcggcactagggcgacttggttcggctaggcggcggtgactcggcggagtcacgcagttagggttagggcgatggcacagcgacgacgacgcacagctacggcagagcacgacagcaaggcgcagcagcggcagcgactcaacgacgacttagcgagacggctaccgagcggtagcaatggctctactaagccaggaacgcggcagcggtggcaacgcaacaccagcagcggtggcaatgtggcttggctggcaacagcaaagcggccggcgcagcagcatgactgaggcagggagcgacactaaggctttgatagtg

SEQ ID NO: 37898 - DNA, 1476 bp, Oryza sativa
tatgataactcgacgaattacataaaaaagattagagtgtcataaatatggaagcactaatcccgagaacgcaagccaccataacaagttttaccccttgttgaagatcgaaaccgatgcagctcaacccgaaagtaagaactcgtcgaaacaaaacgaaagtaaaaagggtggcaatgcaccgagattgtattgaacgtgtgttagtttgattacatggggctcgggtctatttatacccgagaattacaaaatatgtccatatcggacacgactcttatctctaacaaactctaagataccataagtctttgcggcagacttttgcccaaacatatctctaagaaaattacataaaatatcctaattaattgatacagttgccttctcaggactctatacatgcgtagcaattatcatgaagcacatcaacctaaaccgacaacatatgttgtgtcatattgtcggattcggctcaatcggctaacctcgtccgacttgaactctgccgatcttagtcgtagccgattcgaacttcagccgatcctcactctgtttccgggacgatttccatctcgaattccatctcggtttcttcttcatctccgatccttggattaccaaatttggtcgttaacagctgtgttgctgtgtttacttccgtttaaacttctaaaaatttcgtcacatcaaatgtttggatacatgtatggagtattaaatgtggacgaaaaaaaaccagttgcacattttgcatataaattgcgagactaatcttttgagcctaattacgccatgatttgataatgtggtgctatagtaaacatttgctaataacagattaattaggctaaatagattcgtctcacagtttacaggcagaatctgtaatttgttttgttctttgtctacatttaatacttcaaatgtgtgttcgtatacttaaatttttttaaaaggaactaaacatggccgcagtcgtcaggaacagttgcagttacagctgcacccaatctgaatcctcgcttgagctgcatattgcagctgttaagcggtcacagtgcactgatgtcgcgttctgtcccgagcagccacattgaagattcatcgccacgcacacgcctgttgttcccgactgaaaaccgcggagccaaatgaagctacacgtttttcgtcggaatttggcaggcgtggggcgaagcacagggcaagtgacgcattgggtgggggcatggccccacgcgacgcccctcacccgtgtgacggcggaagcggcagcatagggagaagaagagaagatggtatggcggtggcctagggcagagatgttggcggcggaggaagaggcggcgacagatctggcacctaacctcattgtcatcgtcgttccgtgctgcctcggagcgtagcagcgacaaatcagctgtgtcgccagaacacccgtcacgccgtctgtcgtggacgcaccaccgtgcc

SEQ ID NO: 37899 - DNA, 762 bp, Oryza sativa
tggatcccccttttttttcggcgtcaccttcttcgggttcgccgcaacctcgccgacctcgtccacctctccgtttcggtcgccgaccgccggaacgccgccgtccccgtcgacccgagccgcgccgccgcctctatccgctccggtcgccgttcccgtcgtcgccgtcgacccggggtgagccgtggatcgccgattcgtttcccccttccctcccctctctcgggcaccgctccgccgcgccggtggtcgccggcggcgaccatcggggcacgagtgcgccgcctcccgtcggctgtgccggcgtggccgccttcgggcgcgccccgcggctgccgcgtggggcccggccgtcagccgcccgcgccctcgggtgcggctgacgcgtgggacccacggcgccggtcggtgcgagcccgggtgcacccggtccaccgtggaccgtgaggctgccgcgtgggccccacccccgtggacccggtccgcgcgcccctcccctcggctgacgcaataaatccatttttaaattaaaatttaaatgaagaaattcgcaaatattcatttaaagagcatataaccttcaaatggccataacttggccatttgaactcggaattggaccgttcaagtctctaattcttccttaaaaagtcaagaacccatttttgtgctttgttcctgcttgctatatggagcttatcagagtaaaagccctgtctttcccttggtcgtgtagacgctgcagcttcggaggaccgctct

SEQ ID NO: 37900 - DNA, 1331 bp, Oryza sativa
gcgtggagcttgattgcggatgttgttgcccgcattgttgttgaagaactgacgctgcggacgaacaacagacgaagaacctccctgtcgcatggactggggtcctaaagtaagacgcggcctctgactatcccttgttgtgccttgaattgagcaatccggcgtttcttctgctccatgcggttgtacttgccctcctggcgaatagccttatccactaacttctggaaatcatgataatccccagtcatgagtgggtaagaaagctcatcattaagtccttccaagaacctctcatgtcgctcttcatcagtgcgcacatcttccggagcataacgagccagacgattgaattcgtgcagatactcagtaacagagcgagacccctgagtgagcgacctgaattccttcttcttgagagacaccactcccgatggtatatgcgtcttccggaaagcagcggtgaattcaagccaagtgataggttcagtagtagtcctgttcaggcggaagtgatcccaccattcagaggcaaggccatgcaactgatgtgatgcaaatgagaccttctcctgatcggtgcactgaagcaaatccaacttcttttctatggcatgcagccaatcgccagcttcaacaggattagtggtactagagaaagtaggcggcctcacatgaagaaattctgctaacttgttctgaggaggtgcatgattatttccctggttctgctggttctgaagttgctgcatcattatgttcataagctgtacctgttgagccaggacttgggcaagtgtgggattctctccattgttgttgttattgttgttgttggggccattcccgttgctgcgagtgagcaccatctggcatgggcaggatcacaagaagagaaaccgggaaaaactacttaggacagagaattaatttaacttttattgatcttaagtgagtttcattattacaaaactaaagactctcacaccactaaactcaccaactacctaacactcgaaagcaaacaaacgcatggacttacatcccaccactgatgtaaatcacatgcgagacacacacaaccaaacttaaaacaagcaaactaacacaacgatctaagacaactgtttgacaaggcattctagttcttccgggcatcggagttgattgaaggctcgttcggctcgtcttcatcatcttgagttgctccccactcgatcttggaatgggtgcgcttggattcttctccttcatcatcacttacgttgacgaccggaggattcgctagggctggggtaacttctttctccaccacacggacctttggcgcc

SEQ ID NO: 37901 - DNA, 3813 bp, Oryza sativa
  unsure (1)..(3813): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaatagatgtatccaaggcgggtagatcatcagccgacttatcagtcggtttagttttcttgaatttggcctttttctttggagctaagaccaaggtactcatggccgatgatctggttttccttttcttgcgtgcatcggctagttccctggttaggccgtgaagaagagttgaagtcttgggggcatggtagctgataacagggggagatagtccacctccattcggaattagaccttgagcatattcaatgtccttgccactattactttgatgaggaggggaggactctgttgtctgcaaaataggagaaaaagattagtcaagtaatgaatcggctaactgattatgcaatttagtaatgacaaagtttacctggggtatgacgtcagggaatagatctgtcatatacattgaagccgattgatgaaatagatgcagcttccattcaccccaccatctgtcaaagtttttgcttctaaatcctgccaactcaatattatcaatgctgcccagagggggtcttggtaggttaagtagccgatccatcattagagtggatgtgatttgtcctcggcattgaatcttgtcggcaaagaataagccgattgggagttggcccaatccaagttgtctggccgagctcattgggtgataaaactcgtaggagacttggatgtttctcccttggtgaatgccgacggggaggatgcataggctgattgtagctataagaacttctctggatttttggaatttttcatgattaatgtcttcaaatctaaagtccgatggaagttcaaggtctgctgagtcttcatagggaaaccagattcgtgcatctttcttaaaaccttcataggagctgcagaaccaattcttaagtagctcagccgatagcttcgctccagcatcggttggtgtggatgcatattctccatatgacatgcatctgcgatgggtgcgctcttctccatcgtctcctgcaatcggctctggcagtgggaattcagcttctgtcatagagggccgattgacaaccttcatgactatcaggactaaccaggtttgcagcagccaccatggtccgcctgctccaactattgagccgacggctattttagccgatgcgttgttcaatgtttggtacagatagccgagatggattttgcccaaaggaaattctttctttgattctaaggcttcagctacaaattgcctgttggttgtagggccacaactagatccatagaaggggaacttttctaaccacatgagcaagaaagctacatgttcccgaggggtaacagacccttggcccatatatgctgccacatagccagactagccacctatgcttttggtcttgaagtcaaattggttcttggtgttcatactcatagggttagccaatgaagttacatctaatccagtaatcatggtgatgtcgattaaagttggagtcatcggcccttggttgaataagaaagcattgatggtgttggaccaaaagtaggtggcggtagccatcagaggttcatccttagcagaattggctatggtgagagcaagcgcttggccgattccaatctcatcccagtgaactttcttactagacgatacgcgttggtaccaggtggtccagcttttatcaggtgtgggtttttcgagagatggccaagacttgaaggtattcttccagtgacccaggttagggttggctagtctaaaggggatccggttggtttcaccaatgatgaaatcagtggggtcgaggttgccgattgggccaagaaaatagtggattttgtgcgaaaggctgggaatcgcgactaggttgaagagatgctacaaatccaaaacaacagagaaaaagagagcaatgtaagataagagaaaatcgatctgctgctaagaaaggggatcaagccgacgggaacttacctcagcatactcggctgaaggcgcatcagatgggttggtgcaggacgacatcgctgcaggcggaaatctcgccgaagatgaagtcacctggaagtcgcttttgcgtcggaggaatcgctggagagagagaagacaaagtttcgcttgagcggtgaaaacggaagtcacggtgtgagatttctcgagggtgacgtttaatatttaaagcatggcagtaacggtcggaaaacggcaaagtgcgaacttactcggggtcgatttacagcaaatccgaaacattaccaaatattccggacttggggggcatgtgttaacaaccaaatttggtaatatcggcatcgggaaagaatattagatcgaagcaaagtcggaggcggagattgagttcagaaacagagcaggaatcggctggagtccagatcggctacgattaggatcggctgggtctgagtcggactaggtaagctgatacaaccgattccgataatgcaacttgatgtatgatattgggttgaattaaggcgcttcaagatgattgccgcacatggatagagtcttgagaagtcaattgtatctattaattaggatattttatgtaatttccttagagatatgcttgggcaaaagtctgccgtaaagacttatggtatcttagagtttgttaaagatattagtcgtgtccgttatgggcatatcttgtaattctcgggtataaatagacccgagccctatgtaacttttaacacacacgttcaatacaatttcggcgcatcgccaccctttttgctttagttttatttcgacgagttcttgctttcgggttgagctgcatcggtttcgatcttcaacaagaggtaaaacttgttatgacgacttgtgttctcgggattagtgcttccatgtttgtgatactctgatctcgtttatgtaattcgtcgaactatcatatatcttacataatctctggcaataccactatctaatctacaatcggctaacatctatcggtagaggacagccgattaggttagatttcgatattgacttagattatataagatatctaccactctatgaaacttccagcagcttgattgtctagatattgttcttcttttcatacttaatgttgtatcagttgagtttgatctattaagtcatgcttagaaaatcaacctctagcctgccttctggttgccgattagggtagcatcggagtttcagccgatcttatctgatttaactatatttactctatatgctttattgacatgttaaatctggcatttattttaagatcttattgcatttaagtatattaggccattgtttgatatattctacttgctttaatatcttagtatagagtggtatcggagtattagccgatacatgctagatctatatgatcggctctgctatgaacatatgtagtcccattattaatatatatttcgatttaagtgatttatactgtctcggcatggcgtccgatctatcccaatcacttgatttaagtatatatcgatacaaggagtatatattgtgaatacctacagccgatcgagtagatttagttccttcttgtttattcatgactgccgatcgatacatatatgac

SEQ ID NO: 37902 - DNA, 2703 bp, Oryza sativa
taagcagatctcccaggtcacgtgttttctgtcaacacaccagcccttgaggtttgctgccaacccgtagaagtcactcatcctctccaccccgccacctcgcgaggagcaacacatctagcatcctggctcagaggagctcgttagcaccatccccaccaacttccacaccgtgcacggccgaggaggatagctagagaaaggcaggtccctcgcaccgaccacggacaaggtgaggaagccccagatctaggaggagcgacggggaatggccaccaaacctgggtcgaaagctgctccgcaatatgccccccaacacactcgctaataagctcggtcagcgagttcgccgcacgcacctccctcgtactgccgccgtcgtccggcaacactctctccatgccggaggggcacaaaaaccgagccccaccatcgcaatcctagctagccgctcaatttccggcggctagctccggctgcgtacggttgggaatggggaggagggtggtggcggtagggcttgcatgtcgcccccaggttagttgctcgggtgtgatagggggcctctcctctctctccaactatttttttagtgaaagtgacatttcaagaacaagctcacttcttttgtgctagtgtaccttctactcactccgattcacaatgtaagtcattctatcattccccacatctattatctatctatctattatatactaaaagtccaagaaacttcctacaaacgctcctaagccaccatgtgtactcctacaaatactcctaaaccgctatatggcatcttaacaaaccggtaggtccaatatttttgtctattagaattttattaaaaaaataaccccacaaactcccctaccctctcctctccccatgggcccatccttcaactggacgtacaactcaagttcgtacgtccgtaggtacgtcttccctcccctcctatccaatctcttcttcttttttctttagttatacaaatttttaaacaataataaatcttaaataaccatattttttctatagttatttgcacgtagtctatcaacaattaaaaaatatatggtgttctttaacctatatgaaatatttaattttttatcacctcctaaactttgcataacacggaaaactgtcatataaaatagggaaaaattgataatgtagattacacaatcatatatcaattcacagaatatgcatgaacaaattaagttagatctattatataacaaacttttctaagccaccatgtggcatcctgcaagcgctacttactaagacaccacgtgtcactgtaataaattagagaaatttctaaaaattttaagaaaaaaccaaacatctagacattaattttcattaaattatgtggacccattatttaccaccattagatttgtctttaaaagaactccctaacccccaaaccggatccaaattgggactgtatgtagcgtacgttttcttaaggattcttaaggatagtacgtgcgtacgttagtaacgtacatccaccccttcatccctcaatttcttcatatttttgcacatatttcttcccctattatcatatactttattagttagaaaatatattttttgtgttaaacaattcaacaactataacatctaaatcatacaactaacttttaatccgcttatatcttaaaattatttatgactgcatctacaggcaaagaccaaaattccacaataattcaactttgaggaaaaaaatgacactttggattatatttccagacttttgcgtaccgttcaagcaattacaataaatatgaaataatattattatagactctatcattgtgcataacttcataagaattaaattatatctacaatcataaaatctaaaaaaatagctatgagtaatgttcccaaaatatataagttagaaagcaagagttatacgaaaaaaataagcagctataacatctcaatcatgagatcccctatatcatacgagtaatatttttgcttatgtattttgattattttacatttaaagacccatatttggggttatattatctgacttttatgtgccattcaaacaattataaaattgtgaatagtaatgatatatattttatcattgtatataagttcacaataattcaattagatatgtaatgacaaaaaggtaaaatgaacctaataacactaagtattgttccaaaaatttactcctcccattatgatattataataaagcaaaaataacagtagtagatttgtaatgttcacattttcaatattgtatactatgtaggaaaagacgagtaaaaaagatagatcttaatcaatcaataaagcttttattttatttttagttaataaagtaataataagtaaaacacaataaatgtaaaaaaataattatatgtacacatactttgtcccattcgactttctcttcttctcctatctcactcaactcctctatcttataatttttaactaattaacaaaataataaaaaatgatcaataattacaaagctaaataattatgattcttatgtcataactgttttttagtttatttgaactgttattttttttataattaaataaataattgaagatgcatattactcatatttcactccataaaaatgaaaatactccatttaagcacacacacctatatatcctttgcatg

SEQ ID NO: 37903 - DNA, 1482 bp, Oryza sativa
cgaacatctagtttgactagacacttactatagcttcgtatactcgttgatcttctgcatttggcatgaagattgtgccatcatcatgtttctggtacctagccctggcccagttcctagcccgagggtgtgggatatcgccaaacacgagcggtgtgcacgattcctccgcttcttcatcctcacgctgccattcctcttccttaccggcatatccagtggtaccaagccggtgcggatgctggttcctggtctggagcaagcgatatgcctcgcttctagctctggactcgggggtcgacttcttcgcatggaattcctcccagacctgttctgtgatccaaggaaatttctctcttggatctggatttgccgggttgtagacgaactcgccgactagcttagttttgaagttcttccaagcagtgcccataaccttgaaagcagcccgcctgagacggtcctcatgctccgcaggataatcaaagctctccttgaacattagccaagcaatgtccttctctgcggccggcatgagcttgaagtcgtcttacagaatactgaatttctgcctccctatgaccccgcagatagacctaaatcggctcaatattttccttggagatgtcggcaaccctacggcgtccaccgctgttatgcggaaccgttccttaggaattttgttccctgtcctaggagtacgtgcccttgaggacccactagttgtcgtcgacattggttcgccttgctgagacattatctacttttttccaaaaaaacaaaaaaaaacataatttagtgctacaatttattacaatctattaaccacatttcacaataatttcattaatgcaccacatttcatcccaacataaataaaccacatttcatcccaacataaataaactacatttcatcccaacatgaataaaccacatttcatcccaacataaataaatctcatttcatcccaacataaataaatctcatttcatcccaacataaataaaccacatttcatcccaacttaaataaaccacatttcatcccaacatgaataaaccacatttcatcccaacatgaataaaccacatttcatcccaacatgaaccacattgcatataaataaagttaaatgaaccacatttcatcaattactacaatcatctatcacaaaattcataaatgcaccacatttcatcccaacatcgacatgtctcactcacagttcaatcacatatcatccacatccacatttcaatgacatgtcattcacagttagtagagggcgacgcgatggaggactcacctgaggatggccggtggggctcggcggcgcccgggctcggtggagggcggcgccggtcggtggagacgccgatcgggcaggtcggcaccgggcgggcggcgtcgtgctctatgggggtcggcgacgtgggtcggtgaggacgcgggcggcgacaacgagggggctgcaggaat

SEQ ID NO: 37904 - DNA, 430 bp, Oryza sativa
atcggttgggaggttgttggcgaagagcgcgaagtccatgatctgcaggccggggttggagctgctgtagaaggagaccgccatggccgccgtcgcgttgttgccgtcgccgccgccaccgttgtcgttgatctggaagtgcaggaggccctgcgggaacaccatgaggtcgcccttgcggagcgtgctggtgtacaccttgttggatgtagagctgatgaatccggcggacagggtcccctcaacgacgtagatgagctcggtgccgctcgggtgggagtgcagcggcacgatgccgccgggggagaagtcgacacgtgcggcggagatgtcgagcccgttcacgccgggaaacctggtttgcactttcgatttcggtcaaaaatttcggtaacattttgaattttacaaaattttagtacttttaact

SEQ ID NO: 37905 - DNA, 777 bp, Oryza sativa
caagaccacgtagttcccgcggcgcgagtcgacgttgttgatgtcgacgccgacgtgccggccgctcgggtcccacccgtccatgtgcgtgtcgaactcgacggcgacgaagctggcggcgcctgaggcgttgcccatggtggcgctcgccgtgttcctcgtcaagctctggtcgaagaggccgaggcatccctcgtagcactcctgcggcatgtcgggcatgaacggcgcgaggaagaacgtcatgccgtggccggcgagggcgttgcccctgccagccaccgaccggatggtgaagttgaagctcgcggcgaagctggcctcctcgccggtggcgccgtcccagagctgcaccggccgcttgtacagcgcgcgtcccctggcccgcgccgcgaactcctcaccgagcagctcgatccggccggcggtgaccatggcgtcgtcctcctgcctgaaatcttcggagacgaaggagtccgcgtcatagctgaaggtgagagaggtggcggggacggcaacgagcagcaagtggagcaagagtagtagtagctgctgctgctgcggcggccgcggcgttgctttgctgcttgaggaagacgaagggtttaggaggacagccatggaatggtgctaccgtacgtggttgcagtgcagttgcactgccacgatgacttgttcatacgccctaattagttaaccaggcatcttgacttactgccacgatgattttgatcgcagttagacagttctcagttgggtccacataattattaattt

SEQ ID NO: 37906 - DNA, 108 bp, Oryza sativa
caaaggtgtggaacggcaggatcaataaatttagaagctctggaagatggtgatatatggtcactatttaaagcatatgcatttagtactgatcaacatggtagtaat

SEQ ID NO: 37907 - DNA, 1520 bp, Oryza sativa
ttagtaggcttgcgcgtgtgttctttctcgtttgtcttcttgttgggttgtgtggggcatggttatgccggtgtgtggcataactgtgtcggagcctgcctttattttatttgcctaagcaacttgaactttaatgaaccaatttaatagcagtaataaattcaagaattatggtagtcgtgggtggttagctttaattgccagctctctctatttgctggttctgtgtggggttttcagatggtgacgaccaggagaagtgctaataccggtgatggcaaccaacctgaaggcagcaaccatcaccaccagggcagcccacctccacctcctcctccgcctccaccaccaccaccagacaccaacgccattctcacccaaatcctcgcccagcaggccaacatgatgactgctttcctccaccacctccaaaattcgccacaacataatactccaccaccacccccacaacactctaaactcgccgagttcctacgcatccgcccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcaacctattacttgggcccgtttcaccgccgctttccggagaacccatgtgcccgccggagtcgtggcccttaagaaaagggaattccgagagttaaagcaaggcaaccgctccgtgatggagtatttgcatgagttcaacaacctggcccgttatgccccggaggatgtgcgggaagatgaggagaagcaagagaagttcttggcaggaatggaccctgagctgtccgtccgtctagtctccggggactatccggatttccaacgtctggtggacaaaagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcatggtgcgcgtcccacagccgcagcagtagcagaatcaacaagggactcgtgcgccccgtcctcctacgccaactgtgcagcctggtcaaggccgcagggacgctcaaggtccgcagcgtctgtgcttcaactgcttcgagcccgggcactttgcggataagtgcccaaagccgaggcgtcagcaaggccaagcgcctccccgctccaacaacggtggtaaggatgtcattcggggtcgtgtgaaccatgtgacggccgaggacgtgctgacaactccagacgtcatcattggtatgttcctcattcattccatccctgctaccattctgttcgactctggagcttccactcgtttatatctgtgccattcgtgggg

SEQ ID NO: 37908 - DNA, 1396 bp, Oryza sativa
cgacccggacatgcatggactcctcaagaatatgaaacagggtaaagccgctggtttcacagaggatgaacacggaaccctatggaacggaaatcgggtatgcgttccagataacagagaacttaaacagctgatacttcaggaagctcacgaaagtccttaatccatccaccctggcagtacgaagatgtacttagacttgaaggagaaatactggtgggttagtatgaagcgggaaattgcagagttcgtggccctttgtgatgtgtgccagcgtgtcaagtcagagcaccaacgaccggccggactcctccaatctctccaagtacctgaatggaaatgggatgaaattgggatggatttcatcaccggacttccaaagacccaaggtggatatgattccatatgggtagtggtggatcgattaaccaaggtagctcgatttattcctatgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcataccacccgcagacagatgggtagaccgagcatctaaatcagatcctagaagatatgcttcgcgcatgtgtcctggatttcgggaagacctgggataagagtctcccctatgccgagttctcctacaataacagataccaagctagcatacaaatggcaccctatgaagcgttgtatggacgcaaatgccggacaccgctcttgtgggatcaagttggggaaagccaagtgttcgggactgatatcctgagagaagctgaagctaaagtcagaaccattcgggataatctaaaggtggcacagtcccggcagaaaagttatgcagataaccgtcgccgtgacctggaattcgcagtggacgattttgtataccttcgggtcacgccattgcggggtgtacacaggtttcggacaaaagggaagctcgcacctcggtatgtgggtccttttcgtatcgttgcccgacgcggagaagtcgcttaccagttggagctgcccgcctccttgggcaacgtgcatgatgtgttccatgtgtcgcaactcaagaaatgccttcgagtgccatccgagcaggccgacttagagcaaattgaagttcgcgaagacttgacctacgtggagaggccagtgaaaatcctggacaccatggagggcaggaccaggaaccgggtaatccgtttttgcaaggtccagtggagcaaccacgccgaagaggaagctacctgggagcgtgaagacgagctgaaggcagcccatcctgatctcttcgccagt

SEQ ID NO: 37909 - DNA, 619 bp, Oryza sativa
ctgaagttctctcttaccattaaaaatttcttctttcttctaaatgtgtgacgtaccgggagcaacctccggtgacccatgtataccatctttcgtgatttcttcagccaccggtttcgtggatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacactttctttccaaagaatctccagatcgtcgataacaggctccaggaatacatcgatatcattgccgggttgccttggaccttagattaacaagcacaacataatatatttctgtttaaagcataaccatagcgggaggttatagttcgcaataagaactggccaaatgctgtgagtactactcatgtcaccgaaaggattcatgccatccgtacaaagacatatcctcatgtttctagggtcggcagcaaagtctttgtgttctcgatctatattcctcattcaatcgaatccgctgggtgtctaagcataccatcacttccttctttccgtggcgtgccaacgtactaact

SEQ ID NO: 37910 - DNA, 4730 bp, Oryza sativa
aattcctgcagcccaaataataacaacgatgagaacccaaccatcacacaagtcttggctcaatagactcagctcatgaacatgatgatgtagcagatggataaccagtttgaccaaggtaacaacaatcctccgccccagaaaaagttagctgaatttctttgtgtgaggccacctacattctctagcactaccaaccttattgaagctagtgactagttgcatgctatcgagaagaagttgggactgctccagtgcacggatcaggagaaagtcatttttgcttcgcatcagttgcatggacctactttagaatgatgggatcacttccgaatgaacagagtagaagaacaaccaatcaacttgactgacttcactaaaggattcaagaagacatacatacctgcaggagttgttgctttgaagaagtgcgagtttaggacactaaaacaaaaggatcacactgtgagagagtattatcttcacgagtttagctgtctagcatgttatgctccaaaagatgtgcgtactgatgaagaaagatcggagaagttcttggagggactaaatgataagatgtcagttaagttgatttccgatgactatatatgcgttgatttccgatgactatatatgctgatcactggtggatagctgcaagaggggaatgttggtttcaaaggaagcacagggtagtagccagaggcaacgtatcaagccactccaaattgaggaatcaagttctacctctcaagaatagtcgcaatagttcaagaatggtggtgagatcaactcagagaataatgcgggcaatgaagtcagcaacgagcaaactcctcaatcaataccagcttagccaaattagcctcaagaagacaacggtaatggaaggaagcagttggtgtgtttcaactgttatgagtcaagtcactttgtaagagagtgttcgaagctgaagcatcagatgtcacaaggtcaagtcaacaacattgtcgtcataggagccaatgtcgtgccaattgcgtcttcaagtgataaaactcagccatcagttccaaagcagcagtagcttccttttggccttagaataattattagagtaatgaaataagatagaatgcagtttacatatgcccttttctttctagttgttccaaatctctggacgagattcctggtaagggggtaaatctgtcacaccttgattttcgttttaaggacatataaattattcctagaattttcattaaatttcattatttacaactgaagttaaatttgggaaataaaatttcctaagtaaaacatggtctgatttaatttttgttaaattctccttgatgaactatactctctaaaaatttttcggatttttatagctcagttactaattttaataatacaaacaacatttcagtaattatttaagttaaaaaggtaataaatcctcttcccagtcttggccgagttgggcccatttccttccatctctccccgtcggcccagctcgagccagcagcccctcctcatccctcggagcaagtccgttgtcctccctccttcaaccggcccaagaaagaaacaaaagtctacttcacgttccccatgctacactgacggccctaacctccagccggcctccctcccgtgcccgtgcgccacaccaccgccttgtccgctcgattcggcttcctcattgcctcctcttccaaatttatcgcgggaatggaatccctcaatctcttcttctttaattgtcacgtccgaactaatttacacatacaattctcgtcaaagaatcaaccgaggtacacaaatcaataatttaataaacaaattcatcaatataatatcgttaaatacttacaaaagaaaagaaaacagcaccggacagatgatctagagatggcttcagctacactcccataggcagcttaagtgaggtataagccaaatgttttttgcttcgctactttcttcaactgaggtttatttattattgcaagagtgagcacatgaaatactcagcaagccacacaaatatgcaagtgcacaggaataacaaaggatggcataataaagggttcatttgcaaaagtagtatttagcaaatatttgagagtagtaaaacattagagtaattaatcatcaatattaatcaacactgaagtacaccaatgctgcacaggcctaaccatctctgaacaactaaccccagttgcacagatctaaactccataacagtagctaacaaattataatcaccaattattattattaatgaatagtgcggtactaatcacaaaaaacattgctaggcccacccatgaccgtgggcgcagcaattcgaatagttttattttggccagaggtgtacaaatttacccacaaaacactaattctacacatgttgccatgccccgaaataccgccatggtattgcaaaggggaaaactttgacaagaccatttgcataacatgcccaaccgaatgacacccactaagcatctgtctccggtagggatggccagttccctaacagggagactacctaatgcccaaacagtggacttaattgtctatcacctatcacctgtggacttagttgtctgccacgataaaaacacaacataccgtggcatctgtcgttggtcatattatactacagatctaagtcgttgcctattcttgctcgtggttaatatggttaatgcttcacaacactagctcgtaaactagtccttagttgtcatgaggacgtccaacacactatgtgctcacaactcaccattagtaaaattttatttgtcaagttaataaaccaagcactaccaatcagcactaccaatcgtcacgagatatcactaattaatcatcattaatcatgagggaagcattaattattcccacataaatgacactaaagtgtctaagcatggcaaagcaaattatactaaatactccctccatctacttttgatagtcatacttcatcttgacacacagaccaaggataagtgattctacttatcatccatttaaatatgctactagtaattcctcgtaaacaagcgattcattaatatttacatttctcgatgctcatgcaaccaatctggtgtggaagaatgaagagtcatgcattaaatctaagaaagtcattaagatgataagttgttggattgaaatatgcctattaaaaataaaattttcagatttggaaatatgactatcaaaaatagatggagggagtatctagttggaccaatgtataaagtccaaactagtcaaagtataatctaggttaacaaggaataaggtaatcagtacaaattagctatacaaaggaatatgtgttcacaccacacaatgacattaaaaaaatgaacatttgaaataaatagagaatttaaatataagatcaacatgctcaaagggattgtatatgtttgggatctgtcttgcaataatcggtcttcaattaatcttctgaaactcttccaatgcactcataaacctccaaaacgacagaattaaatgacaagctaacaggcaaaacgagaaaaaagaataaaaaaactccaaataaatagtacataaaaagtaaacaaacatgtagagcatgattttataagaattataagacttgaacagcctcattccaacttcatatgaattagttatgaattttacaaggtttaatccaattaaacctattaaagaaaagattacttcaaattaattggatggcagagggggaaaatgatgacggcagagctcggtttgactaagttgacagagtatcaacggattagatcactcgaggatggatgaagggctgacatcgattgactggattttgactatatcggacggctcagattgaactcgatctagggtttagagatggcgccacatggtgacaccggattttgacctatattggatgggagcgacgtaatggcggtgacgtggacagccacacaggctcgatggccggtcggctctagacccacacgataatttgaaaaacaacataatgcatataatttgaaacgagataaatttgtaagttgggatcaacatgttcaaaacatgttcaagggtatatttgcctttacccatgggattttcacactgaacttcacctgcaatagcaacttcctcggcggcaacgtctacatgatcttaaaagggataaaaacaaataaacaaaaagaaaaggcagaaaaataacaacaaataaaataactaattaaatcggaagatagagctcaacttttgaagaattaacttaagaaaataaacaggtcaattcggagttcggatggaggagatataacaattggaagattgaattttgagataatttggatggaaaggtaaacgaagatttgtggactgtctctttagtaattctggaacaagatattatttttggagaactgatgagcatgatccacccatcagtgggatggtatgtgcctaataggtcttatcgggaaaaaatagtggatagaaaatttggaagacacagagcacgatatgtcactattagaaaattagttgttgctgacagtcaaaatagagtttcgctggtggccagaagtgtcaccagcgactaacggccagtgaaaataatgcattttcactagcggccggctggccagcgaaaattgagtttcgcaacccgacatgcttaattagacagccgctagcaaaaatggtgc

SEQ ID NO: 37911 - DNA, 5915 bp, Oryza sativa
cccgaggggcagagaggaggagaaccgcccccgccgccagatctgtgccaccgtgaccaaccatggtcgaggtcgcttcatccatcaccgagccgcaaccctagccaccggatccgtgccacagtgacccgccactggatccacgcccctccgacttgccgccaccgaatccacccccctccaacctgccgccgctggatccatgcccctccaacctgctgccactggatccacgtcccctcccctctggctagatctgggaaagggagaggagggtcgggtcaccatcaccgctcccaggagcgtggccgcccagtcgtcgaggccacgtgcgctggaccgcgtcgctgcctcccctacactctgccgctgagctccgccacgcgctgccgcctgccgttgagatatggggagccgagagaagttgcgagagataaagagggagacaagtcgtgagagagagagagagagtcgctgctgagatggatatggggagccgagaaaaaaaagaggaagttaaaatttcagttccgcacgcgctcccacattttttgctagcggaagttaaaaggaagataaagaactgagatggatttttgctagcggtggcttaggtgggccgccagcaaaaagggtgcatcttcattgacagtcctcttaacttggccgccaacgaagatccattttcgctaacagtgctaggtgaggaagaaaaagctgagaatggaatatggctgcagaggcagtggtgcaacgatgggtggtcaacgacaaggaggtggtgccaatggacggcctatggtctacggttgatgatggcgtcgactgaaatttcggaggtagcagcctatgctctccagatgatggcaaacagcgagagacagcaccagatggtggaggtgaagccggagggttggaagatggtagaggtagtaccaggaaaaaaatggtggtggtagtgccaacaacgacgtggtttgggaacagtgaagtggcggcggtttgacaacgaggcgttggcgaggataacagtggtggcatctccgatcctttggatagtataaagaacaatgatgcacacaaccactgggatggcgttggaagaaacagagtggtgggcctggttgatgaaggagctactgctatcggaagatggaaacttagaatgaacagggaatatttttagaatgttccactggaatttctgaaataaaagtattatttttgcatgagattaatataggaagaacaagggaccagcgggtaggggtgacatagtgacgatggcacaaccaccggtagtttgatggtgctaggaacaaaagaaaagaccgacttaaggaagacaacaacgtacggtcgctagatgagaagatggaattgactaagataatgtcacttagctatgacagtggcgttgatcaatgatgtagaagaaggaagatgggagtagactgatactcaccaacgatgcaaccgccatggacgacgtgtggggatgacaactgtagcccctggcagcaggacgacgtgcgtgcgcacgatgcgtcacggtataggcgcagaaatggagaggatgcggtggcactagtcagctgatgaagatggcggatggcataggcagccaaggggatgaaggcgaagcaacggactgagtcgtcggcacatccgctacatcgggacagagatgcaatggcagcttggatcaaggcggctctagcgatggggaagaagctgacgacatctcagcgtgcgttaataaaaagaaaagggcagcagcactaggaagagaagatagcaatagggtaatcaccggtggtagaaggaacttctggagttgaggtgtcaaggctgcgttgggtgctgatgctgacattgccaaggaggagaagatcgaagggagaggtagtagacttaaaagggggaatgttcgtttaagtgggccagaatgggccttgtaagcgtgagtggttattcgacccaagtgccagactgtaagcgtgtgtggggagtgagtgggagtgataaaactgaacacgcaactcctgtaaacctttttatcgatttagaacttggcggtggcgattggcggcggcagcggcggaattcgttggaaatccccgtcgatataccttgtgtgtctccagttctgaatcctagtttaggcagctatcaatttggtatcagagccctcagatcttcttggtttcttgaattcccttggtcgagccgtaaaattccatgagataggtggggatccgctgtttacagtgatattccgcaaaagccttttggggctcccttgatctggttggctagattcggggtaggaaccagcgatcatcctggagcgacctcggtataccactaagcaagcggctcaaatcatggctcaagatgggaaactcgatctcttgttgaagatgatggaggaggccgagaaggagcgggaggagatggataggaagcgcgaggagtcggaggccctgaatcttgtggagttgcagctgttgaagcttgcgatggagtcccgcatacccttggtggagaaacaggtgagcgagttggggggttctgcgaatgatttggcgaagagggtgaattccttgcaggcaagtgtggagaaatgtcagcgggaagttcagcagaacgcgctatacaaaggggaatccagccaaggaccaactcaattcccaaatgatgatgacctcaatggaaactcaccgaatcctttcctgttcacaccccaacaaggatggcgaaatcctccgcagttcaattctgtaagcccatttactcctgagaactcgggttgtccaatctttgattctggaatggctagtattggtggcaatgtcccttctatgtcttgccctcagtttgatggagaaaatccccagatgtggagagataactgtgaaatttattttgaggtctatggggtacatcctgctaattgggttaaggttgctctgctgaatttcactggaagtgcttcgttctggttgcaatctgttaggaatgagttggtagggatttcctggttggagttatgtgatagagtgtgccgtaagtttacaagggataggcaagaaattcttattagactgtggtttcatgtagcgcagacaggcagtgtgactgagtatgtggagagatttgatagtctcatgcatcagctgttggcgtatgacaatgcccttacaccaaggtacttcctaactaagtttgtggatggcttgaaggatgacattagaggggcagttatgcttcagagaccggtggaccttatggagcttgcttaatggcattgctacaggaagaaatattggaaggaagcagaaaaccaagttacaggaaatctgatggaaccaatttcaacaaggtgttttcccgacctactcagccaactgtttggccaaaaagtcctgctcagactactggagatgacaggaagctgattgagtcagggaagataaggtcttggctctgaaatcttacaggagggctgaagggttgtgttttacatgtggagaacgatggagtaaggaccacaaatgttcccaaactgtgcagttgcatgtggtagaggaattgttggaagcatttcaaggtgatatggaagaagaagttaatggacttgattcctcccagaaagactccttgatggcgcttttggctagtgcttgtaacggcacagattctactcattctttcagagtcaaggggttgatacaggggactaaattactgatgcttattgactctggcagttctcattccttcttagatgagaatattgttcagacaatgcaaggagttacatcccttccacaacctgttaaggttaaggttgctagtggtgaagttctgatttgtgacaaacaattaccggattatgcttggtggcttcaggggagatgttatagaaccaactttaaattgctttccctgcctgggtatgatgccatcctggggatagactggttacaagggctgggagtcatgagaataatttgggttcaaaagtggttggaatatgagatcaatggaagtccagttaggattcaaggggtgatgcccaaggttgatgcctgtcctctaatatctggagataaactcatgggcttgtgcaaaatgggagctcttatgcatctgtttcagattaccagtgaaaccgacatacataaacctgagattcccattatgatacaagaagtgatgaatgaattcaattcagtttttgaagaaccacaaggactgccacctaggaggcgttgtgaccattccattccattaattcctgggtctaagccggtcaaccttcggccctatggatacaatccagcccagaaggatgaaattgaacagcaagtacgagatatgttaaagtctggagttattcatcctagtgttagtccgtattcatctctggcattgctagttaataagaaagatggcacctggaggctttgtgtggatcatagactgcttaatgctatcaccatcaagagcaaataccccctgcctgttattgatgaacttttagatgaattggccggcacaggttggttttctaagttggatttgagggcgggatatcatcaaatcaggttggttgctggagaggaacctaagaccgcctttcaaactcattttgggcactttgagtatcgggtgatgtcctttgggttgacaggggcacttgcaaccttccaaggagctatgaatgaaaccttggcttcggtcttaaggaagtgcgccttggtgttctttgatgacatactgatttacagtccaaccttggaagctcatgctcaagatcttagaactgtcttgcaactcttgcaggatcatcagtggaaggtgaaattgagcaagtgctcttttgctctgaaggaactcaattatttagggcatactattggagtggctggagtttccactgaccctagcaaggtacaagatattgtcaattgggctattcctactaccttaaagaagttgaggggattcttgggaatagctgggtattatcacaaattcgtgaagaattttggtgtgattagtaaaccactcacaaacctgttaagaaaaggggttgagtttgtgtggactccggaggtgcatgagtccttcgagcaatttaagaaagctttggcttcagctcctgttcttgctcttccggattttactaaaccttctgtcattgagactgatgctagtgagatcggaattggtgcagttttgtcccaggataaacaccccattgcttatatgagtaaggcattgggtcctcgtactagggggttatccacttatgaaaaagaatgcttggcaatcctattggcaattgagcattggcggtcctaccttcagtatgcagagttcactatactcactgaccacaagagcttgatgaatcttactgatcagcgcttgcatactccttggcaacaaaaggcctatacaaagttgctagggctgcagttcaaaatttgttacaagaaaggaatccacaatgaagcagctgatgcccggtccagatgtgaccataactcttctttggaggtggttgctatttcggtttgtaagcccacttggctggaagaggttgttaatgggtatttgaaggatgccaaggctacttagttactgtctgaattagccattcactctaaggctgactctccataccaacttaaggatggtcttattcgatacagaggacgaatctggttgggacagaatattgagttgcaatagaaaatttttagtgccttgcatgacagtagcatcggtgggcattccggatttcctgtgacttatcgaaggatcaaggccctttttgcttggcctggtatgaagaaacagatcaagctcaaggtgaaggagtgctctatttgtcagcaagc

SEQ ID NO: 37912 - DNA, 14657 bp, Oryza sativa
agtattgtatgggcatattcctaaccaattgggcattactgttaactcttgtgaacttccaaatgtccagcagttgttgaatgaatgagggttaatgatacaactcttgcagcaacatttgaacagagcacaacagtttatgaagagccaagctgacaagaaaagaagttttagagcttttgcagtgggagattgggtctatttgaagttacagccatatgtccaaacttcagtagcagccagggctaatcacaagctgagtttcaagttctttggtccttatgaaattcaagagaagattggtgttgtagcataccgtttagtccttccggcgagcagctctattcaccctgtttttcatgtctcgcagctcaaagcagctcaaggttttaaaggggatgcttctgttcatcttcctgttcagtcttctactaaacaagttcctgtggctattctggatactagggtgcgcaagtcaggtatgtctgttattcctcaggtgcttatacattggtctgatgatgtgatcgccaatgcaacttgggaagacttggaagatcttcgtactcgtttcccaagagcactggcttgggggcaatccagttttcaaggggggaacattgtcaaggctgcgttgggtgctgatgctgacattgccaaggaggagaagatcgaagggagaggtagtagacttaaaagggggaatgttcgtttaagtggaccagaatgggcattgtaagcctgagtggttattcggcccaagtgccagactgtaagcgtgtgtggggagtgagtgggagtgataaaactaacacacaactcctgtaaacctttttatcgatttagaacttggtagtggcgattggcggcggcggaattcgctggaaatccccgtcgatatatcttgtgtgtctccagttctgaatcctagtttaggcagctatcatgagggcgagagggtggcaccattccacgatggcagcagcacctctgcacgaaggcgacaacgacaacacatgggagaggaccggggattaaccactgatgaggacattgaggtggcagctatgttggaaactgggcaacgatgatattgtttgtgatctgcgaatataaccaaaatggttttctcacactagatgatgattagggaggaagaacgtgaaagcggcgcaggtgcttaccacgatagagaggtggcagcaatgccgggtggttgacaacaagttgatggcgatggtggatggcttgatggaagacggcgcaggaagtggggaagacgacagaggtggatggcataacagtgctgcgccattcgctggtaattgagagatctcccaacgatggtagcagtgctggaaatgagacgaccatcatgccggctcgatcttcccatggagcagctcgtgcttgcgatgacagcggcaacattggtgctcactcgatcggactgcaacacaaccgcgtctactcgatgtcccgaggcaggaacctaggccggattatagtgagcagcaatagcagcaagacatggtccggtggacgacgatggagagagaggcggcagtgcaagttcgcagcgaacggccggtggagggatgcaggcgtgtcgccggaggtgaggaagatgcatgggaggtggccttggccttggtgttgaccggcggcggcgacggcacggtgtggcaggaacggtggtctgcaaagggaaaaggagggggtgctggatctacttatagaggaggacagggagttgagcggccagccggaagatgtttattcatttttttagctgagacgatggaaattgaggtgactgactgatgatggttactcattttttggctttggtggagaaaattgatggaggggtttcgccggggatttggctggtgatgtgatggcacggccggggctagctgaagcgcgcaggcgggctggttcgaactgcatgcgaggaaatgagatatggggcttcggcctcctgctgatgggacttcggcctcctgctggccagaggaagaagatgaccgatcgagaaggaagaaagaaaagatgaacagccgggagacaagatccaactcatcaaaagagattcaattttcggcattcaacaagtgaaattgatgatggagaggaaaggattagggaatttctgttagcttcagctataatcatgtgtcgtattatcggttactgtaacgtgtctagtgttgtcgtttcttcagtttcgtcagactctgtttcggcgtctgtttctctgtttctttttcctgtaagccgagtcttccgggtcgtgcgtcgtgtgcgagtcatccggatttcagtgtcgtggtcgcatcgtcgtggatgatggcgtagtggtgtcagtttgagtctgtacatatttgctatatatatgagcatcagaaaacgtcgctggttggttcgcgacaccaaaaactctgttcgtgttcatcgtctttccaattcagagaattcgcgtgagagagagagtgaggattcacaatcttgggctttgctatcatttggtatcagagccatgtccgctcccgccagcggttcgtctcgcactcaccggcgaacaggccgccggctctcgccgtctccgccgcgcgtgagcgggcgacagctcgtcgtgcagcggattgttaaggaagatggctccgtctactatccaatactcagacgctcaaattactccgattgggcggtgttgatgcgagtcaatctccaggctcaaggtctgtgggatgctgtcgacaccggcgatgtcccgtatcaggaagattgccaggcgctttcagccatcttgcgagcggtgccggctgagatggtccggccgcttgccgagaaggacagcgccaaagacgcctgggatgcgctcaaatccatgcgagtaggcgcagatcgtgttaaggagtcccgagcacagaagctgcgccaaacttttgagtccatgcgattcaagaatggcgaacacctggaggatttcagccttcgtctccagtccttggagatgatctgtctgaagagaaggttgtttgaaaattgcttcgcgtcgttccccggaggtatcgccaaatggctctatcgattgaaaccttgattgatctcactgtttgatgaatttttataccaaaattcatagaaaaaataatatatcattgggcattaatttgcagcccaattttacgaaatacacgtgaaacatgtctctacgacatgtgggaccagaaaattcaaatatcatacaatgttcaaacatattcaaaattggactcgttttgttgtatgttttgattggaaaataatggttccaacagaattcatatttgatatatgattagggagatataaacatttgaaggagatcaaccagtgttaacctcgtatatccttaatttgtttgctgctcctcaccggttggtaattatccttatggcagtgtttggcaaatgtctaaaggaaatgatttcccactcatctttaaatcctaaccatttattctccctcatccatttaatcctaacccttcattcatttcctaatcccaatcccacccctcatttcccattatccaaacacaccctatgaggtgtgggatccaccgtcaattagccaagttaatcctcgtgattatctccagcacacacacgttctttttatctggagcacaaaattctttttatcacgcgcaggtcgttggattaacagacgcgctggcttatccagagaattaacgcttgatttcgctggcttgctgaaatctcggaagggattaggcgaggactccgtcgcctctactcttatataaggcgctgtccctcacgacgcaggaggtgggagaaaatccccggcgcagaggcggctggcagaggagaagacgtaggtaggcaactatgctgtgtgctctgatctgcttatagtttcacaaacccatatccaacatatacacaatttacacgtcgtcaccgagaagcacacatagacggcggaccgctgcgcggctcagcagcaatatgccttagagagccgccggcgctgatggcatctctgccggcgagtcgtccgtcctgaataacaagcagatcgatcttgtttttcgtcaagaaaatatcatcagtggtgtgcagacgagtccgatcctcgtggggttggaccgtctaagttatcaaatattggagttggatatttatttgtataaacttaggatgagtttgagccttattggcatcagaccaaccatgatttacacatatttatattctcgttcatgataaaaaatcggatgcgcatatttataaacttgggatgagtttgagccttattggcatcggaccaaccataatttatgcatattgatgttctcgctcatgataaaatatcggatgtgcatatttacttgtataaacttgggatgagtttgagtctaatcggcatcggaccaaccatgatttatacatatttatattcataccggaacaattatagatttgccttgtgcatgtcatgtgcgggagcaattccttctctctctaaattctaccagatggatgggagcaactctcaaaattcttgaagacaacaaaaacaatgctcgccaggagggcaaggcatgcagatttacaacacacgtcgacatcatggccgagtgtcgacgagatgaaatggccaatttatcaatatttgtgctatgtccgagaccgacgagtccggataacatattggctaaagctgacaaggctgcagtcattaactcattccatttgtctatgaccgacgaggttagatgaaaccatggccgagtgtcgacaaggccaggtcactatactattaacacgtctaaaatggacgggaactggatataccgttgctgggcaccgacgaggcaaaagcaatcacaaaatccatgtttgatgaaggccggggcacatgagtgggcaccgatgaggcaaaggtcacccgcttcaccaaattccctccgtatactaacatgatgatagtgtattgtgactgggttttggcaaaacaaagccatcagttccacattcactatattcaccgttaaatctgaaccaacctcaaccttcggcgagcaaccaaattttgatgttgacgatcacaaagcgcagcttaatcggaggtgttccataggctcgctcctatagatgtaattaaccggccgcctcattgctagcgccgggaatcagcggactgcacggaatctcctgtcaagatacctctccattaagcattcctcacgaaggcaaaaggcgaactcctacaggagccctcatgtatttgtaaacattcatgttaatgaatcatgattaataaaaaggcaatacagggtttccctattttctgtgtgttcgttgttttgttttcatcaaacactgaccttgctttctattgaggatctgactggccggcttctcaccgtcgacgatcaccccgactctgatggcgaggacgcgggtcaggtgctcttcagcgaaaaggaggcccctgctcactcaaacaaggaagctgggcagaactcagccggggggagggcgtccagctcacggcaaccacaccgcagcaggcgcgagcgcgacggcaacggctccgacggcaagtcaggttcgtcccaagcggcaaaccgcaatgtgtccaaggacaaatgccggtactgtggcaaacttggtcactgggccaaggactgttgcaaggcgaagcgagaccgcgagaaactggctcaggcaaaccttctcatcaccgagcctgctcaagccgcggacgaaggggagccgacactgctgatggcgcaagtgtgcgagcttgcccctgctaccgatcctgtcattactgacggggaggtgacactgaaggaggaacgtgctcacgtttctcttcaggatgaaggaaagcccgttgatctagactggatccttgacacgggcgcttcaaatcacatgacgggctaccgtgatgtgttctccgagcttcacaccaccgtgcgcggcactgtcaagtttggtgatgcgtcgagagtctggattgaaggacgaggcatggtgctgttcgcttgcaagaatggtgaccactgcgcgctcactagcgtctactacatccccaagcttcggagcaacatggtcagccttggctagcttgatgaggcgcattgcaagacggtgatcgaggatggtgttctcactttgcatgatccacagcgacagctgctgtgtagggtgcgccaaggagttgggcgcctctacgttctccacgtcgagctggcgcaaccggtttcccttctcgcaaaggggaaggatcaagcctgggtctggcacgctagatacggtgtcacgcccagaaattttcgaatagaattccaagcagaatgtgcattaaaatccccgtccaggaccggccggggtacacaaacgacaaagttgacatacagatccacgtcttacaaacattataaaagttttacataaatgcagcggaaaaacaaaagataactggagctaagccttgacttgaactacagcgggaacaccactccacaggcatcctcgatggcacggacgaagcctactcctcggagaaaccaccatctgacgcatactcaaactctggggtttggggaaaatagagcaagactgagtattaccaactgtactcagcaagtcataccggaataggggtatgatgcagggaattatcaagggatagctataatggttcatttgcataaaacgagcatttataaacagaagttgaaagcagtaaagcagttgtaacaattaatcaatattaatcatccactgtccaacgctataccacattgcaacaggcccaaccatccacctatactatccaatttcattagactaaactagggtgagactaatcacggtgaatctggttgatcgcccataaccacgggcacggccatttgaatagttttactctgatcagaggtgtacaactgtacccacaagacacaaccccacgacacgttttcgtgcgccggcatgccaccacgacatactagaaagaggccgtgacaggacccttcgcataaccccctctaaccaagcacaccacacctcaggtttcacccccactcctcgcaaggccgtgggcagtcccctctcgtgcctagatgaatccggaagccgcataggccatcgcaggacccatccaaactccatcacgcccacccttgcctggatgcgtcaggtagaggaaagctacactacaagcccagccgttgcccacactggcttgtggtaagtatgataagttcttacagggcatcccgcgaaccggtccttaactgctatgggtgcgaccaacaaaaccatgcacccacagcccaccatgtgatttattttaattaaccaataccgaagcggtggcactaatccaacattaccattagaatctacagtctatacattaataggattttcccctttgtgtgctagttgaacaaagcatggctaagcaatccctagtccaatatctagtcatgttataacccaagctaacaaaggagcatggtaccaaaatagcatggctgtaacagtaggtaaacatcacatagtattattgtaaaacaatgcagtatttgaaggaaaacattagaacatttgcaatataggatcaacatgttcaagtgaccggcatgacttgccttgctctactgctggaggaacctcgacgactatctcgaagtacaccggagcgtcggaagagccggaatctaagtgacatacatagcaaacaatacaaacacgctataatactactgaaacagagaacaaaaccaattttaatggattctacatatttttcttgatttactaagacttgaatgggtttaaacggagctcggatgaattagttatgaattttagaagattcactgtgtttttactataaacagaaaaatccttaattgaattattgcgcaataaatgcccagggctgacgtcatcaaagggagcgggtggcgccgacatgcggggcccgcatgtcagcggcgcaaggggagagggagggggcgccggcacgtgggccccacgggtcagcggcacaaagcggccggtccaccgtggactggggccacgcgggtggtccaccgccggtccacgggaccgacggtccggatcggcctcgggccgatcggacggcgcagggagcagccgccgggcttggctcggcttcaaagccggccggccggccatggctagaggcggcggcgtgcatgaccaccggcggcgaccggcggcggcggacggcgcgaaggcggcggcgcacagccggagcagcggcgcggccaaaagcaatggcgcacgcgggaaggggaaggaaaggaagggggagggattcctcaccggaggggacggcggcgaccggcggcagaaaacgagggaggcggcgaagtccggcgatgccgaggtgcggacgagtgacggcgacacctaggggaggggaggacaggaattagcgcagaggaaaaaaccccacggtggccatccatgtcggccggagtcggaggggagaggggactcaccggcgacgcgagggaaatgtggtcttggtgggatttcggcaacgcaaggcggcggctgggaaagatcttgcggcggcgaagctagtggtgacggcggcttagcgcggcggcggctctagcgggggcagcacgtggccgtagtgcggtggcaagcggtggcgctggcggcgagcggcgcgagctcggtaggaagcacgggagggagcggcgagagcggaaagggaaagaggaggctcggggcagcgatttataggtgcgggatgggtggaaacggccgggaaagcctcctttttgacctgcgacgtggggtggagagagagataatggggggattcaaaatgcgaatcccgccccttgcgagcgcgcgcgcgggccgggagacgcgggggagacggcggcgacgtggggaggacgcggggacggcgcggcgtgggcgcggcaggagcggaggaggtgggtgcggcggtttcggcggcggttgccgacctggggcgggcggccggaggaaggggacgacctcgacaggtgggacccacctgtcggcgtcccggagagagagaggggcggcttgggccggcccacaaggaggaaaagagcgcgcgcagcggcgggcggactaggccgacggcccaagaagaggaaaaaggagggaaaagaaaaagaaaaggaagaaaggatttatcctgggatttaaaattgcatgtgctcaattttaattggttaaaattatttctagggctctcaaaattccactaaaaatcttgttagcaaatttcgacatgtagaactcaagaaaaattccacatgccaattccgattattatttgcattggtttattagggtttactcttgcttttacaccgatattttcttgggaccatttataaattcaatttaggcttgggaggagaacttcagggtgtgacaaacctacccccttaaacggaatctcggccccgagattcggaggagctggcgaagaggtgcggatgggcggccttcaactcatcttctctttcccaggttgcttcctcctctgaatggtggctccactaaacccggcaaaacctggtgaccttgtttctagtcctcctttcgctggtctcaaggatgcgaactggcttctccacgtaggtcagatcttcctggatatcgatgtgctctgaatcggcttgttcttcgggtaccctcaagcacttctttaattgggacacgtggaacacgtcatggataccgatcatattgaatggaagttctagctgataagcaacttctcctcttcgttccaagattttgtatggtcccacgaagcgtggtgccaacttgcctttggtttgaaaacggtgtactccccggagcggagtaacacgaaggtacacgtaatccccggcttcaaaagtgagctcccttcggcggttgtccgcgtagctcttctgtcgagactgggcaattcttagcctctctctgacggtcctgactttctcttccgcttccgttagcacttatgttccgaacagttgacgttcgcctgtttgatatcagaagagaggtgtgcggcacttccggccgtacaacgcttcgaacggtgccatttgaagactagcctggtagctgttgttgtaagagaactccgcatacggcaagcttttgtcccaagctccaccaaaatcaagtgcacaagcccttaacatgtcctccaatatttgattgactcgctcggtctgaccatcggtctgcggatggtaggctgtgctgaaattcaaccgggttcccaattcctcttgcaatttctgccagaactttgaagtgaattggctccctcgatcagatactatctttttgggtactccatgtagacacatgattcgcaagaggtagagctctgccaaccttttgcccgtataagtagtgtgcactgggatgaaatgagcgactttggtaagccgatccacaactacctatatcgaatcgtggccagatcatgtcctgggcagacctgttatgaaatccattccaatttcttcccatttccattccgggatctgaagaggttgtaatagtcctgcgggcctctgatgttctgttttaactcgctgacaaacatcgcagagcgtgacgaattcagctatttccctcctcatgctggcccaccaaaatttttatttgagatcttgatacatcttggtactacccggatgaatggagtattgagtctgatgagcctcggtgagtatcagatccttcagctctttgtcatcaggcatgtgcaatctttctcccatccagactgtgccatgttcatcctcaaggaagtcccgggcttttccgaccctcatattctttttcagttcagctatctcaagatccgtcacttgagctgctctgacttgatccacgagcgtaggccgtgcttctagagtggctacgaacctgtgttcaacgattcccacgttgagacgttcaagctcctgctgcaattcttcacacatgtcctcggtgcatagggcattgcagtagcttttcctgcttaaagcatctgccaccacattggctttacccggatggtagtgaatgctcatgtcataatctttgattagttccagccatcttcgttgtcggagatttagatccggttgggtgaagatgtatttcagactcttgtggtccgtatatacttcacagcggttgccaatcagatagtgcctccagatcttcaaagcatgtaccactgctgccaattccaggtcatgagttggataattcccttcatgtggacgcaactgccgcgaggcataagcgaccactctgccctcttgcattagaacacatccaagcccgtggcgagatgcgttgcaatagactcggaagtcttttgtctagtcgggcagaatcagaactacggcggatactaatttcttcttgagctcctcaaaactcttgtcacactcagctgtccatttaaacttctcatctttctaaagcaactgagtgatgggtcgggcgatcctggagaagttttcaatgaatcggcggtaataacccgcaagtccaagaaaactctgaatctgtgacacggtcttaggtggggtccatttggtaactgactccacattcgatggatcaactgccacgccttgagctgtaataacgtgacccagaaatttgacttccgacaaccagaagtcacacttgctgaacttggcatataactggtgctccttcaacttctcgagtacccgacagagatgttgctcatgttcttcttcggactttgaatagataagtatgtcgtcgatgaataccacaacaaacttgtccagaaattccatgaacactttgttcatcagattcatgaagaatgcgggtgcgttggtaagtccgaaagacataagcgtgcactcatacaacccataccgagtggtgaaggctttcttcggaatatcctcttcccgaattctcaactggtgatagcctgatcgcaggtctatcttagaaaacacttagctcttttcagctgatcaaacaaatcatcgatccgcggcaaaggatatttgttcttgattgtgacctcattgagtgcgcggtaatcgacacacattctcttcgtcttgtccttcttctccacaaaaatgaccggagcaccccaaggtgaaatacttggtcgaatgtaccctttctgcagctgctcatcaacctgcttcttgacctctgctagctcgttgactgccatcctgtacggtctcttgtaaattggagcggttcccggtgccaaatcaatccggaattcaatctctctcttgggtggcatggtagtgaggtcttcagtaaacacttctgggtactcgcagactatggggatatcttccaatttcctcgaactcttcccctcggtgaccactgggatttccacctcaatctgattcaaggagaccccttgctttggtgagactagtgatttgtgttggcaacattttgtgacaagtcgacaagcacaatcgcaacacctaaacgccttgcggtgacatggagtcgccaaccacctcgatctagccaaaggaccaaatcaagatgggttttgtagaaagaaaagctaaaccggctagcggagccgatttagagatcaaaatcagcctctaggccgatttagatcgatatgaggataactacccgtctcgtgggcaaaacggaagttttacaggacaaacctacaaagaggtgtcgcactctcgctgcggcggcggatggtttacagcgcaaaccgacaaagatggactaaactagggtaaaatagaaaacatagttaaaaaacgattcaagtagattgtattcgggggttttacaatgaaccggccttgtcccttatataggggttggtcttgccctctacaggccctccttcacgtccaattcgggatagaaaccaatggaaacacgaaacatgccttcctgagcaaggaaacccgagacccgacgaaaacagagtcggactcagaccctcacggtctgaccgcctacataactgcggtcagaccggccctactagccggtcagaccgcccacatacctatggtctgaccggccctagtgaaggaaacccgacactttccaaactttggcaatttttccctatttcgtccataggtgccaaatttgggtgtaaacacatgcccccctgcctttttggtgaacatacgtgaacctaaaagcatagaacatgttatctcagggcgataatccaattaccggccataggacttcctaagcatcttaccaaatgctcgggaagtatttcttcaagctatttcccattaattgctctttgaaaacaccgtcttgaagtgtcttcatctccttcaaagtctttaaacgcttgtcgatgacgtcttcaaaattgcttcccatcaaggtcttgtaatcgtcaaccgacaagtcgtcttgcttgaaataccgaagagagccaagatttacctcaactggcaaaacggcaattttaacaatgttttattactcgactcggcttatccattagcctgagcgtagtaaagagaagaactcaacaacttaatatcataagattcggcaaaacttctcacttccttggacataaaagaagctcctttaatgtttgaggaataccgaatctatgaacgatatgcttcaaaataaagccaattacctccgtagtaatattctcgagcggcacggcttcggctcacttagtgaagtaacccattgcaactagcacgaaccaatgcccttttgatgacgaaggataaatttgaccaatgaaatccaaagcccaaccttggaacggccatggtttgatgataatattcaatatagtgataggcgctaatttgaacattgtcgatccgttaacaagcttcactccctctatagcatttgaaacaatcatcaattattttcggccaagaaactccactctcctaagcaaccaatttatcttacggccgattgatgaattccacgaattccttcatgtacctctcccatagccactttagattgatcttcatctaagcactttaacaagacaccatctatgtttcggcgatacaatatttgaacacttgccaccgaatctttcgatcaaccttaagtgtaggatcttttaaatatctaatcaaaggaattctccaagctatttctaactcatgggcacaaatgtccgaataattaattcggccttttaatcaattgtaacgtgccccccagcctcctgtctgggatcggtcagaccggacacgcaatgccggtcagaccaccctgtctgcccggtcagaccggccatgcagagccggttagaccgcgggtaccaccagtcagaccggccgtgcaatgccggtcagaccacccctgatctatgactttgccaacttcatccaaacttttgaaatcaagcatcggcctttagtatataatttttcttcacataatagccagatgcttagtgtatcaaattattggaccaaaattccttctctctatacatatgaaaaatcataacattcaactaatatgtctagatgaatactaattcaattggctgttgaaacaataatc

SEQ ID NO: 37913 - DNA, 4925 bp, Oryza sativa
accatgtagaaattgaattaggagcaagtaaactataccatgtagatgcaaagtttgacaaagaaagaggaaacaatttaacttaagcaaatatattaccggccttaccacattgatcaataaatggccgatatgctccattgttgttctagcatcctcacctgtgaattttgtgaagttgggcaccttaaatccttgcgggtatgggaccgaatctacgtgttcaggatacgatctttgatatgtatgcatagttactttggattctatctcactactatcctgcaagacattgtcactatcttttccaacatctacatgaccgatttgtaattcggtcttaggtgacaatgctatttcacttgagcttgtaatacaatccgaaccgtcatttagttcggctatatcttcgatggcattattctctaagctagcaacacaatccgaaccattacttggttcggctattccatcattgtctaaactagtgacacaatccaaaccaacacttggttcggctatattgattattgcgttatcatccaaactagtaagacagtccggaccaacatttgattcggctatacttgtcacggcatcattgcacaaattattaacacaatccgaattatcgctaggttcggctatacatgttattgcactatcatctaaactagcatttaagctattgtcatccactcggctttcctgagtcagagcttcatgcaacacatgatcaatatcaagaaatatctggccattcaatttctctttaatagaatcaagcaatccatcatatgaaatgttggccaaatctttgtcagttattttcaaactaaaacatcggcttttaatttctctaaacctttcaatataatcaacgacagattcattgtatttttgcctaaccgatgttatatcagacaacctatgctcagttttaccagtgcaaaaatgatcatgaaattgttcttctaattgagcccaagtatgaatagaatttgccggtaaagaagtaaaccatgtaaaagcattaccggataaagataaagaaaacaagcgcaatttaaaagtatcactattagcctcaccacattgcgctaaaaattgacctacatgctcccatgtggtcttaccatcctcaccactaaatttggcaaattcgggaactctataatttctaggaaacggcacattatcataataatcaggatatggctttttgtaagctctagcacgattcctagtttcaatcccgaatctatttctcataatatcactaatcacattctctatgttattaggcccttgtggatttggtggtgggtttggtagcctaataggctgggtttgtggcgcaatatgattatattggccttgcctagtatcgggaggatatcccctagaaacatcattataagcattaggaatatgtgggggaacttgaggattaatagtagcagtagatacaggaggatcaaatgttctaaagtggtacaaataactagcgttagtcgttggatctataccctgaatcgggacaattgcaccggtctgaccggcccagggcccggtctgaccagcgtcctgttgcgcggtcggaccggcctgagagccggtctgaccggccgtctggccggtcggaccgacggctatgttatggtctgaccggccgtcaggcccggtcggaccgaccgtgaataccgtcgcgtcggttttactacccatcggatctataggagattgatcaacagtggtataggctttatcctttaatgtgtaatcatccataaaagcacctagcctactccttaaaaacccatcaaccttctccttaaacattaaatctaatctatctttaaaattagccatagatgaatcttttgtagatgcaatttgttcgttgatagattgcgatacctcgtcattacttaccacgtcgggagcgagcataggacgtggcccgggcttgatgatcacaacttgatgagtcctagtagttaatctcatcaacgcctcccgtgtgagctcgttgatgtactcctccacagctttacgatcctctccttcgaagtcatccaatgtgaccggcatcacattagatggctccacctccgttctggatgatggcttcgtcatggcgaagtcgaagtcgagttgacgatgaacggatctcgtccccagcggagtcgccaaaaatcatgttggcacctttttgtgacaagtcgacaagcacgatcgcaacacctaaacgccttgcggtgatatggagtcgccaaccacctcgatctagccaaagagccaaatcaagatgggttttgtataaagaaaagctaaaccggctagtggagccgatttagagatcaaaatcagcctctaggccgatttagatcgatatgaggataactacccgtctcgtgggtaaaacggaaggttttcaggagaaacctacaaagaggtgtcgcactctcgcagcggcggcagactgtttacagcgcaaaccgacaaagatggactaaactagggtaaaatagaaacatagtaaaagaacgattcaagtagattgtatgtcacgaccggaaataacccaacgggcgttccttacgtgagtgcattattccttgtcccaggaggcaaggtacaccaaaagttgatacagatcagagttcaacaagcggaagcgtaaatagttaatttattacatgggcagcgaaggcccagcacacacaaagacaaacgagaaacagcggaagactagggcgacgaccacaggcgtttgacggcaggcacgagctagacaccaaaaccttcatcttccagagactcctcttctgggtttgggaaaaaaattgagcaagactgagtacaaccaccgtactcaacaagacacacccacaagtgcataataaatgcaagggagtacaagggagttataatataaagggttagggttgcagtaaacagcatttaaagatacttagttgctcaaagctattttgtaaacacgattctagaactatacaatattatttatcaaggccgtgaacccacacgaacctgccttaacccaaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacatgcaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccgaccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtgaaagtacggtagtgctttgcaacagaggcccgaagaccggtccttatttggccgaggtgctactatcaaaaccatgcaccccgagcccagcctaaaaccatttttggggattttgaatagagggggcggtgtgaatccaattccacaatactccaacaattccaaagtgtccaggtgatatgaatatcccaaagtctagagttgtaaaaccgcctaatgttacctaattaaatagcgaagcatctacctaaaatcatactagtggtaccatgagtagagtgtccactagctggggttttgtttattctagggtgaacaaggaaataataacaataacaataataaggtcataacaaaggtaaataggcatggctagataaaacagtgataacgcgggaatttaaataaagcgataatgcaataattttaaagcaacataattttataaactgggattcaatatgttcaaggatgatgtgacttgccttgctcgctttcccaaacgccggcttcaacttccacgaagagcggatcttccaaagctgcagcgtctacacgatcaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatggatttattgcgtcagccgaggggaggggcgcgcggaccgggtccacgggggtggggcccacgcggcagccccacggtccacggtggaccgggcgcacccgggctcacaccggccggcgccgtgggtcccacgcgtcagccgcacccgaggacgcgggcggctgacagccgggccccacgcggcagccgcacggtgcgcccgaaggcggccacgccggcgcagcggcgggaggcggcgcgcccgcgcccctatggtcgccggcggcggccataggcacggcggagcggcggccgagagaggggaagggaagggggaaaagaagcggcggtccacggctcaccccgggtcgacggcgacgacggaaacggcgaccggagcggaggaaggcggcggcgcggctcgggtggacggggtcgacggtgctccggcggtcggcgagcaaaacggaggagtggacgaggtcgccggggatgcggtgaagccgaaggtggcgacgccgaggcgggaggtggtccggggcgacgacggcggcggac

SEQ ID NO: 37914 - DNA, 2522 bp, Oryza sativa
caacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagatgtccatcgacccccgacttcttccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagaaggagcggtgtgaagccaattccacaataaccaaaccattccatagtgtccaggtgatatgaatattcccaaagtctagagttgtaaaaccgcctaatgttacctaattaaaagcgaagcatctacctaaaattatactaggggtaccatgagtagagggtccactagttggggttttgtttattctagggtgaacaaggtaataataacaataacaataataataaggtcataacaaaggtaaataggcatggctaaataaaacagtgataacgcgggaatttaaataaagcgataatgcaataagttaaatcaacataattttacaaactgggattcaatatgttcaaagatgatgtgacttgccttgctcgctttcccaaacgccggcttcaacctccacgaagagcggatcttccgaagctgcagcgtctacacgaccaacggaaaagaaacggcttttactctactaaactctatataacaagcagaaacaaagcacaaaaatgggttcttggcttcttaaggaaaaattagagacttgaacggtccaattccgagttcaaatggccaagttatggccatttgaagtttatatgctctttaaatggatatttacgaatttcttcatttaaattttaatttaaaatcggatttattgcgtcagccgaggggaggggcgcgcggaccgggtccacgggagtggggcccacgcggcagcctcacggtccacggtggactgggtgcacgcggcttacgccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccccgatggtcgccgccggcgaccaccggcgcggcggagcagcgcccgagagaggggagggaagggggaagtgaaacggcggtccacggctcaccccgggtcgacggcgacgacgggaacggcgaccggagcggaggaaggcggcggcgcggctcgggtcgacgaggacggcggagttccggcggtcggcgggcgaaacggaggggtggacgaggtcggcgaggttgcggtgaacccgaagaaggcgacgccgaaacgggagagggtccggggcgacgacggcggcggaccggagctcggcggcgacggcggagagagagaacgacggcgcgagctcgattccgacggggagagagagcggcgagtggcggaaacggtggagggaggcacggggagtgtttatatagtgttgggagggggagagaacggccggatgagggggaaacgggcgcggaagatccggtcgccattgatggcgccggcgaggttaggggagaggtttccaaacgaatccgagggagagagggagggaaaaatggggggaaagagggagggaatcacgggaaatatttcccccccccccactttattgcgcgcgtggacggcgggaggcggtgggattcgtggcggcggcggcgctagggcacgggcgaggcggcgggagcggcgggaggaaggggatgacgggtgggggtggcgggcgggcccgcccgtcagcggcacgcgcgcggggaggaggccgaatgggccgcgggggagaggagagagagggagagagatgggccgagccggcccaagagggggaggagggggaaaaagactttttaggttttttctttttataaaacctttttaactttgtttatttcttcttaattattatttgtgctctgaaaattccactaaaatttatttacgcattttaggcttttaatgatgtgacttgccttgctcgctttcccaaacgccggcttcaacctccacgaagagcggatcttccgaagctgcagcgtcta

SEQ ID NO: 37915 - DNA, 5109 bp, Oryza sativa
atcaaaaagtactattgcagggattgagttaacaggaaacgtacccagtacgacctctggtgctgcttgcgcctcctctgcggacgcgtggttgacacgagcctggacaaaccttagcccggcacgccttggcttcgggcatttgtcagcgaagtggccaagctcgccatagttgaagcaggaccctggctttgtcccagcctccatcttggcttgagcggatggaactgactgtgctggtgccattggtgggcgcggagctgcactgaggttgggctgacctccctggtggttctggctgccactggcgccctggtggaagctgcttgagttgaaagggcggtgctggaggacgatcatggtggtaggtccaccttgctgtccgggagtgaagcgcggttgctggtggctcccttggttggaccggaactgcgccgcctttctcttcctgtccattttgttgcgctgatcctcctgacggattgccttgtcaaccagcctctcaaagtcggcgtagtctccagagattaactggttggtcagctcgtcatccaggcctcctaggaacttctcctgcttctctgcgtcagtgcggacatcctctggtgcatatcgcgctaggcgattgaactcatggagatactcagtcactgtcctgttgccctggtggagtgcccggaattccctcttcttctgtgccacgaccgcgtctggcacctgcgcctttctgaagctgcgacagaactccgcccaagtgacttcagtgcctggcgggcgggtggccatgtgattgtcccaccaagctgacgcggaaccctggagctggtgtgtggcaaaggcgaccttctcctgatcattgcactgcaggagatttagtttcttctctatggcatggagccagtcattcgcctccatggggttggtggtgcaagagaaggtgggtggcctgacgcgtagaaactccggcaacttggactgagggggagggggaccaaactgctgctgctgttgctcgtcttgctgctgcatcctctggtgcatctgctggtgctgctgctgcatcatggctgccatcatctgagtctgatgagccattacttgggccagagtcggattctcggggagtggtggcggaccattgctggaatcgctgttgggatgcacaccgtcagtgcgttctttgccgttgctgccctcgcctgttgtgcggctaccattcctggtgtagaccatctggaggaagagcagacgggggggtagaaaagaagaaaaacagatgctcaggaactaagctttattatataggaatttaaactgcaattgttctgatctgaattaaaacacttaaaacagcaagcaaaatccttattaagacagccatatcataggcacatgatatcgaccgtcgactgacccacaagcgagcagacctaaacacacaaactaacaggcaaatactaaacagtcgataaactaatggaaagcgagcctaatgctcggaacggctcctgcggtcggtggagtcgaaggcgtcctcctgcttgtcaccaggtccctctgagcggctcctggagtctggcagatacgtctcgccgctgcccggctctgagccactggaactgctgctgctgtggtcgcggctgccactgggagtggcaggcaaccaaccgccgttgccactggctgggcccctgacggctgatgctggagcgaaggagagagcggacacgggagctgacactggaacatgagctgggactggctctggagctgcaggagctgcggcaactgtggggcagaactggaggagctgcgggagctgcaggcggaggtgggttcctgggcgcaagttgaatgcacacgggtgccgtcgtcgacttgccgggcgtggtgcggatcaggactcctcttggcgcggggagacccttcaactgagcattctccttcttcaggcgtgctatctcatccttcagagctatgatcctcacgagcttcccaccattcaaggccttagacgccttgtgcagatccgagtgcatcctgtccattcccctcatcacggtgcacatgtggccgaaggtggtgtcgttctcaccagctatcgggcggaaggtgctgatatcatcgccacttgctcgacgagggtggaagcggtacaccgtgttgcagaagatgtagttgtgctgatcacgaagcctggccatcagcagatatgctgcctcctgacaggcgtgatctgctgtgcctccggatgcctcaaccacaatgttagcgaggcaggtacccacatagccatggacctccaggcgaacacggtgaggaagctcgccactgagcggtggaacagtcgagtactctggcacgttggggtagcccaccaccagtgtcatgcgagccaattctgccacaaaatcatccatgccttctccgcggtggttgggtgggtgctcggccatctagagaagacaaaggggtaggatcaatgcatgctcaaatccaattttaaataaagcagtaaaggactcaaataagagaagcgaataagagcggaattttatgcatagatcatttgcatgagagcgaataaataagacagacttacatagcgataaaatagtgagaaaattaggtacatactaataataacaataaaagcataaacaccttgcaacccatattcctgagctaggacctaatgcataccacccatcaaatcccgactaactgtcgaatatatctcaaataattttactaaaaccctagacttacttgtttcgacaaatctcacttaaacgagcgaccaagatttttcccttgaaccacaagaacagatcccaatttctcacggaacaaatccaattgcaaagaacatatgcaatgaaaaggattcagagggctcttaggttttccatttggcttgtcctacggtcaaggtcggctctgataccaacttgtcacgcccagaaattcccgaatagaattccaagcagaatgtgcattaaaatccccgtccaggaccggccggggtacacaaacgacaaagttgacatacagatccacgtcttacaaacattataaaagtcttacataaatacagcggaaaaacaaaagataactggagctaagccttgacttgaactgcagcgggaacaccactccacaggcatcctcgatggcacggacgaagcctactcctcggagaaaccaccatctgacgcatactcaaactctggggtttggggaaaatagagcaagactgagtactacccactgtactcagcaagtcataccggaatagggctatgatgcagggaattatcaagggatagctataatggttcatttgcataaaacgggcatttataaacagaagttgaaagcagtaaagcagttgtaacaattaatcaatattaatcatccactgtccaacgctataccatgttgcaacaggcccaaccatccacctatactatccaatttcatcagactaaactagggtgagactaatcacggtgaatctggttgaccgcccataaccgtgggcacggctattcgaatagttttactctgattagaggtgtacaactgtacccacaagacacagccccacgacacgttttcgtgcgccggcatgccaccacgacataccggaaagaggccgtgacaggacccttcgcataaccccctctaaccaagcacaccacacctcaggtatcacccccactcctcgcaaggcagcgggcagtcccctctcgtgcctagatgaatccggaagccgcataggccgtcgcaggacccatccaaactccatcacggccacccttgcctagatgcgtcagctagaggaaagctacactacaagcccagcagttgcccacactagcttgtggtaagtacgataagttcttccagggcatcctgtgaaccggtccttaactgccatgggcgcgaccaacaaaatcatgcacccacagcccaccatgtgatttattttaattaaccaacaccgaagcggtggcactaatccaacattaccattagaacctacagtctatacattaataggattttcccctttgtgtgctagttgaactaagcatggctaagcaatccctagtccaatatctagtcatgttataacccaagctaacaaaggagcatggtaccaaaatagcatggctgtaacagtaggtaaacatcccatagtattattgtaaaacaatgcagtatttgaaggaaaacattagaacatttgcaatataggatcaacatgttcaagtgacaggcatgacttgccttgctctgctgctggaggaacctcggtgactatctcgaagtacaccggagcgttggaagagctggaatctaagcgacatacaaagcaaacaatacaaacaggctataagactactgaaacagagaacaaaaccatttttaatggattctacacatttttcttgatttactgagacttgaatgggcttaaacggagctcggatgaattagttatgaattttagaagattcactgtgtttttacaataaacagaaaaatccttaattgaattattgcacaataaatgcctagggctgacgtcatcaaagggagcgggcggcgccgacatgcttggcccgcatgtcagcggcgcaaggggagagggagggggcgccggcacgtgggccccacgggtcagcggcacaaagcggccggtccaccgtggaccgggaccacgcgggtggtccaccgccggtccacgggaccgatggtccggatcggcctcgggccgatcggacggcgcggggagcagccgccgggttcggctcggcttcaaagccggccggccggccatggctagaggcggcggcgtgcacgaccaccggcggcgaccggtggcggcggacggcgcaaaggcggcagcgcacagctggagcaacggcgcggccaaaagcgacggcgcacgcgggaaggggaaggaaaggaagggggagggagtcctcaccagagagggcggcggcgaccggcggcggaaaacgagggaggcggcgaagtccggcgatgccgaggtgcggacgagcgacggcgacaccttaggggaggggaggaaaggat

SEQ ID NO: 37916 - DNA, 3640 bp, Oryza sativa
aattagggcgaaggaaaaaaccccacggcgggcggtccatgttggctggagttgaaggggaaaggggactcaccggcgacgcgagggaaatggggtctcggtgggattccggtgacgcaaggcggcggttgggaaagatcttgtggcggcgaagctagtggtggcggcggcttagcgcggcggtggcacgcggctggagtgcggtggcaagcggcggcgctggcggagagcggcgcgagctcggtaggaagcacgggagggagcggcgagagcggaaagggaaagaggaggctcgggggagcgatttataggtgcgggacgggtggaaacggccgggaaagcctcctatttgaccggcgacgtggggtggagagagagataatggggggattcaaaatgcgaatcccgccccttgcgagcgcgcgcgggccgggagacgcgggggagagggcggcgacgtgggaaggacgcgggggcggcgcggcgtgggcgcgggaggagcggaggaggtgggcgcggcggtttcggcggcggttgccgacgtcgggcgggcggccgggggaaggggacgaccccgactggtgggacccacctgtcggcgtcccggagagagagggaggggcggcttgggccggcccacaaggaggaaaagggcgcgcgcggcggcgggcggactgggccgacggcccaagaagaggaaaaaggagggaaaagaaaaagaaaaggaagaaaggatttttcctgatttaaaattgcatgtgctcaattttaattggttaaaattatttctagggctctcaaaattccactaaaaatcttgttagcaaatttcgacatgtagaactcaagaaaaattctaatgccaattccgattattatttgcattggtttattagggtttactcttgcttttacaccgatattttcttgggaccatttataaattcaatttaggcttaggaggagaacttcagggtgtgacatacgggcacctcaacttcgacgctctccgctcactggcgagccgcggcatggtgcgcggcattcccactctggagcgggttaccaaggtctgcgacggctgcctaataagcaagcagcgacgagcgccgttcccaacggcggcattgcatcgcgccactatccatcttgatctggtgcacggggacatctgtggacccatcacatcgtcgacacatggcagtaaaaaatacttcctacttctgattgatgatctaactcgctacatgtggttgtttctgttaacatcaaaaagcgaggctcccgctaccatcaagcggttcaaggcaggagtggaggtggagaccggctgcaagctgcgcgttctccacactgatcgaggaggggaattcacctctgtcgagttcgggctatactgcacgaacgaaggcgtcgccaggcagctaacgacgccatactctccacagcaaaacagcgtcatcgagcaccgcaaccaaacggttgtggccatggccagatgcatgatgaaggccaagaacatgccgggggagttctagggcgaggcggtcaccactgccgtctacatcctcaaccgggcgccgacaaagagcgtccgcgacaagacaccgttcgagtcatggcacggtcaaacacctgttgtgcactactttcacacatttggctgcgtcgtctacgtcaaggaggtgaaaccacacatcaagaacttgatgatcggagcaaggtgatggtctttctcggctacgagccgggttcaaaggcatatcgtatatacgacccggtggccaagcgcatcgtcgtgagccgtgacgccgtgttcgatgaggcggcatcatggccatgggcgtcacccggggaggaggacgggggaacgtctcctcaggaaaccttcaccgtgcgctacgaggtagtggcggtggacgtgccgtcccgccactccgactccatgtcgtcgccggctcacatgggaacaccagtgccatcaatctctgcgtcaccgggtgtcctagcggtggagtttgtgtcgctgcctgcggaaacacctgatgtcgacgacgacagcacagggccacgtcgtttttggatggtggccaaaatccttgacactacctcgccaattgagctcgactccgacgagcttcatgtggctgctgccgaggaaccaagcaaccacgctgaggcggcacaggacgcactctggatgcgagcgatgcaggagtaactcaagtccatcgaggagaacaacacgtggactctcgctgatctccctgctgacaagcgtcccattggcctgaaatgggtgttcaagctcaagaaggacgagacgggcgcaattgtcaagcacaaggcccgcctggtcgctaagggttacgttcagcggcaggggattgatttcgacgaagtattcgcccctgtcgccagaatggaatccgtgcggctgctactcgccattgcagctcaccttgggtcgtctgtgcatcacatgaatgtgaagtcagccttcctgaacggagagctagaggaggaggtgtacgtcgcccagccactaggcttcatcgacgacaagcacccacatcaagtcctgcgcctaaacagagcactttatggtctgcgtcaagctcctcgtgcctggaacgcgaagctggatgttagtcttcatgaactcgggttcacacggggcatcacagaacatgctgtgtacacgcgcgggaccgggaacgcgcggctaattatcggcatatacgtcgacgatctcatcatcaccggcgctcactctaaaacaattcagagtttcaaggaggagatgcactccctattccggatgagtgatcttggattactcagctactacctcggcatcgaggttcatcaaggcaacgatgggatcacaataaaccaatccacttatgcgcagaagcttttgaagatgggtggcctggcggcttcagcttccgttccaatggaacccagattgaaactgacgaagaacagcgatcgaccaagtgttgattcaaccttttatcgcggcttagtggggagtttgcggtacctggtgcattcacggccagacattgctttcgcggtgggttacgtcagccgattcatggagtcaccgcgcaatgatcatctcacggcggtgaagcacattctgcgctatgttgcaggtactatgaactatggttgcaaatttgtaaattcaggagaagagggaatccatttgctaggattttctgacagtgatttggggggagatgcgcacgatcggaagagtacctgtggtgctctcttcttcctcggctcaagcccgattgtatggcagtcccagaagcagaaagtggtcgctctttcctccagtaaagctgaatatatcgccgccactggagcagcgtgtctcggcatatggctggctcgattgctagctgaggtgctgggaagtgatccagggaaggctctcctcaaggtcgacaacaagtcggcgatctccctgtgcaagaatccggttttccatgaccggagtaaacacatcgatacaaggtaccactttatcaggcaatgcattgaggagaaaaagttgaggtggagttcgttccttcggacgaataggttgccgacattctcacgaagccactcggacgaatca

SEQ ID NO: 37917 - DNA, 4291 bp, Oryza sativa
attcctgcagcccataagcaatcggtgtaccgtggtgatgatgtgtagtaccaacatgcatgattgtcgtcgagtcttcaaagtcatgtataacttgcacggttggagtaggtgtgcatttggaagttttatggagtatgctgacaagtaaagtcaaggatggccgtcagtgccttcatgagctagctactcccttctcccttcatctcattttatctgcagccataagttttcgtgccaaacttagatcatatgtcttatttaaattttttttataattaatatttttattgttatgagataataaaacatgaatggttctttatacgtcacttatgtttttaatttttttattttttttaaataagacggatggtcaaagttgtgtataaaaaatcatagttgcacttaaaataggacggagggaatagcatatagcagccggttgcattaatattgcattcttgcgcggcaattacattgtgaagtcagcactcttgccatattagtctaggaggactcaaaataagtccaagtcaatgacgacgaagccgctcaaaaaaaattcgtcgatggcgaatatatatgacgataaaattgtatttttgtttatttggctcaaaatggataggttgttgggttggaatttcctacggcataacggagcgagataagtcattagtacaggattagttgaatattaattattataaaattaaggatatgttcatattatagccaaaatatgccttatcaaattttggcaatgctaaaattttggcacatgatttcttatgtatttatgaaatttagcaacaaactaaacatagatatttttttaacaattttgtaaaaaaaatggtatggttgaaaatggtatcaatctgaatagcccttgatattgtttgtttgatcttttagaaatttctacgcagaaaacttttatataaaacacacagtttaatatatacttaaaagagtgtgcttatgatgaacgaggagtcgttccccaattgcctaaacgaacttagtcgaagccactgcaaaatttgtccatggccagtgtaatgataaaaatgcatgtacgcgtttatttgttttattttgtaacagtgttatacggttggagactgagagggatattcgacaagcatattgaatgagaaggcctcttaatttctcacagtattttccacatagatcgaagtagtagtatatttcctactgcatatgtgaaagaggcaaagtttatttctgaacctccgacatcgttacaagcaaccatagtttaaagctaatctcaaaggtcttcgaaccatgtgaaataccctcttccggtcttccctcaaaccataatgggtgtttagttatttggatgtaaagtttgtaagtatacggacgcatatttaaaatattaaatatagactaatgataaaacaaattacagattccgtctgtaaactacgagataaatttattaagcctaattaattcatcagtagcaaatgtttactgtagcatcacattatcaaatcatgacgtaattaggcttaaaggattcatcttgcgatttacatgcaaaccgtgcaattagtttttttcccacatttaatactacatacatgtgtcaaacatttgatgtgacgtttttagccaaaatttttaagatctaaacaaggcaaatggtttttactaaagctcatatggtaccgaagtataaaagtacttttacattatgtcatataaaataaaaaatatatcatacgtgttgatgtgttcaaggatgcggccgatatactttttccccttgctcccttttcactcaaacatgttggactccgacggaataagcgaaacgatatatttaacgaaaaataatttgtaaataaaatttttatacatgtgtttttagtgttctaaaagtaaaactaaaggctgaaaaataaactataataaaaaaaatctaaaatcagctctaaattttaagttgaaaatttaaattttggcttataaacataagcataagccaaaagatggggctgataatatacggagtattatcatcaacatacttctcaaactcgtagatggatttattttcatactacctccatcccaaaataagtgcagttttgcactattcacgttcaacgtttgaccgtccgtcttatttgaaaaattgtgaaaaaattaaaaacatttagtcacacataaagtactattcatattttatcatctaatagcaataaaaatattaatcataaaaaattttcaaataagacggacggtcaaacgttgaacatgaatagtgcaaaactacacttattttgggacggagggagtagtattttaaagcaacatttcaacctcgtagtagttaattattttttaacaagctatatagtcacgcatatacttaattgatgatgtggctcaatcaggttggaagaaaggttatttctttcattactttagattccctaatgaaatattgtattcttaaataaagtttgaggtttcttattttcttttgttagtgtaacttttttgaggttctccgcccgtcatgctgcaccacctactactagtctaccacgcctttcaactgttgacttttgcagctgttgtggtgtcttgtgtcagtggctgcaacataggagtacaggtttatggccagggttcacggaactcatcatcgtgaaaccgttacatctcggtttgtcaaaatcgatccgtattagtattagacggttttttaggggttttgtacggtgttgaccaaaacttacggtttttttgttaagaaactacgggtgatctcatccacccaaggaaataggaacaacggttcctaaactaactagcagagaagaggagatcgctcctctctctccctttggcgtccctctcgacaaccgacgcgatgttcccaaacaccgcgtcccttgcggttgacaccgcttcacattgtataaattaactgttgatcaatgagaaatccatcgattcgctctacttgtgttcaattctctctctcgctcaatctctctcgctcaatcatttctatccacatttaacatgttatcagcactttcgctctcgcgaaggagatcgcgaagtgaaaggaagaaacatcgcttttgatctaacagaaaagcgaacagaagaatcaactgagaaggtacgatgcctacctttcattggattatggatgccgttctcggcctttctcgcaatcagcgcgctcgtcgccttccccatcttctccatcgatcggagaggagtcgccgccgccaccacggccgccaccaacaccatgaacgtcgggctagggctggtggccgacgccaccaccctcgccgacgcatcgtggtggccgctactccggttgctcctcctccgcctccatctccggtagccgcagtgcctcgccgtatctgtgtgcaaggggtgcagtactgcgcccaccacggatggacggcagtggtgactctgcccggcgagccatgcgatctttccccggagatggagtcgctgccgccaccatcaaccgctgcttcaccagccctaccgaccccaagccgacgccgacgccgttcccccactcccgcgccaccggggtccggttggaccggtaccatggctgcgcgcacgggggagccgccattcttcaatccgtcctcgtctcgtcgtcatgccagcgaagccgccgctcgccgtcccggcctccgccacaccttcatcgccgttccccatggctctcctagccgtacactccctaacggggtgccggggaatggcgtcggggctcggccggtttccgactccgatgaggatcgggagccgtcggcctaatccggccggccaaccgccggcggacggaggggcggccgaggcggcggtggatggtggatggcgatggcgatgggcggcagatggtggatgcaggagatggcggcgtgtggcggcggtggaaatggaggcggcggcggcgacgcatcttgatgcggcggcggcgcgtcccgcgtcgaagctgcacagggaaatggcgacgacggacggcgcagcgacggcaggggaagggcacggtggacaggcgacagcggctccgacggcggcatcggcaacggaaaggcgacggcggcggcggcggcggcagaaatcccgcgagggggcagttaagggttctaaccctaactcccccccgacgcccccctgtgccctttttgctgtcgggcctaatgggccgcgccctacgccccgctgccccttgttggccggcccaataccg

SEQ ID NO: 37918 - DNA, 6344 bp, Oryza sativa
  unsure (1)..(6344): unsure at all n locations
cccatttaccccttaaatttagtttttatttttttattttatttgcagcaacaatttcactttagtccctatgttttatgtaatttagtcgaaacagttcatcagttgtacaaacaattatgtaatggtcctatagaccactgatgttatgtgtttattaacataggtgtttatttaaatactctgtttcactaaatttattgttgtcttaataacatgtcttttgcatattattttaagacacgctctactttctcgctttattaatttacaaaattctataaattttgtattttgatttagcaaattcttttaattatgtccaacataattaatggaggatttaatgcatgttccacttcacactttgacttagaaattaatcacatgtcgatggagtcctatactttggtcatatcgaccataacttaggcagcgagtatctcgcccatcataaagtggtctacattttgagatgattacccgatggagtcctagaaattggccgcactggtcataacttaggcggcgagcacctcgcccatctcacagaggtctacatctcacgattattacccacatgtgttcttttccaagaatatgttttgagaaatgagattatttgaaatttggttgaacacaaggtagtggagtcctaaacattggctgcggtatattcaccagaatatatttgcctggagaccgtgttttaggcagcaagtataacttgcccactattaagagatctactccactgtttaattacttagagattatccacattgtgccacctaatttcgaattctaactcaaaattgtcaggtccataacctacatctttcgaaacattacagaatatgaagttttacatttcgcattgagattacacccttaatatcatgtttttattaatttacctctgtaaattgataatgttaaccatgattgtagggacatggcaacaaaagagttcgacgaactcgcctcgatgggactaactatcccatctgggcttctgatatcaaaatcaattttgcctctcgggagattctaaatacaattgaggagcctaatgatggggatccggcaattgagcccaggaagctcaatacagccctttttcttttgagactctacattcacaaggatctcaaacatgaatacatgttagagacgagccctctcaacctttggaaagctctaaaagagcgttatgatcagcaaaaggaactcatttggcctaaggctaattatgagtgggttcatttatgcctacaggactttcaaactgtggcagaatacaatcatgctgttcataacatttgttccaggttgaagttttgcgaacaagagccaacggaggcagagaagatagagaaaactctatcaactatacttccggaggacaggatactgactcaacagtatcgcgctaacaattttcagaaacattctctgcttatacatacattgactcaggcagaaaggcaccctgagctttctttaaagaatgcccaacagcgcccaccgggctctgctccactgcctgaggtgcacttcaatgtatagaataatgctgagaataagaaaggattcaagggaaattcttcgaataatcctaagaatctgactggaaagcgcaaacgcaccaacaacaggcgcaaattcaagggtcgaaagaaaggaaaagggaagggtaaggcaccacaacctcgtagcaataccaacaagcattgcaacaggtgtggatctgacactcatgtcgctaaagactgccgcatcccgaaacatcttgtcctcttgtaccaaaaatccctcaaggacaaaaaatcttctgagaacccaagatttgaagcacacttcaatctcacacatgaagagcaccctgaggttgcaagttctcaccaggctcctgctgaaccagagagcaacctcaatgttctcccagaagatgtcgctccactctctacgatggacgatatgttcatcgaatactgctcaacggacccacttggagatttgcaatgatctcggtgcgtcccacttggagatgaagctgcccttatctcagtgtgattgaaacagtatattgatatcctataagtttgccaaataatattggttgtaataagtagataagtacgaactcccttgtattgtaaggttgtatggcttgctagtcattagagtatgtactattaacatatgtaaacgtcatactatgtatttgatgttttaattattgtatgtatgtatatatattggataaagaattcttaatcatgcaattcttctttcattatagatgtctaaggatatcgctccgattggagaggaattatgtcttgtggacagtggtaccacaaactctatacttagggagatcaaatactttcaaactctcaaaaagagagaaggcaaagttttgactatcgctgggagcgatactgtgatagttggctcaggacgagcaattattacactcccaatgggtacacaaattacaatcgaggatgctttattgtatcctgattcaacccgtaccctactaagttatagagatatccgtcaaaatgggtttcacattgaaactcatatggataatcgagaagaatttcttctcttaacgaaacaaaacggatatggcaaacgcatttgcgagaaaattccatctctcacatcgggattgtactatacatacattaagcccattgcacatgttgcgtacaaagtaatttttcaaaatgttgatgcattccacacttggcatgatcgacttgggcaccccggtatcgggatgatgagaaaaattattggcaactctattggtcatcatttgatcactgacaaatttcccaaatcctctgatttcgtatgcactgcatgtgctactgggaaactgattttgagaccatcttatctcaaaatcagagccgaaccacttaaattccttgaatgcattcaaggagatatctgtggccctattgtgccaagatcttgaccgttcaggtactttatggttttgattgacgcatctactagatggtctcatgtgtgtcttgtatcgacacgaaaccatgcctttgccaaattgatgtcacaaattataaggctgaaggcaaattaccctgaacataggattcaatcaatccgtatggacaacgctgccgaatttacatctcatgctttcgatgattattgtatggcattgggaattcaggttcagcactctgttccatatgtccacacaaaaaatggtttggctgaatcattgatcaaaagaattaagcttattgctcgaccattattgatgaattgcaaattaccttcgtcgtgttggggtcatgcagttctgcacgctgctgaccttgtctaactacgaccaactgcatatcatgaaacttccccaatgcagttagtacgtggaaatcctccaagtatttcccatttgcgtaagttcggatgtgctatatacataccgatctcaccaccatagcgtaccgctatgggcccacacaggaaagtgggggtctatgtgggattcaaatctccgtcgatcataaagtatttagaaccctaaacaggttatctatttattgcccggttcgctgactctatctttgatgaggaacattttccggcattagggggagaattcaagtaccagaaagaatgccaggaaattgattgggatgcccagggtattccagtctcagacccacgtactactgaagctgaacttcaagttcagaaaattatacatttgcaaagacttgcaaataacctgccagatgcatttaccaattttaaaggtgtgactaaatctttcattcccgctcagaatgcgccagaaagagtggaggtaccaaataaaaccactcaacttccactcactaaaaagagaggaagaagtatggccactcagcgagaaacaattgctaataagcaaagaaagacggtaaatgcaaaccaacctttagttggtacacaccaaattgatactatatgtcaagcagatcatgatagtctgcaacctagctcggtggtgcacaatgctgagactaggaattcggaagaccatagacacattgtttcgggagatcacaatgagtctataagggttgatgaaattgccatcaattactctgaaactagagaatcttttgatagaagagctacaattgtcgacactaatttttctgaacaaattgctgaatgcctccaagttgatccagaacctaggtctataaaagagtgccaaaagcgctttgactggaacaaatggaaggacgcaattgacatagaattagcctcgctttacaaaagagatgtattctcggctgtaatgcctactcctcgtggtatcttccctatgggatacaaatgggtttttgtccggaaacggaacgaaaacaacgaggtggtgagatataaagcaaggcttgtagcacaaggttttacgcaaaaacctggcgttgatttcaatgaaacttactctccagttatgagtggtataactttccgatatttaatatcattggcagtacaaaatcgtctatttatacagtagatggacgtagtgacagcatatctttatgggtcacttgattctgatatttacatgaaggttcctggtggaatcgacatcccgaatcagaaggtaaatcgtaacatgtattgtgttaagttgcagaagtcactttatggcttaaaacaatcgggcaggatgtgatacaaccgattaagtgaattcctttcgctaaagggatacactaaaaatgatgattgcccgtgcgtctttatcaaaaagtcccccacaggattttgtattatttcggtatatgtcgatgatctcagcatcattggcaatacacaagatattaatgaagcacgtcatcatttaaagacggaatttgaaatgaaggatttgggtcaaaccaaattttgcttaggtctacaacttgagcatttaccttctggaatccttgtgcaccaaagtgcatatacccagaaaattttggagaaatttaatatggacaagtcatatccttccaaaatccctatggtggttcgatctctagacgtggagaaagatccatttagaccaaaggaagatggagaggatgtacttggtcctgattttccatatcttagtgctattggcgcacttatgtaccttgcaaatagtacaaggccagatattgctttctcggttaatctattagcaagatatagcgctgctcctaccaaacaccattggactggagttaagaatgtctttcgatatcttaatggcacaagagatcttggacttttctttaaaaagaaccaggattcgactttaattgggtatactgatgctagctatctatctgatccccacaacgccagatcacaaacaggattcgtatttttacagggtggaactgctatttcatggaagtcttctaaacagactctggtagccacttccacaaatcattctgaaataattgcattatatgaggcgtcacgtgaatgtgtatggcttcgcagaatggttaaccacatattaacatcttgtggtattggttcattggaatcacctaccattatctatgaagataatgccgcttgtgttgttcagatgaaaactggttatattaagagcaacatcactaagcatattgctcctaaattattttatcctcatgagcttcagcaacatggagagataaatatcttgcaaactaagtcatgtgataatcttgctgatttattcacaaaatctctaccatactccacattctttaaatatgtcgaaggaattggtatgagacgacttaaaaatttgcaggattcaaggggagtatcttcctctggaaaataacctattttcgtgatattatactctttttcctttgtatgagttttaccctttaggttttctcatccaaagtttttaacgagataatatcaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37919 - DNA, 510 bp, Oryza sativa
ttgcagtaaacagcatttaaagatacttagttgctcaaagctattttgtaaacacgattctagaactatacaatattatttatcaaggccgtgaacccacacgaacctgccttaacccaaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacatgcaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccga

SEQ ID NO: 37920 - DNA, 1305 bp, Oryza sativa
atgaggccgtagctggcgtgaggcataggccaccacatgaccatcctgcatgagcacgcaccccaatccttggcgcgaagcgtcacaatacaccatgaaatccttgcgagtatccggcaagattaacactagcgaggaaaccagcttttctttgagagttttgaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgactctcttgggttgcttccaatcggtaacggcggtcactgtttcggggtccacagcaactcctttagcagatatcacgtgccctaagaatttgacttcggacaaccagaactcacacttgctaagtttggcatacaattgatgttcccgcaactttcccaataccagacggagatggtgctgatggtcttcctcggattgtgagtatatcagaatgtcatcaatgaaaaccacaacaaacttatccaagtattccatgaacactttgttcattaagttcatgaaaaaggcaggtgcattggttaaaccgaatgacatcaccgtgaattcatacagtccgtatcgcgtggtgaatgcggtcttcggaatatcttcttccctaatgcgcaactggtgatatccggaacgaagatcaatcttggagaatacagtggcacctttaagctgatcgaacagatcatcgatccggggaagagggtacttgttcttgatggtgacttcattgagagctctgtagtcaacgcacatcctcttcgtcttgtctttcttctccacaaaaatcacaggagcaccccagggggaagtactcggacgtatataccccttttctttcaactcttccaactatttcttgacttcggccaattcatttgctgccatacggtagggtcgcttgtacagaggagtggttcctggagcaagatctatccggaactcaatctctcgcttgggcggcataccgggtagttcttccggaaacacgtctccgaactctctgacgatggggatttctgacagtcctatctgatggagttctgaactactgacagaggttgggggtgcaaagaaaacaaccggttgttccggctctcggtacagagtgacagtgcgtctcgcacaatccaccactccttggaattgagccaaccaattcatcccaaggatcacatccaagttcttggtgtctagcagaatcagatccgagggaaaaggaatcccctg

SEQ ID NO: 37921 - DNA, 2003 bp, Oryza sativa
tcgacgaagcaggtccacgccagggactgacgaacaagctcgggcctggaggtgctcttgcgggcggtgatcttctggctgcggcagacgcggcgacgcttggggcgacagacctctccctgggcgatcttgagctgatgcagctgcgcctccaccgcgtctaggtccttcttgagctgcaggttctcttgacgcagctccaggatcttcatgttgttctcgaccatcccacggcgcaccatctgatggaagtcgatacgagccgcgtcgtacgcctccaccatgcgcgctaggtgcatgatggtagcgtcatcctccgagctagcatcccggaaggtggcgtagtcgcgggctcctccgcggcgagggtggtagcggtagggcgagtgctgcaactcgtccgggtagcgctggtgaagagtgccgatggcgaggagagcggcgctctagcaagcggcggggaaagaatctccacccgcggtgactgccagcgaagtccgctcgggagagccggcgaggatcactgcagtgacctcccaagcagcgtggggctctgcttcgtcaccctcctgctccggaagcggcctgccctggtagtccactccatgtggataccccaggacaacgcacatgccccgcagctccaagacgaaaccagtcatgtccaaaccacgacgggtgacgctaccggccatctacaaacaaaaacaaaaagaaaagcaacatttaaaaaaaaatcagattttggcgataaatgaagcagcaagacagagaaagactagagggttttcacaaataacagaggatttttatttcgaaaatactgcaaaggcttgggatctacggctcgtcctagggtcaagggggctctgataccaacttgtcacgaccggaaataacccaacgggcgttccttacgtgcgtgcattaatccttgtcccaggaggcaaggtacaccaaaagttgatacaattcagagtttaacaagcggaagcgtaaatagttaatctattacatgggcagcgaaggcccagcacacacaaagacaaacgagaaacagcggaagactagggcgacgaccacaggcacttgacggcaggcacgagctagacaccgaagccttcatcctccaggaactcctcttctgggtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcagggctattttgcaaacacgattctagtactatgcaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcagattttaagaattaaaacactaacttgggtacattgctcggcttggacataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagatgtccatcgacccccgacttcttccatctccatccgtgtacttttgtttataactagactgagccacaaactaagccttacccactagacatgtggaagtacggtagtgctttgcaacagaggcccgaagaccggtccttatatggccgaggtgctactatcaaaacca

SEQ ID NO: 37922 - DNA, 918 bp, Oryza sativa
tgtactgtctcatttgggacatccgtggacattgtcacacgattcttgaaccattcgttgaaccgagaattatgttctctgttaatccatgcatcagatcgccccaagttctcatctcggattttcgctttttgctcctcaaagtatgggacaacttctgccatatgttggagcacagcataatgagcctgcacgtacgacgcttgatcgggcctaattcttttccttccaattgtgccaacacctgacaaccttccctcgtgacgagacgctggaactccgataggatcggcatcggacatgtaattgacacagaactcaatagcctcctcggtcgtgtaacctttaatgatgctcccctcgggtttagctctgctacgaatgtacgactttagaactcccatgtacctttcaaacggccacatttcccttagaaaagccggaccacatagttttgtttgcttcaccagatgaacagagagatgaaccattatatcaaagaaagacagtgggaaaaacatctccaggtgacagagggtattcacaatatcggtctgcagcccatctagatcttcaggatctataaccttctgtccaattgcattgaagaaggcgcacagacgttggatcgtgtgacgcactttcggtggtagaatgcctctgatagcaactggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatcctccgacagtgtgtggcaggctggagggaggtacactctacctatctctgcatctcgtttgggctggagttcgctgcgaatattcatgtcctgt

SEQ ID NO: 37923 - DNA, 9730 bp, Oryza sativa
atcaaacatattctcattcttgcaatctgcacatggacaacaaatgtaatcactgtttacttcttatccgatcctcctccgcggcgttcataaaatttattacgccctttcggtactccgtacaatgacgtttcaattttttggcatacatccaacttcgatcaattgctaaaaaaaacaaattagaggcacatattataagatcagtattgcaaaagtaagatgtgatgaaattgctcaattaatgatttatattactcacttgattgatccattttgatcacttttgggaatttaatttctgttttccttggaaaaaggacaaaaaatcgccccctacagcctcccaccaaaatagtgaacagtgggatacagttacactaggtggtggggggtatttatactgtgcaacaaatatctgtaacggccctaaaacaatcaaccatgacgggcatacaagtaatctctatcgggccttaataaaaggccgtcaaaaaagagtgtcatctgtgacgggcaataaacttatctcaatcgggcctctagttggagcccgtcacagatgaccctcatctgtgacgggcttcttttagggcccgattgagatatggtaccctcatctcaatcgggcctcaactatagcccgtcacagataagtgtcatccgtgatgggctttagttttatgccgatataccatggctgtgcgaccatatctcaatcgggcgaaacttcggcccgattgaaattacttccttgtgacggcccgcaaattccagtcttgttatgggccgtcacagatggaaggatctgtactagtgtaaggtagcccaagtggcgaatccaggataaaaattgaggataggctggactagaagtctaaatttaagttgataatgctaaaataaggcacatgccattatcaattcaaatgtaacacttacatgatttaatagaaaaatatacttataaaagaataccttgagtccttgacttaagatgctaattttcttgggccttagcaaagagtaaagtgagcagccacctgaatatataaatgagcaaaattagtattgcataaatggtagaagtaaacaaatgctaactaaaagaagcaacataccacataccactaagctgttacaatttattcacgaggaaaggatattttgggggttttcaaggcttggaatcgcttcatgattgcattatcatcaatacttttgaatatctctcgctcagtatagcataccatcaaatcattaagccaatcgtctgatatcttattggcaatcgcacgccgtcgacggctcgacgccaaaaaaaacggaaaaagtacaccgaaggtccctcaacttatcatcgagttacaaaatcattcctcaactgcaaaaccagatatccggtgccccttaactaatcaaaaccggtcacaataggtctttcggcggttttgaccctggttttattctatgtggcggctgagtcagcgtgggaccaacatgggacccatatgtctggctaccacctcagcctcctctctctctctcttcccctcttctctcccttcctcatctctctctcccttctttgactcagccggtgagaggacgagggcatcggcggccggccacgggcgatgcagcggtggtgaggggaggagctgtgggcgggcggtgggagaggggcagcgcacaggtgggcggtggaagcggggacgtccacctcagtggtagcggccgcatgctcatttcggcggtggcatggaggtccctggcgacgacgaattccgacttcgccgcagggctctcgctgacgctcgctgcgtctctcggagacgcagctcggcgagctccatgtcttgccgtgctcgtgccttctcggcttgcgccttctccaagcttcgtcttagctcatcaagaaggcgcattggtgccgcctaggtccttcaccgcatgtgccttgccggcctccgcttcttctgatctcttgtggcactcggtggcctcatcctgcaccaggtcaagctcaccctgcacttgtttgtgcctctgcacgcagcagtcgacactagaaacgggcaaatcacaagaaaatcaaaatgctaatcactgtctaagcttaaccacaagacaagatcagtagcaatggagatcgatgtaatttacttctctccaatcaacagttcatccgaacttggtaacggcgcccttgacggaatcgatgggcgcagtacggtgtcgatgttcttttgatttcttgttaaatatgtgatccgaattttgggcccacaatatattcggattagtttcctagtagcactttatgtctatcctattaggtgtctttcttttatcccctatatatactcttgtaagccgtacaggaaggggtgacgttcccattgttattcccctacgtttgtaatcaactcctctataatgatgattgccagtcggcgcccgtggttttttcccgtaagggttttccacgtaaaatttgtgtctccgttgtgcatcgatttttataacatctctgaacgaagcgattgtcgatctccgacgccgtcgccgggggccgaccgcctataggcggccacacgcggccatggccgaagcaccacgttcaggtactccaagaactcaccctccatctcatcaaacgaattcgccacggcgccccaagcttaggaattgagcaggaagctttcccgcatgagctcctactgtggatcgcatgagtccgtggtgccgccgccgcgttattccggagggaaatactatgtaaccgcgtccgtgtcgccaccggccgccggacctcctcccacctcgctccagtgaccttctccccacccgccagccggattgcccggagaagagaaaaagttagagagagagagaggaggaaggaaggggagggggaaaagagagggtgctgaatcctaacatgtggggctcacgtgggtcccacgctgactcagctgccacgtcggataaaaccggggtcaaaaccatttaaggacattaagtgaacggttttgtaagttgagagatgtcatatatatggttttatggttagggacgattttgtaactcgatgacaagttgagggaccttcggtgtactttttccacaaaaaaaaatccccacagggcaaagccaaggccagcagccacgcccacgcagcctccagactccaaaaccctaagtcaatggataaaatagacaaatgggccaagtgggcttttgctaaagtgataaatgggccattttatgcatactgcgtaccggttcagctacctccatcgctcctgatcttcttcctcgcgccaacagagacagttcttcacctcttctcttctccaagccttctccagctactcccatgggatagatgctatataattaattttttttttgcaaaaatcagatggtaggctcgagcctgatgaagcctacctcttggatccgtcctgcatgaagggtgaaggctggttgaagcgcgtgaaacgaggtgttgaggcggagcaactgcggccttacatgctaccggtggggagggttaacctggtggcctttgccagatatggctaccacatcatcggctagagcattgcttggtgcctcgtcgccgcccccacaactagtgctgcatcgtcaccactacctcctcgacacccctagttggcgtcgcctcgtcttgccttcccgtcgctgccacaggccgcagccgacgccctcagcccacctcctcgccgccatggctgctgtcaagcttacggataaggcatgcctcctatcctacgactcatcgaatatacgccctcagcccacctcctcgccgccatggctgctgtcaagcttacggataaggcatgcctcctatcctacgactcatcgaatatacatatacggtataccttcgcgcattcggttcgttcacgtatacattaagaaagtttatctctaattatggaaaatatctccacgagtcaagtgatttccaaagttctacttggagaggataaggtttatgttatatcgtaccagatccgatgtctcgaggtttgacttagagattaagatgatccacgctataaaaggaacccctaggcgtgggtggaagagatcgaccaaaaccgccaacacacccatcatagtttacgaagccggagtactcggagccaagtggccgtgagatctcgttgatccccatcgattacaatctcgtcggaatcgtcagtttcgtctacttctttgtaatatgtggtattttcatataatcccatactaactggactagggctattacccatcgaggggcctgaaccagtataatctgtctcttttgcttgtttgatgtcatacaacgcaaatccctgttccaacgtaccccaatactcaaatcatccggtccatgagtattactcgtcgacagtgacgcgccaggtagggagggcttggtgcttaaggatctgccaatacaacttcaaaccatcctgacggcagtaccaacaccggcgtcaaccaaggagtttcagcctcgacaccgctggtctggactcatgtcggaaccattgtctttccaatctacaccgctacaccaccacatggcgccacctccgccattcacctcgtcatcaccaccgtgatgccttgatggaggagagactgagtgcaggggagagagaggggaggagggagagaggagaccacagagagagcagggggaagagagaaggtaggagtaggagagttagaatgataggttgggccactttcatttttgtcacgtacgtaagagtctagtcaacatgagtggactaggtcaaattgccatatcagtaaaactaaccttccatactattagaggacttaatctgaactgtttttgtaagttgggggtattgcggtttagggatgcaaattaaattcgagataaaaattacagccggaaagtggacttattcctcgtaacatgcatgcgtccggaatgcaggccggccttctctgatgggttaatctaaactaaactttcaactctccccaggtaattatgaacatgaaagttcttatatttgagtttgaaaattttacaattttagttgaaaattattcgatttgacagttcaataattcgtgtagagagttgtccgagaaatacaaaattttatggataattaccttaattaccatttcgaggagaaaatctgttcaaattgatttgccgaaaactgagaaaaaccagtggaaaccaaacgacatttatagggataccaactaaaacggctcggttttataaggaataagttcatctgaggtcccttaacttgtcaacgaatccgattttcgtccctcaactgaaaaaccatacacaatgagtccctcaactatcataaccggtacagatgaggtccctcggtggttttgatgacggttttggttaacgtgacatctacatggctaatttgactcggttttcatctgacgcgacgcttatgtggcaattcgatccagaaaaataataaaacccgtgggacccgcatgtcagtttcacacacgaaataataaaaaaaatcgtaggacctgcgtgagccccacatgtcatcctcactcctccctcctctctctattctctctctcccctcctctctatccgttctctctctccgaccgatggagcagggcgagcggcggctggcaaaagcgggcgacaggcgggacggagcggctggccggtggagcagggcggggctgcatcgggcgtcgcgacggacctcgccgcggggccggggctagccgccgccgccgccggcaatccgaatgacgatgggggagatggaggccgccatcgccgccctccccgcgaagaaggaggcgctgcaggagaatggctggccgcagggaatcctccagttcacccacggcgctgcttctgcttctgctgttgctgtttctgcatcatcttgccctgttaaaaagacacagtgcccttgttctttcgcaattgcaactagcatctccttctctacttctactcacttcacacctcagctcagctcatctcctgtcatctcagctcagctcagctcagagagagagagagagagctgcaggtgtgagctgatcaccaggaagcagaggcttttttcagattacagttatatatctgaaacaaccagattcagaatcaatcagcaaaggtagatggagtttcttgtttcttttgtactactacatgactatatccatatctctttttcttctacttcttgtcttttgtttggttttgtgtgttgttgctgtgtgtttcaacaagtcaactggatagatagattcatagatattatagtttttatctgaggttggaggtttcccctctcacccaccacacattttggcaccccaatcctgaatttactgttcagttctcttcttcttctttatcgattgatcgtccatgcatgcatactggtatatagtgctagtgctcaagtgatcatccttcctgatggtgaatctcttttgagaaaagaaaagaagaatatctctcttatcttggctttttcctgatgatctgagcactgcaatggccacgtcgtcatgcagacaggcgccgcggaagccaccgaggccggaaaggacgacgatgatggcgatggcgatggcggaggatgggtcggcgtcgtggtttcagtactcagaggagatgctcctgccgatgccgccgacgcccttctgcacaacgccggcagtcgccgccgtctgcgctctatggccccgcgtgccgcggacctgacctagcccgctgtcccgcgtgtcgatacccgggggggggccggactcaagggattcattctttttcgcactaatggaggacatgaattctgggcaaattatctatgttacagtctattaaaaaaaggacttctaataagaaattcttctgctaaagaataggctcgcctataaatagaagcttcggcgcactctatattttgcgggacaagaaagaaagagtcaaagccatggatatcgctgcaagactatcagcgattcctcaagaaatcgctgatatagaaaacactaagctcgaactagagcaaatgctgggtgtcctcggggagcctttatttctggctttcgtcgatccagcagtgatcatacaagatgatatagttcttgttcagaaccaaatccgcattcttgaaaacaggaagaaggcgctgctggaagaacagcaatcgctcatcgtgatggctgcccaccacggtgactaaaatagaaaaaggtagttactcgtctatctcaacgtaaatgaacgaagtcacttaaggcttcctactactactgctccttcttacttattttccttaaatcataatatctgactatcaatacttgtatataatgaaataaaacatggtgtccaacttagtggtaaggattattactaattatttccactagtgttggtgaaatatgtatatacaggtattttgagaagaaaacacatccgtcgagcgacaaactgcacctctgtgcattcaggatacatttacacgtattggaggccccataagtcaattaaaaaactgcaaatgggcccaaccatcatgccaatgggctgagggtctcaaaattagtgtccaggaggaaaaacaggtccaacggagccctcctgggttcggccgaaccacttatgaggctgttgatcgcgagattcgacgtggacggccctgattacttcctgatggtggttccggggtagcttggttatttcgcataggctgtaacagtcatacctgcctataaaaggaggagcctactctcatttccaacacacaactttgagctgaattacaagagactctattgtatcttttgttcattagaataaggtagagagtgaggggaagctctcgaggagtgcccggaagtttggcgctcatccgacttctacctcgatgagtgtagcttcttaggaggaattccggaggagtaccggagctgtcggtacactctgctccaggttcggagaacttcttctataaagtaagtattcgtgttcctttcttatgttatttaattactttgtctaagtaaaataagatttccatctctgcgggttcattgtttagtatttgtactaagtgctctagtactaggactctggatagagaaggaagttcctgcgcaagtattagagtagtaattaataacttagacgtggtgtctaggttagagattaccttcccacggatttgtcagagataggcggcaggtggtgacagccttaaattccgtcccagtaatcctccatattcggatacatcataaagctatagccggaaccacgctggcagaccagcaggggtcggtgcccgaagcaacagatagaaaattacctttgcttagcttatataattaacactcatagaaagtcctctctagcctacctaccatcagttgttgtccttggatagccttagccttaggtagattatacgcgttccctgagttcgatatccttttggggtcacccgaaggttaagtgctacagtggtattccgtgctcttgcggatttatctgtggacgtaagaaataccaacacccgccgtcggccgctgcccgcccagctcctccccgcgcgacgcccgcttctgccgaccgccgctcgcccctctccatcagccggagagagagaagggatagggagaagaggggagagagaggatcacatgtggagcctacgtgggtcccaccattttttattattttatgtgtggagctgacatgtgggtcccatgggttttattatttttccagattaaattgccacgtaggcgctacatcagtgccacgtcagatgaagaccaagtcaaattagccacgtaggcgccacgtcagctaaaaccgccctcaaaactgccaagggatcttatctgcaccggttttgatagttaagggaccgttgtgtttggttttccagctgagggacggaaatcggattcgtcgacaagttaagagatctcagatgagcttattcgttttttataaaccgatcagtagggtgaacctgtttaacacacaggccgtgaacctggcccaaatccggactctcggcctatccacgtgagtgggtcgcgggattcaggcccttcaaaagaacagatgcctccgttgtagaaaaaatgaaagaaaataagaaaggaagaaacaaagatggtatatatccatttgatcgatggctacgtgtagaaaaaactcgcgtgttaataagaaaaggcatgcaagtccaacctaacacttctcaatccaactatggaataaaactagacttggactagtataaattttccttgctacactagtcaagagtagaaggcgaggccatccacatcatctatggataaattcagctgctccctctgcccgtagtacaagaattttgtctttgcactaatttatcataaaatataaaatgtaaaggctagatttttgtggtcctggcactggatatactattactatagtttctttttcacaaaacaccctcagtattattattttgcccactgtagtatttttttaccatgacttatcgttctgttacattgttaatttttttttcaaaatggtataatcaacataggaaggagtagctaggccattacccacaaggcaaaatactccgaggatgaagtattagttccttgtacatggtttgtt

SEQ ID NO: 37924 - DNA, 3136 bp, Oryza sativa
attaatggaattagcacaaaacaaatacattaaaatcgttcttgtattaatggaaaatcgtttttcgtttttgtattaacgaaaaatccctagcaccagccacaaatatactggtaaggcttgtgagcgaacattcccccatcgataatctcgcgaatggatctatatatacgaggatgattacaggacgcgccatgaagtagtattgttctattcccaattttccatttcttttcacatgatcctcctatacatatcaagcttttttgttttttccgcttccttttttcatatttatttctttcgttagtcttttttatagttttattaatggaatttttaatatgaattattttttatagttttattaatggaatttttaatatgaattatttttttatagttttattaatggaatttttaatacaaattatttttgtggatacttagaatttagcaagaaaaaaactttaaattaccaacgaaaaatccttagcaccagcaacaaatacatcggtagggcttgtgagtgaactttcacccaccgataatctcgcaaacggatctatacgaggatgattagaggatgaaccatgaagtggtattgttctattcccagttttccatttcttttcacgtgatcctcctatacatataaaccttttttgttttttccacttcctttttttcatatttctttcttttgttagtcttttttatagttctattaatggaattttttaatatgaattatttttgtggagactttcttcatacattaactttatatatgcgaagcccaaaatatagactttacatatatagagtttctatatagattttatgtatatgaactttcaatatatagactttatatataaaatgtttctatatagacttcatgtccataataaaatttatatttgcaattagaaagtttagtgcataaactttaatagatattaaaaatgctgatcatgcagcacccaatattttttttgaaaaaaagaatccaattgaacgaatctagtaaagtaaaatttgtgtggcagcatggatttggtttataactgaagaaacaaaaaaagtaatcacataattaggcatgaagagatgttatgccatgctagacccaccccaaatacatagcatactcaaaccccactaccatgatatgttttatttcgttgcctgtcacgtggcgtgctgcgactcgacttttttactcatgataatgtaacttttgtggggctaacaacaaatcagtcgaccaataaaaacaatatgatatcgggcgctcgctctttgtacagcttctttcttcttgatttttcctcctctgctgcatgcatgctaatacaacaactttctttttcgtatttcttcatgcatgtgtaactcaacatgtttcttctttttctaatataaacctttctcaaactttaaactatttttaatggtaaattaatgattcaatctgtgacccaattacaccattgtgttctttgatattaaatcgtacaacaagctctcacatgactatatattgaataatatatataccatatttctaattgaaacatttttatattatacttgaaacatttaatatataattattgaaacatcataaaatatttactgaaacatataacaccattacgtgtaacattttaaaatgctctagtgaaatatcataatatatttatttaaacatctaaatacacatgatgtgaaacattagccaaataactattgcaacataaaaaacttaaaaaatatgcaattaacatagtcagtttctaggtgaaacattgacttcaactatcgaaacatgtatattttttcatcgaaatatatttgagtgatatcttattgtaaatatttaattgtgacaaaaataacggtataatcgaataatcgattggataagtaacatatgagataaaatcattttacgaaaacatagggcatccaatgtgaacataacaagggtcataaggttgagttggcagcttgtgactagccttaggttgtgttcggcagcctatgttcccaatacctctcccgcatattctacgcgcgcgcttttcaaacggctaaacagtgtattttttataaaaagtttctatacaagaattgcttaaaaaatcatattgctccatttttgagaaaaaatagctaatacttaattaatcacaagctaatggaccactccgttttctatgcgtaggagatttgttcccatattctccaaatgatctcagccttaaatattgtggaacgtaacaataggccattaaatgctaaagttgaccgtaagcttatggcttggtcacaagagaaaaaaaaaagaataaaagtactgcacaaaggagggagtcaattcattccttgagtaatactacctccgtcctaaaatagttgtcgttttgagttttttttttataatttgtggtcattcgtcttattaaaaaaatatgaaattattatttattttatttgtgacttgctttattatcataagtactttgagtgtaacttattattttttatatttgcattaatttttcatacatgaagaatggccaaacattataagaaaaaagtcaaagtgatcactaattagggatggaggtagtagaagacttcaaagaagcactgtattttgactaagtgggacccatcttatttcctcccataggttttaaccattgtggagtttgttatagctagttctttttcactgagcccgaccgttatattactacccattgttacatgtacattgagaatgcccttacacccaccaataaggttgtctatttgctttgctactccgtagcagtagtactctacagactcattatgcaagcacgcgagcattctggtctccgaattttggtgtcgacctcaggcgaccggacagaagtaatctccaacttttgttggaaattaataattatgtgggacccaactgagaactgtctaactgcgatcaaaatcatcgtggcagtaagtcaagatgcctggttaactaattagggcgtatgaacaagtcatcgtggcagtgcaactgcactgcaaccacgtacggtagcaccattccatggctgtcctcctaaacccttcgtct

SEQ ID NO: 37925 - DNA, 1209 bp, Oryza sativa
atccacctcgtcagccaagacggctcatctcagcgccgccgtggccgcagccggcatagcactgttactcctcgtcctcgccatcaccatcctcattcgccgagcgaggaaacgccgccgacgcgacgacggcgtctcctacgacgactccctcgacgacgacgacgaggaggacatggagtcgggcacggggccacggcgaatcccgtacgcgcagctggcggcggcgacgggcgggttcgcggagatcggcaagctcggggagggtgggtcggggtctgtgtacggcgggcacgtgagggagctcgggcgggacgtggcgatcaaggtgttcacccggggggcgtccatggaagggaggaaggagtacaggtcggaggtgacggtgatcagccggctgcggcaccggaacctggtgcagctgatggggtggtgccatggccgccgccggctgctgctggtgtacgagctggtgcgcaacggcagcctcgacggccacctctacagcaacaaggagaccttgacctggccgctcaggtacgtacgtatgtgcccatgttaccatcgatcaggcgtgttcctaccttgacgaagtggcttttgtggggcccacatcttggccgcatttacgatagcgctgcctgtagattccatcaacagggcaatttggctggactgatgaaaatacattaaccatggatggtgacgtgtccccgagtcccggcgtccgggtgcatgaattatgagtagatgattgctccagtccggcggattgtaccggtaggtaatagtatcggaaggtacaaaatcaaatctagtcgtctaaattgggaaccggaaaagagaatagggaagggtattgaacatttgaagtcactcaaattatagtaatcagtaaatgacagaggagagctgctggatgggagtaaatctcttatgattaacaaggaagggagcccgcccatttacgtgggcatgtatcgtagattgtatttcaaaacactataaggatggaatataaatcagaaaacattttcaaaatataaactgaaaataaagcccgcagagatacactgacatcttatttgttgttcaagaaaaagaatggtaaaataaatcatacatccctatatatatatatatatactgtaagggaatgtaaattttcttacaataaaaaagaaatatatttaccgtaaaatagtggta

SEQ ID NO: 37926 - DNA, 22212 bp, Oryza sativa
ataaatcatacatcactatatatatatatatatatatatatatatatatatatatatatatatatatatatatatatatactgtaagggaatgtaaattttcttacaataaaaaagaaatatatttaccgtaaaatagatggtatattttaatatactactaaatatgataagaataagaatacatctcatatttaaataaaaatcattttgtcgtggtcatatataaactcctctattgttattgttttaaaagctatgtgcatttttaataaatgaaactgtattagtaccactaaaataaattatatattattaatacactaaaaaataatctacactacttaactcgatgttcatcacttatttccacatcatcgactgtatctaccaaagctttcttatataatgccctgaaacattggttccacatcgacgtagccgtgaccctaaagaccagcctatggcaccattttaacacttagttcactatgagcacacccacaaaggattgcattagtaagaatgtcactttagatacattgcctatagtgatcttttactgacgccaccttaactcaaccatatgtatatgcctgtaatatttacgatggcatagtaaacactagacgctgcattgaaggacatggagggacaaaaaggaggaggtgatgaaaatagttataatttttgccccctacttatttttgtatagtattatttttaacaaaatcatagttgaaaggctattgacaacaataagtgccggtgtttatgatttttgttgattagtatttctttccgattttactattaatatattgatatattttttgatttatcgtttttctccgtagtatatgaggtagataattaagttttgtcttttcactggtggagaaaccatctttggtcggtcggcccaattccgtagtatatgaggtagattgatttttagtcccggttatttgaaccgggactaaagatagcgatctttagtcccggattcgtagtcccggttggaaaaccgggactacagggggttatgaaccgggactagaaagcatttctccaccagtgttttctggaaagtgagacgattataaatataggtagtttggttttccatctaataagtgagaaagaaaaaagaaaaaaaaaggaatgatgtgggcccagtgtacgtatcaaagtatggacgtacttgttgtttttgggaatacctatacgtgcacgtactatgcgagtttttgagataaatttaattatattttttataatagatctaatggctagaaataatgggcctatcggattttaaaattttttaaagcgccacatagcgacttaggagtgtttttaggagtgctatgtggcggcttagaagagtttgtaggaagtttaatgaacttttagtatataatagatagatgttgatgattcttgtcctacgagaaccataaactactccatcttagattataattcgttttgaatttgatcaaaatcattttactctaaatttaattaagtttataaacaatataataagacaccaaattattttcattaaatctataattgaatatatttttttaatatatttgtcttatgttaaaaatgttactatttttttataaatttggttaaacttagagtagtttaactttgatcaaaactccttataatttgaaaggtgggagtaattactactgcctctatggctctatcccaattaatcataccctaaaatttgtacgtcttagtttctaaatcgatcattatctaactgttatctatttgcttattcgtgtagaagtaaataacattgttctatatatgttcgtttaggtgtgcagtagtaaatgacatcgttgtatatatgttcgttcatctgtgtatgagtaaatgacatcgttgcatacctcacattaattcaactacacgttttcatatccacatacatgcctagtacaacatcatgaccgatgaggtttacttctaaaaggagtgatattttttgcgttgatctcggtaacatttgcaaatatgatagatcaaattggaaaggacggggaaaaatgagtagtactctgatcgaaagttcgattttatcttcgcataacagttagtaataaggtgatgtattatacaaattaccacatcacatttatattcgtactatcgtaatagttaggagttaatttggagtttttctctaaaaagaatgctataaattcacaataactcatatgatctaaaaaaatccgaaattaagcgcggtattgcacgtaaactcatatgtaaattctctgtgaaaatcaaatatactttccctgtatctgtgtatcatattatgtgactaatttttgtcaggtaccagattattaatggactagcctccgcggtgctgtacctccaccaggaatgggatcagtgcgtcgtccatggcgacatcaagcccagcaacatcatgctcgacgaatccttcaacgccaagctcggcgacttcggcctcgcgcgcctcatcgaccacggcatgagcctccagaccatgaccgccgttgccggcacgccgggctacctcgacccggagtgcgtcatcaccggcaaggcctccaccgagtccgacatgtacagcttcggcatcgtcctgctcgaggtggcaagcgggaggcgaccaatggtagtgacacctcgtgcagccgctgccaccgcgggtggtgggaaggacgacgacgacggcggcggacaggtgttccgcctggtggagtgggcgtgggagctctacggccggggtgatgatgatcagtcgtcgctcgacgccatcgccgacacacggctcggcggcgcgttcgaccggtgggagatggagcgtgtggtgggcgtcgggctgtggtgcgcgcaccccgacccgaaggcgcggccggcgatcaggcaggcggcggaggcgttgcagtcgaggaagttcaggatgccggtgctgccgccgaggatgccggtggcagtgtacctgcagccgttcgcggcttccaccatgaagtactacggcgacagcatgacctccgttgggtcggaggttgttggttactcgtcgaccagccttgcgacggcgacgctgtcgtccagctctagcttgccatcggccatggctaacaatgacagcttgagcccaagagaatgagggttttggttatattagaagttggtcagttggtactgccgtactggtagatggcacatggtagataaaggatatactcccatgttgcaataactcattccaatctgcttgtaatatttgaatgaactggtgtccttctgctccactagtggtgaaatacccaaggcaaaatttgctacaagacacctaaagtttgtggcatttgctgtgagacatccaaagaacgtgtattttctcgtggacaccgtaaaaatgtggtaattagctgctggatatctgcctcattattttattatcccttttattattttcggtggaaatggagagagaaagagcattgaaagtaccaaaacacccctgacactgtttttcttccagcttctgttcttctttcttctcctctcacactgccatgccacagcagaccaacggctccatctggcaagggcaagcacgatggcatccaggtacatgctagccccgtgtagcagatgtccccgttggcctcgttctggaacgtatgtattgacacctgcagcagcagcaatgccaagccgagccgtgtgcaaactggaaaacggcgttgattcgataccccttagcgagtgcgagcagcaccagcaggagcaggaagggccccaaggggagtaggtatgcagtatgcccctgatttcgctcgcactactgctccttgcgaggtcaaggacggagaggaagaacagaagaggggatctcaaaagggaaaaaaaatgaaaaaatgagccatccctgtcgatccacccgtggcggaaatggcggacggggcatgcgtcccgcgcaaggatttggccgacggcggcggtgcccacttcgccgctaccccatccgaagcggagccctggggaggactcctagcagcggcgcgccgccccgtgctccagcccagccagtcccgcaccgccccgtgctccagcccagccagctccgcgccgccctgtgctctagttgctgctgcagcggcggcgcccacttcgccgttgccccatccgaagccgcaggaggaagaagatgaacagagaaagagggattgacaagtgggctcatggacaaatctgtctttaaccaatgtctctctccgtttctatcgaaaataataaaataatgagacgagtgtctagcagctaattaccacatttttacagtgtccacgagagaatacacgttctttgggtgtcttacagcaaacgccacaaactttgagtgtcctgtagcaaattttgccaatacccaatgttaacaccaaaatttagtatggctttttagtgaattcaattaaggaaagaggtcgattcatgtatgaaagtttaccaagatcaaactgacttcaaagaaaaaccgtgaagacagcgactaggcggtttcatatttttaagtatatccttaaatagactggatttgttattttcctttggtcttattttagagagccacatgggagtttaatagcgtttgtaggatgttaatggacttttagttttttaaatatataataggtagatagattaacacagtaaaaaattaattggactaattgtaacaatgaattatatagctaatttttcaaagaaagtcaactcttctactatataggtacatcagtatatttgctttacaagtaggcccatccttggtcatgcagttaattttctcggcgctgcattttgttctttttttagtatttcgtttgttgctactcctaacttccatgtttgagggaatacactggaattttccagaacatttttttactgctttttacccaccaaatccaacggttttgccatctcctttttctctatccaatggtgattacgtggaacaatctggtgaagtttcaagatttaggacccatttgaatcaaaggatttatataaaaattttataggattcaaatttcatacaaaatttttctatttcgtcctttgattcaaacgattgaaacttttcaaatcctatgaaattcctatggaatgacacatagcatatagattttggaggaaacttagcaagaggtccaacctcttggaaaatttcctttgaatctatctctctcatatgatttctgtgtttttaccgcggtccaatcaaacgatcatttttgtatttttcctatgttttgcaatcctctgttttacacttcaattcctattagaatcctgtgttttttctattcctccaatcttttcaactctgcgattcaaaggggtccttaccgttcacttttatagataaatatatagatatatactccctctgtcccaaaaaatgccaacttctggctatgtattcggatatagcctatatcgtagatacacagctagaggttgattctttttgggacataggaagtatgtaacatcttttgagaagtaaaagtgtaaaaacatgtaaagtgggcatccctttgaggccttgttaggttggcccgggtttggccgggattgggctgcaatccccgtggattggatagacgcggattgaaacccggcccacagaaaagtttgcattcggttaatcccgtcgcggattgaatcgaggccgatccggcctttccccctcgtcctaggttgggaaagaaacagctacccatatggagtggaaaaaaaccctcgcgcacaggagaagagcagcgcgcagggaaagcggtggcggtggagcggacggttaacgaactcgcacaggaaaagcaatccagaacgaacgcacggattagagcacgaaggaattggcaactctattactgagatatttctccgattccgacatgaatggagccaccgccgcctatgccaccatggtcgccaaagacagagttcacctcgtgttctctctctcttatcttcctcacctactcagttcttccccctctcgcacgaagaactattacaggaattagacttaattacttggcctagttaggcccatagtacttctggtttatcttgacgggccttgttgcacggcgcaccacttctccttcagctgcttcaagttcatcttccctccttccggaatcagcatcatctccagcgtctttagcaactgacttagcgccctcggacagtggttgctccttgacaatcccctccccttgaaatttggcttgtccccaagccaaagcagtaggaaatcgagtgcgtaagtcctccatgttttcccaagtggcatcctcggctgcagaatcagaccagcggatcagcacttgaagaacagcatcggtagccctcttgaccaccctgctatcaagaatctgagaaggaacttgcagagcagagttagctttaggcaactgaagtgatgaaagctctttataacccttagccgcccttaactgagatacatgaaagacaggatgcacactggcagttgcaggaagctgaagtttatatgctactgtgccaattttccgtaacacctaaaagggaccaaaaaacttgaaggccaatttatgattagctcggagtgccactgaggattgccgataaggttgaagtttcaggtatacccaatctccaactgcaaaagatctgaaacttctcttcttgtcagccatatgcttcatttgctgatttgctctatgtaaatgctgttgcaccaatgcttgcatcagtttcctctcctttagccattcttgcaaatcaggaatttcacaagtgtccacattgattccaaaatgcctaggagagtgcccatataggacttcaaatggggaagtctttaaagaggaatggtaagaagtattgtaccaatattcagccaagtgcaaccatgtgacccatttagaaggattggcatgagcaaaacaccgcagataaatctcaaggcactggtttactcgttccgtctgtcgatcagactggggatggtaagaagtgctcagattaagttttgttccagaagcagagaaaagataagtccatagctggctagtaaaaattttgtcacgatctgatataatcaccaatggtagaccatgcaacttataaatattcaacatgaacaccttggctacttcaagagcagtgaaagggtgggccaaaggcaagaaatgtgcatatttagaaaatttatccaccacaaccattatgcagttataagatctttgacttaggcaaaccttcaataaagtccatgatgatgacttcccaagatccatcaggaacaggtaatggttgtagaagccctgggtacttagatctgtcaggttttgcttgcagacaagtttgacattgctgtacaaaatcctttacttgagatttcataccctgccaagcaaacagtttcttgatcttactgtaagtgactggaaaaccagagtgtccccccattggactagcatggaactcagcaatcaattgtgactagagagaaggatgattaccaatccaaatgcgccccttgtacttaataattccagactgcaactgaaatccaggtttgcagtcaagctgaacagacaaggctgaaagcagatcagaagaatagggatcatgttcataccccttagcaacctcttgcaaccaactgggaacacaactagagatgatggacaactcagaatcactttgaaactttcttgatagagcatctgcagcagcattgctggtccctttacgatagcaaattttatagtttaagcccaataacttggtgaaagccttgtgctgccatggggtatgtaaacgctgatcagataagtgcatcaagctatggtgatcagttagaattataaattccccaagttgcaagtatgacctccagtgatcaactgctaacaagatagccatacattccttctcataagttgatagcctgtcacaccctaaaaattcaaaatatataaattgttgtttaaatggaatttttagaaattattttaaaagcctagaaaagaagatctaattttaattaataaattccaatataaagtggggccagataaaatttcattaaatactttgcttaattctataattcctagatttttctgggatttatttgagctaaggaagtattttaataaatggaattgcatttaagaaataatttaaattgaaaaaggttttaaaaagtctcttttggctttgggccgaaagtcggcccaaaacccctctctctctctcctcggcccagccggcccagtccgcagccgcagccgcccgcgcgagcgcgctgtcgctgacaggtgggtcccacctgtcgggatcgtcgtcttcctccggccgaaaccctagcgcgttgccgccgctttccaatttggccgatcctttccttctccggccgaatcaatagaagggaaatgatcttcgagatctcctctaccttttctcctttggaaacatcggctaaatcgtttggaaattcgtggattcgagtttgtttcggattcgattttcccgaactttccttctcgtcgccggccgacgtgggccttcgccgttgcctcctagcccctttaaaaggctccccggtgtctcctctacccgccgccacctttgccttcgcctctcgtcgtcggaaacgccctagcgccgtgtgccctagcgccgccgtcgccgccgtcgctccagccgtgcgccgccgccgttccagccgtcgccgtcgctcgggaagaccgccgtcgtggtcgccaagtcgccgccgtcctcgtccactccttcgccgccgccgaagaccgccggagcaccgtcgccgccgtcaacccgaagtttgccgccgcttcctcctcgtcgccgtcaccgtccgttcctcttccgccatcgctttggtcgccggtgagttcgccgtgccgtccgctacccgttggtgtcctccgttcgtgccgaagcgccgccgttcgccggcgagcgtgcgccgtccgagccgccgagccgccgccgccggtggtgacgtcatcgccgacgtcatcgtcgccctctcccgtgagccggtcgtggaccgatcgatctcggccgtctgttttggatcaagtcgatctcggccgtccgttcgcgtgaaccgccgccgtgcgctcggtccaccgaaaccctagcccgctgacgcaataaatcctcttttccttttcaaaaaataattcattattgcgtcataattcaattaaaatcagtttaagtgttttaatccgatttaatctttaaaaattcataactaattcatcttagatccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgagctttatttattggttcaactagatattagatataattgcttagccctgattagaaacattagcacactattgggataacttatgactcactattatttaatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcaaggggtattgtcacaactcttttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctgtcgtgattagtcccacacttctcaccatagtaaatgatgctataattggtaataatttgattagctcctggtttggaatggtacattcctggtttggagatagaactgtgcagccggcatggttgttcagaatggttgggcctatacaacagggtatgttgtgtagcgttggattaatattgtttaatacttaagtgtttcattaaattctgaaatgtttgataaatgctgcttttgcaaatgaagccgtagtatgccatcctttgttatcctgtgcatttgcatattttttgcgtggcttgctgagtatgtcatatactcgccttgcaatcattcatcagaggaagagttcttcaatgaggctgatggtgtggaggattaggtgtagccttggtcaagctgcctgtggagtggagccgtctgcgccgtttatcttatttttccgctgcttagatctttattgtttgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacatagccctcgatttcggggaccaagtgccttgctaatgtaggctattgggtgtttgttctgagacaggacagccccaatccctgaatctgaagcatcaatttcgacagtaaaaggcaaactaaaatcaggtaatgccagcactggggcagaaaccagagcttgtttcaattgttggaaggcagtttcagtctccaaagtccatttatatggcaccccttttcgtagtaactgagtgattggtttactgattaatccaaatcctttcacaaactttctgtaatagccagccaaacccaagaatcccctgagtttctttttggttgttggtgtttcccaattaacaatctcttgaatcttgcttggatcagtagataccccctctgcacttatgacatgacctaagtaggtaagttgctgttgtgcaaaagaacacttggataactttacttgccaatgatgttgctgcagcagggttaacacttgcttgaggtggtcaaggtgtgagggcaaatcagggctataaataagaatgtcatcaaaaaataccagagcaaacctcctcaggactgatttaaatgtctcattcatggcaccctgaaaggttgctggagctcctgtcagtccaaaggacatgaccttgtattcataatgaccagtatgagtgtgaaaggctgttttatattcatctccttccttcatccttatctgatgataaccagcctgttttatattcatctccttccttcatccttatttgatgataaccagccctaaggtcaagttttgaaaaccatttagccccaggtaattcatctagcaattcatcaatcacaggcatggggtaggaacacttgacagtgatggcattcagttgtctgtaatcaattactagcctccaagtgccatccttcttcctgactagaagggctggagatgcaaaggcactctgactcggttggataacaccactttgcaacatctctgaaatttgtgcctcaatttcatccttgagggctggattgaatctataagggcgaaggttaacaggcttggacccaggaagtaaaggaatgtgatgatcacatattctctttgggggtaatcccttgggtctaggattgactgaatgtcatcagggatttcagtcttttcagaatgagatatagacatcaactgtaccataaatagcagtgacccaaccttagccattcccaaacattgatcaggagtaatagaggagcatctgtcggtttgatgagtaacaccatacagtctgacaggctgcccatcaatcacaacctctagccatttgttaacccaatccacctgcataggactaaattgttctagccagtccatgccaagaatagcatcataagagaaaaaattcaccagcttgaagtcgctcttgaaataatgaccttgagtccaccaacgacaccccagaatttgctgtgtgcacttcatagtaccaccatctgctattttcacagttacagatctacttaaaggaatgaggcccacaagcttgctgccaatgctctcatctatgaaggagtgtgtactgcctgagtcaatcaacataagaatctctgttccttgaacccatccccttaatctaatagatttggatgattctgtacccccacaaagcttgctgagatatagccatcaatcctccatcaattgcctctactgattcaatagggtctttagctgtcaggatgtcatcagaattacactcagagcgcattgcttccaataattcttggacaacatggagctggacagaagtagcacatttatggtctctcccccatctttcaccacagacaaaacaaagacccttagcccttctgtaagacttaagagaagcaaatttgtcctctctggacttagcagattccactccctttttgtcatcatgtgcactaacagctacagatctctgtcctggaggcactggcacataattgttgagttttggtactggcctgaacgcaatgtgattatcagaccttctgtgtgtagtagacttattactttccaggatttcttcttggagcaaggcaattgaacaagctgagtcaaggtcctggggtctctgtagcataactgcacccctgacatcatccctgagcccttcaatgaacttagtaacaaaatacacaggggtgagagcactgtcatatgccattagctggtgcatgatactgtcaaattgttcaacatattcagtgactgtgctgttctgttgcgcatggaaccattttctaattagtgcttcctgtatatctctagtgaatctagcacagatcaagtcacacagagtttgccaagtaatacccataatttgagaacggatcgactgaagccaaaatgctgcattaccactgaaattgagtgtggccaccttgacccaatgcataggattaataccatagatatcaaagtattgctcacaattgctcttccacatctgtgggttctcaccatcaaacttagggcaagtcataggaggaagactagtactcagatcggtgtgatgctagaagaagttggtgattgcacagtagaatccggagaaaatggactaggtgagatgggaggaggattccgcttaccatgcaaccatggagttccttgtgctgaagcatctgcagcggtttcttgtttgatcgcgccaccttccatcagctccaccttgtggcttagtgtctgcacggactcgctgagtttttccaccttctcctccatcttgggaagacaaatctccaccatcttcttcagatcagcgagatcatcccgagtcctcgcctccgcctccattctcttcttctcattctcctcaatagttctcaacaagacatcaagtttactctcctgcgacatcctggaatttgtgagcgaacccaactagatctagaatcccccgctccttcccgaactcagttaaccaagagaaggcaagttgccttattgtggaatctgttctaagaacaattccaatcctccccctggaattttacaaccgcgccaaggaattcttggagcgtagaggctctgataccaattgttaacgaacttgcacaggaaaagcaatccagaatgaacgcacggattagaacacgaaggaattggcaactctattactgagatatttctccgattccgacaggaatggagccaccgccgcctacgccaccatggtcgccaaagacagagttcacctcgtgttctctctctcttatcttcctcacctactcagttctttcccctctcgcacgaagaactattacaggaattagacttaattacacggcccagtcaggcccatagtacttcaggtttatcttgacgggccttgttgcacggcgcaccacttctccttcagctgcttcaagttcatcttccctccttccggaatcagcatcatctccagcgtcttctgcaactgacttagcgccctcggacagtggttgctccttgacacggacgtgactgggattcgacggcgctccgacgacgcggcgctctcccctccggcgaccgtctcctccgctggccaccttctcacttttgagtctctcttccttctcctctcttcttcctatcctacctagggtttggttcttggtccttgtttcttggtttatctccgtctccaactgcaagggctcctcctcatccaccatcaagaacaaggccttgaacatggtgctgcttgtcgattgcgtatgaagaacccaactgctggttgcggctatgcccagctcctcaaatcagatttgagccgattgtgaattggtgatggatttgggttcactgttatgccatttttttacacggtccacacggaagcgagctcaactcggaaatatatctgtctatccactatacatgatttctatatcttcttaaaattcaggcaactcaagattcacatctactatacaattgattctgaaactttgtgcattataatgttcattgcgttatgtctagtagaaggaaaaagaataattggatggtagtagttttgttttcttctctatttctgtgataggtaaactgatgtctactcactgattttccttgcagactccttgaaattgactggtagggatgttccatagaatttctttgatggtagcagtttcgtgatggtgtcatttatagactaattaactatccaatgaagggtattactgatgtgtcattttagggatgttgggagaagtttggattttgttgtgcatttagactaatcaatcatcgaagtcgccacagatggattcaacttgctcagtatcagtgtctactgatgtgtgtgctaaagaaaccagtggccactaattaaccatcgaatgaatgattaattttggataataacactatgcctccaactgaaaatagcttatttcttgatcaggtgtaattgttgacattgtgacatgtcagatcttcaacaatgcctgaatgcagttcattcagccatctttaacaacctttcaagcagttaaatggaatcagaacaatctttttattatatcatataattggaatattacaagcatttcctgtaattttggctggcactacattggcatcaactttcttgatccaggaagttgtaacatgcgtgtatattgttttctagttttctctgaaatggactaatggtacttttgatcttgctcctacgctgccgtcacagggtactagcactactggttttaggtaaatagtggtaaccaaatgtactaatagtagtaatacaagtccagatcataaagagagctagcaatacgctcctatattccctgccaatagctgctatagtccctgtcaaaacgaacacagagtttctaagagagggattggaagaaacaagggatttagtccccacagggtttgagtgaaattggggggattcactcaatccctccctggtttgcttccccttaggatttaatccctagcaaccgaacaaggcctgagggattagaatccatcttccgctttcagcgtgcggttctccaaattgttttatttgcgtactgcagagcttctgagtcagccgtgtcggggagggattatttcaactctaaaagttcattcattacaatgtttatatcctcagtcaaattgctgcagtcgtatgcgtaatgataacatatgcaaatctgacgacgcgaaatctaaaatgcgtgcggtttgaaaggcttgctcgaggtttatccttttgaatatggggagagcaaagtcatcgtctctcactcggtccaaaaccatgtcggacttctgagttctgacttctgtactgcttttatatgcgggctgcggtgagtccccccggctgtaattgtactttgttgtcgttgtttgttcttctcttctcggctgctccggtgctcccgttcccaaatatcattcgcgtattttgcttataaccatagaccatcggttaagagttactaataacttctcatttgcggatggaggagatagaaggtaatttgctggagtcctcgattggatggctggcggataccatagtggagaacctggacaacgacaagtttggcgcgtggattagccaggtcgggctcgccgatgacaccgaaaagctccggtctgaggtcgagagggtggaggtggtggtcggtgctgtcaaggggagggcgatcgcgaacaaaccgctggcccgatcactcggtcgtctaagggaggtgctgtacgacgccgacgacgcggtcgacgagctcgaatactacaggctccagcatcagctccaaggaggtaaagcgtgtacataaaaaatacattgttcttcccttcttcgtaacgcaggacgtcgtacgtactttctctgtttcatattataagaattttttatattacccatatgcctagaatctttaacatccatctatatgaactagcaaggtggcctacgcaattgcgcggatagtatccatacaaaattatttacatatgagtttacttaaaatttgttaaatagcttccttgtatattaggactttaaaagactaaccttatcatctctatttttctaattttatagttttttaaagtcacacttgccgctacctcttgctctttttcacccatttatttgcttgttcgatctactacggcatctattcgtcctcctttgaactttaaaatagaaccttataaattttagacttaatcaactcattggctttcatttttataatttttagaagtcccatcaaacgccgccactctactccacttatgcccgtccgtctccttctctctttatcgtcatttgggttttaaaattcaaatataatgatcgtcggtgttcacttttaactttgtagaagtcccaccaaaccgtcagcagcttagccattatactcctatatggcccgcccgatgtcttcccttttaattgtcattgtgattttaaaattcgaacatgattctcattatggtttatttttttactttcctgctaaccatcgtgtttgtgctgcttaacaggttacccgtcattgggattctatttgtggttttgtttattgtttttacccttgttgtcttccctctttaatatcattgaggtttatttttttactttctagaaatccagccaaccaccgtgatcgtactacttaacggcctatccgtcgtccctccttttgatcgccattgggattctatttgggttttgtttatagtttttagatgtcccatcaactgctgtcacttaattcctttacgactttgttgcttcttccctctttattgttattcgtcattgttgcgttttatagatggatggtgtttattgaaaatttcatattttttattccgatattatattatttataaattatatttatacttgaactcctataattatttttatattttcagaatttaatttgatttttatttcaaattttaattaaacttatgttatttttattttatattttattctgaattctaattaatattgtattaggttcttatatggactcttcatttaatattgcttatttttagtttcgaatttcaattatttttaatttgtattcctacttaaactcttatgtcctttatttttctaattttgggttttattttatttttattctaaattttaattaatatcgtattggattcttatatgtaatcttctttcaatattacttattgtttattccgaattttagttatttttaaaatgtattcctacttgcacgcctaatgttacgttcctggtccatttgctcatgcataatgatattcttacattgttttattccaactgtattggttatttgatttttttttatttctaccttgagttaacgtgtcctacactggttagatttgtactctgtatttgattacaggatctccatgcaaatatgtccgactcctaatcctaatcataaaggtttaattaacttgccatcactctatatagaatataggtcggtcccaattttctgtagtcgttttctagttggactccaatatttttcatgtgttaatctgcaccattgaaaaatctaaacagctataatctaacgatcaaaatagtttctctttttcttcgattaatgtggaaatttctagcccccacagcgaacgtggtgtcttcttttagagctattttaataatataatagatagaatagatagatgtggacaatgctagaaagtcttgtaacctgaaaagaggtagtacacttgattccaatttccgttgcacgttttaatcttggttcagattcatgcgcggatgaacatggagtagagcaagcagcgagaccgagttgcaacgctggcatagcgagtagcagtggtggcaaaaaacgatccaaggcttgggaggacttcgatatcacggaaaaggaaaacggaaaggcggtgaaggccagatgtatccactgtcacacggtggtcaagtgcggttccgacaaagggacgtcagttttacacaaccatctgaagagtgacaattgtaagaagaaacgtgaagcaattggtccgccaccagacccttccaggtatactaccaatctgtgaatgatagctaaaaagagacaccatactgcctttagatttctagaaattcccatatctatccatctatctatatatataaaaaaagacaacacaaaaaatatgaaggctagaaattgcccatgttggctatgaaaaagaaaagaatagtacaaatagaaatacaatctaaaaaacaattgaaattcgaaattaaaaataagtaatattggaagaagaatccatataagaatccataaattaaatttcagaaaaaattctgaaattagaaaaagaaagaagaaagttcaagtaggaataaattttgaaataactaaaattcaaaataaaaaataaaaaaaaatcctaaatcagaaaaataaaaaagcgagtttttgtacgaatacaatttataaatgactaagattttgttcaagtaggaatacagtattaaaaataataattaaaattcggaattaaacataagcaatattggaataagagtccttataataatgcattaatactttattaattaaaattcggaataaaaattagaaaattatgaaaagaaaaataaaaaagagagttttagtaggaatataattttgaaataactaaaattcgaaatagaaaatagtgaaaaaaaacaatcaatctagaacccaacacgagtttaattaaaatttaaaataaaaaataaaataaattcttatattaggaaaagaaatgagagtttaagaggaatacaatttttaaataactaaaatttagtcaatgtaagaatacaatctaataaataactgaattaagaattaaaaataagcaatactgaaaaaagagtccatataagaacataatatgtgattaattaaaatccaaaatattttttctgggatttgaaaaggaaaaaaaaaagagtttgagtaggaatacaattttgaaatgactaaaattcgaaataaaagaatattattgaaataataatcgaacacaacacgagtttaattaaaattcaaaataaacaataaaataaattcctaaattagaaaaaaaattaagtagaaatacaatttataaataacttaaatttggaatagaaataacgaaagttgaaaaaaaacagtccttctaaagcccaactcgggattgaatttgttagggttacagataaggcatacctcatgtcctacgacttacgagatatatcgattaggtataccttcgcgtatatggattgttcctgtaaatgtcacatggaaactacttcaaattatagaaaatatctctacgggtcaagtgatttccaaaatcctactcggaaaggatagagtttctgttatactgtaccaggtccgatatcctcaagcttttcttggggggcaagatgatccacggtataaaagggacccctgggaggggttcagggaatcgtatctcatcttcaacacacctcccgaagtttatgaagccggagtacacggagccaactcagtgggagatctcgtcgaatctctcgactacgatctcgtcggtaccatctgtttcgactactctctttgtaatgtgttctcatcatcatcaattccatataaactggactagggctattacctgataagggccctgaaccagtataatctttgtcttttgtctgcttgatgtcgtactacatagaccctcgttccaatgtaccccaatactctacttatccggtctacgagtatcactcgtcgacagatttaaatttagaattaaaacaaaattaaattcaaaattagactagaaaaaatgcccatgcgttggaacgggtaaacaaaaattatatccaagataaaaatattatctgattagggtttagtttttcatgatatgagccctttaagaaaatatattctgaaataaagaaagaaagttctaaaaaaagaaaagaaaaatcgaaaggaaaaaaaaggccttgtcggacccccgccggcttgctagggtattcacgcacatagcccatgaagcgcgcgcggcccagcaatgctgcggtccaagggattttggactatttgccactttcccggatggcgtgttctcaaatgccactcttccaaagaactttgctttttttaccattggagagagatgatttctttctcattggccatttttgagctggtgaggcgctacgtcaccagatatgagggcaaaatgaccattttgcctttcttcttcctccagcttggggtctctctccttcaaccttcttcctgcgcatgagctggtgatgccatcaccaccaatgccaaaccatcaagccaaggccaggacgacgtgaagaggacctcgagcgtcccgctgccgaatggctatggaggagacgaacggcccctggctcttctaccacccaatgtgcaccctcacctcctgcatcgggcagcgaacaatgaggcaggggaagccctaaggctgggtctgacgcagccgtcgacgtcgggggagagtggagaagatccgagaggaggacgacgctctgtgctcagaggacaacgatgacatcgatgatggagtgaggcaccagcaatggcatcacattgccggacagccatgcccgctgatccttgatgacgttggcagtaggaatagaggaggggctggggatgtagggagtcgagtgagggagggaggagcacaaggcggggagctcgccggagcctaagcagctcactggcaaggaaaaggaaagatgtaaaagggactgaggaaggggaggagaaatgaattaagaagaaggacaagatagtcattttgcccttagatcaggtgacgtggcgtctgccaggctcaaaaatggcacacgagcaggagcccaccgctactcctcgcaaataaatatgcatatctatttctaatgtgatgctaattttatttcatatcatattttagggtctcaaatatcacaaatataaatatgcaacgctaatttaaatatacatatgtagaaatgaaaacaacacaatttagtttttttattttacaccattatattagatttattatttaaaaataaaaaaattatcgtatatacggatacatgagaaacatatagctattaaccagaaaaagtactccatacgtacatatgatttaaaga

SEQ ID NO: 37927 - DNA, 2263 bp, Oryza sativa
tgcgcgggctgcccaactagttttgttcaatttaaagataaaatataataatcttgaaatttacacaaatataatataaaatgtccaatcaatgctttttaagtgttctatcttttaaattattttaaaattatatatccaatttgtgatcccgttgtattcctttaaatcaataaattgataatgtctatagcccaaaatacatcaaaacatatggaaccgacaagtaataattaacgctatgataataatttcacatcatatcttaggtgtaaaaaaacttgatgaatatacaatgctaatttaaatgtacatacgtattctccaaattactaaaggtgtctcatgtcgttagaaagaataggtgttgaaaagaaaccagacactgaactaacgtgcattacactatagatatctgtcaaaaatataatacggtactttggagattatcgtgctagtattttaaaaaattactttgtctcagttacatataaattattctattgttttagaataaaatttaactcctccgatttatgtgacagaggaagtataagtaatataaatcatctttggctagatgaagtagtatcattagctattgcccacattgatatagatgttaatgaatctagacacctatgtgtctagattgataggtgtctagattcattaacatttatataaatgtgggcaatgctagaaagtcttaaaaaaaaaaatggatgaagtatatttttaatagaaaatatattttagaaatatataataaaattaaaatgctacttaaagtaatctatggcatacaaaataaaaaatgttatataagttcggaaactcgaaaaattttaaaaatagaatcacacataatacaaatagctacgaaccaactccattattgtgacacgtttgtttctaagaaatttaaggatatacagtttctagtagtaatacgaccaaaccagttattaacaaatacacgtttaaaatagattaaataaatatttcaaaaatatcatccacacataaatattcgtaataaaaattctaacaacattaaacaacatgtccgtgcgtatacacaggctacattcctagtaactataataagtccatttgccctttggtatggattaatagtcaactaatgcattaaagattttactatgaccactactaataaaaaaagggtgcgataagagtaatttgaggatgatgtaacccgctttaaaaattttatttctatataaggaacatctttttaagttatcgcatatgtagatgcgttttagcgcgtcagccattatgatgtagatcatggtaataaaagtcaaatataaaaacggagaattgaagctctgtaatcttcaatagaatgtttacgtagccacataaggcacgtacttcctccgttccacaatataagtcattctagcatttactatattcatattgatgttaatgaatctagatctagattcattaacatcaatatgaatgtgggaaatggtaaaatgacttacattatgaaacggagggagtagctcttaattccgctgagttaaccgtctgcgtttatctgcttaagatcgtgttatatcgctgactttgctaattgccgaaccacgatcacattcttttgcagtgccggtgagggtgcaccaaatgcacctggtaattcagttggcagaaaaaggatgaggatggatggcacttcaacactccacgaggcagttagcacgcatccttggaacaggggtgaactctccaacatgatccaacatatgactcatcagttacaagaggctgtaaatggggttatgaggctatgtgggtatgcaagtttaaatcagaggtgtgagagtacacccctggccccaaatgcaataacatcatcttatcctcttgagcccaaaatgtatgggagagatgcagagatggaatccatcaaaaatctaatcatgggaaataaatccaatgacataaccgtcctaccaattgtaggcataggagggatagggaaaaccactctgtcccaacatgtttataatgatccggaaatcggaaatcagtttgagatcaagatatgggtccatgtatctgataaatttgatgtggttaggatcacaagggagattttagggtgtgtctccaaccgaagttaccaaggaataagcaactttaacatgcttcaacaggatcttgagaaacacatgaaatctaagaagtttctgattgttttggatgatgtctgggatgtcac

SEQ ID NO: 37928 - DNA, 1582 bp, Oryza sativa
cattgcttagaaagcttgtgttgatcgagatgaagaatgcatcggtgctctcaatccgttcaccgcaggatattattttaattggaatgcaaaacttgcatacgtgctcttgcacttccatggtggacttcaactccagtttaaggatcctgaagattaaaaggtgcccggttctgaaggtctttccgttgtttgagaactgccgtaacttggggtgctcatggttgccccacctcagcaacctcaccatcgatgattgtcctgatttcactgtgcctcatccttttcccccttcaactactgtttcagagttcttcatcaatggaatttcaacacttccaacgatgaggtcaaacgaaggaatattttatattaggagtaactcattttctgataagctgacagcgatggataaaacagtgttgccctaccacaaccttagtaggtttgtaactactttgcatatatcacaatgccgaaatctgagatatatttcgttggaaggactcaggcaactgatccatttgaagaggctgaagatagacgagtgtcaaaatcttttctcttcagatgttccgcaagagcctacttctacccgtgaagacatggtagctggaattggaaatcgcaatgaccgcccatctcttgaacttgtcagtattacagaatgtggaataacggggaagtggctatctcagatactgcaacatgtgcagggcgtacaggaattgacattaagaaattgcctggcggtaacgagactatcgatgggagaggaggaaaagtgtcaactagagcttttgttagatcttgaggcttcctcgtcaagacatccaagtgacgcttcgataagctcagctgaagacggactcctgcgaattccgttaaatctcgtctcctctctgaagaagattcattgcagttgttcagacaaatctcgcaatttcagcttgtcttctgtgcataacggcaaaaatgatgaccaggcgagcgtacatgattattccctacaaacggcgctaccctgttttatagggaagcccgtccgcctcaaaaaattactagtgcagaacaacgcaagtttggaatgtctgcagttgcaatgctgcacggcacttgaagagttggagattcgagaatgttcacagctcaccaaaatagaggtctcgcaatccctctgcaatctcaggtttttgaaagtatacaaatgccccagcttgtccccatcttttctttggtttccagggcgggttgatgagttattccctcgattggaaagactagagatcgatgatcccagaatcctttctacatcgttcttcaagtaccttggctccctcaaacgcctagagcttgaaaaacacagacgcggagaggagagactattggatgagcaagagaaagcgcttcagcacctctcgtccctgcaagagctcaaatttgcgtgcagcgaattcatagattttcctgccggattacaccgccttccctcactcaagaggttggagatttggcattgtactcgcatcacaaggttgccagaagagggcctcccaccatctctggaagaactcgatatcaa

SEQ ID NO: 37929 - DNA, 1483 bp, Oryza sativa
tgcagcccgtcgattctggttggagttgttgcagatcgataaatcttccactgtgtctcgacatccatctcatcaatatgcagctcgatctcaccaccaagtggcggacctaggtattttgtcgtgggtgtgcccacacaatcctcaagagccgaatcagagtcactcatacacacaagtacacaaatagggtaaaagatcttagtttacccccaagtatggaatagatagtgtaggtcatgtcttacataagacaaacaatgaaaagaaattatgtttataagatggtttttgtagcttagaaattgcttgcacgcatcatcattcattcatgtctaatcttaaagaaaatttctctcaatgacgttactaatctttatgcacttgatcatcttcatttttatcttcctacaaggaaaacgaacgctcatttgatcgattcaatttaatctaaatcacaaacctaggtcctctttgaacttattgttttcacatttcatgaatatgaatcatccagagaaagtaaattcgcatgcgccgtgccacgccgccaaatggccaacaggaaagtacgagactggagatgagaaacagagaaaactagtgaagtaccctacaagcgcacgtgcatgcccgatggatttgtgtgctggtgagtcagactatgccgctaggccttgggcttttttttctgcatttatatgtggaataaattcatttgaggtcccttaactttacaccaaatccgattttcgtccttcatgatgaggacacaactagctcggatataaccttgactatcttatgtattactcaaccaaatgtgcatatgttctatattggatttacttgttatatatttgaacaaacattgctacacaatgagtttcgtgtgttttttttgtttacagagatacttgctttggtgaaggaaaagagaccgagcgtaacgaatgcatggatgatcaaagaagttgattggggaccaaactaagaccttctccaagtctacttccatctcaccatgtcacttttggtctatagaagacaagagataaagttttacacgttttgcattcggattcgggcctcctgatagcatcaacttcaaatggacctaaccgctgatctagaaggattttcggtgcctatgagtacttgttagaaagcttatggagtctactttcatatggttttggtcccgtgttaaaattcctaccgagctgccgggaatctgcaaaataagccacgtatttcatccagtccgaatctgatttgggttttgggccttgtaattgtgtcatggacttagcccaagggggtgtgcgccctaggcaaccctaggacatccctaattatatttgttcagtagtcgtcatcgttttaagtcggtttttgcttagattaatctgtcaagaatagtatcgccgctagatcggtttgtggaaccccaaattcgagtgcttaatcattcatatgcaat

SEQ ID NO: 37930 - DNA, 1371 bp, Oryza sativa
agcttgttaacttccccaggaatctagaggatcacttaataaatttctagttggattatataagttgttcagtacatcaaacttatatgcatatagaattgtatatgtgtgatgaagcttattggcaaaatttgctatgagacatccaaaaaatatataattagctgaggtacaccgcaagaacgcgtacatgctgtgggacaccgaaaaaactggtaattagcctgctggacacccatgacattattttataatatctaagaaaaatgagagagaaacagttacaaaagtatgattttatccttgcctgccaagccctactcgcatatagcaactgcacccccagtcgccgtcgccggctaggcgactctctggtgtttcaggtgtgggggaggggggggagggagtatgcacacctaggcacggactacgcatcattcccacactcgtcgctacttcagcgcgagggccacgttggcgctcatgctctgccacacaccacacttgcaggcgagcgcaacgtggaccacctcctggttcatgtcttggccaccacgacgtcagtgctatatgcgagacacacatggcaaataagggcaaaatcatactttcatgactatttctctcttcatttgctctagttataataaaataatattgcatgtgctcagtagctaactaccagttttttacgatgtcccacaacagatatgtgttcttgcaatgtcttcaagctgattacacgttttttaatgtcctataataaatgttgccaaacttatttgcatatagaattctcatggaaacatattcgttctcttcgctcccattacaatagaaggagatcgttaaaagtgcatatatgtgtagttagagttagagtcaaacacgaaccatggatacaaggtataatcatagagataaatctattctagcatatattttacaccagtttttatcttctctctgtagtcaatgcaatacaatataatacaactgattatagggtttgtctatatttgatattttccatggaaatgcgcatgtgcaagaaaatctcgatttctgcgcgccatcccttagtcgcaggtggttcgaagaacacatgcggatacgagttatcgacggcttacaaaaatgtttttttagcagtgttaacttcgccagagaaagatagagtactacgtcactaaatcattttcaaattggattagtcgtttacctaccctgtttgttgacttctccaagaagctagaggatcacttaatcaatttcaagttggattaaatatgtagttcagtacatgaaacttatttgtatatagaattgtacgtgtgtgatgaattggactactaagctaccacatccatc

SEQ ID NO: 37931 - DNA, 587 bp, Oryza sativa
cgtcactgtcatatccattccgtacacccttccagaacaaatgtagtccctccaagcaatggttgcttttcaggcttgctccactggcctcttgctgagttgtaacgttttcaagtcgagacacacccggttctacgggctcgctcatgcattgaagttgtgttatctcaaagccaatagaattctcaaccttgaaatttgttagcttctgaagtgaggccatttctcctatgctagcaatggaagaacacactcccttttgggcaagatgccgcaggctgacaagattatttatgtcatcaggtataaggggacttccatatgaaccaatatctagtacttgaagatggtagcacttgctcagagcatggggcaaagcttcgtgggtcactctttctaagagaagatgaaaagctccatgggactctttgttcttaaatcttagatacctgagatgggtagtgttcgccaaactggaaaggaaggaatcaagatcagcataagctgcagtgatatgcagcagtcgcaaatgctgagcctccctgaaagcatcttggaaggatttaaaaaaatgatggttatattgc

SEQ ID NO: 37932 - DNA, 631 bp, Oryza sativa
catggcaagcaatccaaagcatctgcacttacgtaaataacatctggaacacatacataaagttactttgctttgctagatgtgcatcacatttctaatcttcattttgttctttggcaatatgaaagtgctgctgaagaattttttcatcaccgcatgctacagccggatgcaatttcaagggaccgcagcaagctgccgggaccattgaattggcaagaacataaaaatacaagtcaatgtcaccagacacgtgtttgcacccgtctagcaatgcactactacaacttggaaaatgtgtgtactgatgttatcttggaccttaccttatgtgatttatctttgttattatattttacctcagatggtaatgtgtgtattagatataaggtagcttttggagatcatctgattagtattctgaagtattctgcttacttcatatatttgtaatcagtttgttaagattgagtcagttacctttttaattcattatattttctgttctttttttccttgtattgttcccttcctctcattttcagccagccaataaagcaaccaagggagtagccaaggatagccacatgtttatcttgaggcttgctgactaacaatgtctctggcacgt

SEQ ID NO: 37933 - DNA, 733 bp, Oryza sativa
gagggcacgccgcggtggatcgcggatgatggagcagcggcaggatcgggtacctgacccggggacggggaaagggatagggacgtgacagagtggcctgtgtcgcatttactaatggcgccccatctaactccgcgaggtacgcacccgcgtccagcgagtggccgggaaacgggcacgcatgcaggctgtctcgcgtagcgtggagttgcgcggtacacggccaccgcggctgcttttccgccctgcacggcaggcggcccgcaaagttgcaacttgtgatctgcgtgtgttggatcattgatgagagttgataggagtaaatagaaatggcatgtcactccccttgatattttttttccaaagcgtaaaatagacgcattcacttgtaaacacgcgtgcagccggctgtatttgtgaagagaggaatagaaaagattaagaaaataagtaaaacgatgtaaactattagttcgcaattagttaagtattaattattttaatcttgaaaaaagaattaatatgatttttaaagtaaccttttcatagaaagttattttttaaagaaatataccgtttaatagctcggaaagtgtgcgggcgaaaagtaatgtttttcccttctcgttcaactatcaaacactgcatatagtcctataaacacacataaacattctatctttattggcacgttcaacaaccatagataattagatatcttattgttcacata

SEQ ID NO: 37934 - DNA, 8026 bp, Oryza sativa
  unsure (1)..(8026): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgctcacacctcatgccgatgctcagtacaaaggcctatgaccttggtggttgtgtaaaatggacttataaattattcctgtttctatagtttatagagaaagtagctgcagacaccaagtctacatgtgatggcagtactgcagtaatagtaaaggcgtcttgcataaaaaaaaaacatatagctaacaaactagcaagacaacatggatagaattgctttagaagagcaccggaaaacttgagcattagcgactgcacagaaatggtgaattcggtaattccagtggttaaaagcaaatgagtttgttcagtgaacagctttgaagaagagaagcatgttagtacctgagaaggttgttgacttgacctctgagatggtgattgcgaagcaacatacttcaaaacgtcaaagaatgtattctgtcctacagtagcagccttttgaaaataaaggacaactacatcggtggctcgagctctcaactcaagcaaattacggtcaatttcattctcatgctgtgaaatatatggcctaaagaaagtcccataaatgtaggtagttccctacaatgaaggcaaatgtcaatccaatgtacagaaaaaacatctaaaaatagaagctataggtgacaaatcgagtacctttgtcttagggtaccacaagtatataaagaacatcagctttgcttccgagtaaaatggtagccttcaacacgatcatatgcatggtgcaactaatgttagagactgttaaaaagagatgaaaaatgcaaacgttggcagtcttaccatgatattgtaaaatctccaaatctctccataaccgtcatcagagctactagaatcctagacacaggcacagcaaataaaagctaaatgtctcgcaaatactaatgaaggataatgtcatgatcaaagatgaaagaatcatcttaccaatactgacaccaaaatatgagctgctcaatctctggtttattcagttcgacagtcttgtagcactcatatgctggataggcgtagccaaaggccaacctacatgcaataggcataagccagatcataaatgacatatccatgctctatttgttatccagaccataaacaaaatgtatgtacattctttccgagtaaaatgatttagaggaaaacgattgctctttttttttcttgttttttttttgttgcgctccaaactaatccatagaagagcagttgaccatttcgagggtgcgttgaattgagcatctgagcatcattgaagaggctaaattttcaacgcacttgcattaaagaggagaactcacaatacgcatcttgatctacgagacatgatcaggcttacattatagaacaactgcagatgaagcatgccaaaagaacaaagcttctgaatttcgggtttatttgttcaaatcggagcctaaaaactgagcttcagctaatagtacagaacgtcagaatcattatccattcttagattccgatagacaagatcatgcgacaggaatcttgaaaaaaagaatcaatctgttaagaataaacgaaagcctttgaccgttgtgcaatgcattgaaaatttggtcccatcctcctcgtgaacaataaacatcatatatttttcgaatgcgtagcgggctctcacctcccgatttcaagccgaagaatcaggtgaacaaatcgacacgaagaaacgcatctcgcgatttgttgttttcaaacaaaatagcatatactattaggggggggggggggtgaaagaacagagagacaaaatagtaaaggagactctgccctccgaatggacacacatgcatcctcatctcaagaaactgaaaccaaaaccggagacccaatgcctttgacaacttccatacccaaaatatcaacttcgcaagagcacatttcaagattcagggggaaggggagggaaatgcttacaggaggacccgggagaggaatccgcccatcatcttctccgacgtcctgcgcacatccagatccaacagaaccgacacgaatcagaacacaccatcagcagcaacgaatttccaagagaggacgcaaaagaatctgcaaaagaaacctcttttggagatggatccggcgaggagcggcgaaacggagagggcggagagagatggtcaggagctcgccaccctcccctgttccctctccctctacgctatccctccctcctctatcgcggcttaactaaatataccggcaatgcggtggtggttttgccgagatgaggaggaggagaagagagagagagccggagaagaggcgagcacgtccgccgtcagctcgagctccaaccaaccggaccccttcctgtttctttttgtatcaccgggttataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaataagtggatgtacctggaacatatctttaaccaattataaatgcgccatgtctacctctctctctctctatctctttctctcgtgttgggaaaaataatgtttcaacgcccactaattttttttaactcgaatgcgatgcgacacattctttcatcgcacgaacctttcctcctgatgcaaccgttgaatcatcatctggtttaggtttttcttccccttcagtgtggttatgttgcaatgattgccggtgaatcatcatctttaattaggttcaccgtgatgagggaggcttcactccgccgtacaatcatggcgttgatctcgtcagtagctttttcccttcatgaccaactgcatcctgaccccgcgtgatgaaaggccaaagtggcaaagtggttaagccggtagagagcagagcaaaccagaggcagctttgaacacacggctcgcctcagcctcccgcacacagcactgctattcttgtgcggatcgatcggcagcagcatgggttggatcatggtgatggatggtagccgtgggatgggagcggtagccggtggtaggtcatgagtgacaaagctagtaggacacgcaccgcgaatctggccggatctgagcaaaaacctcgctctcgcgccgtgcgcgagaaacgtcacgaactcacgcgtgcctccaagccgtgcgtggcccgggcggctccccctgcgcggcgcggccgcacatgcgcgccgcctgctcgctctcgagctgatgagcgaatgctcgcgtagagacgggacgagaggacgagagaggaggggtttgttttgtcggttgggaggcgcacgcacgtgagcctgcacgtttcgggcttttggatggcatcccatgattgccgtgcatgggcgggcgacgagacgaggaggggggctaaatctgggtttatactgagattatatacctacctgcctagctacctgcctttttgcctcggtgtagtatgtggtattcccgacaaatacattacctttgctggcttgatgcctctaaaattaggacatgtggatccgatcgatcagcgtcgcatctaggtgcgtgtttgttgcagtggggagctccttttctatactttgggaaatcaacatgtatgtgctttagttaactttataaatctcgaaatcgcataaacaattcgcgttttacagataagcacgggagaatctgcgaatgatcggatcaactcgtttatttgagtggaaaggatcttgcaacttgcaaccgccaacatcatcaactccttttgttagcgaccaagggggtgattatgcccatggattgctgaaatacgtgcgtcatgtcagatgcatgtctctgttgcccggagcgtagctgtcagcttatctggttatacttatacggcagtatggcgcccatgttctctccctagtacagttttgtcctacgttatgtcctgtgtgtctggctgtatcgcttgtaacaattgatgccatgaagttacatgaactctgtacagtacactctaatgtaccgtaatttatcttgccattagctgatgagttgaggacggctgatgtagatctgttctttcccgttgttcctctgccttggcactcatcgttcatttttctctattgatagatgggcctttggaatcataattggtaggtgaggggataggcagtttagtgatcggtcactaatgtcatggatgcattgacactgatacgtttcagcagtgttcagttggttggtttgttcttatgtcacggcaacctaaccctacttattgtctttattattttattatcataattgcctccattcccggtccccaccatgcagataggtagtggccactggccacatcatgtacgtataaggccctgtttagtccataaaataaaaatttttacactatcacatcgaatgtttgaacacatgtatagagtattaaatataggaaaaaaaaccaattacacaaatggcgtgtaaattgcgagacgaatcttttgagcctaattgtgccatgatttgataatgtattgctatagtaaacatttgttaatgacatattaattaggcttaataaattcgtcttgtagttttctggcggaatctgtaatctgttttgttattagactacgtttaatactttaaatatgtgaccgtatatccgatgtgacaatcaaatccaaaaattttccccacctaaataagacctaagcttcacgaacaaaactgcgcaagtaatttctctaacaggtgtggacaccaacatactctgcactagtagtggttattaaaatttgaccaattacagatcaaagtgcaaatatataatttcaggcagttggcaaccataggtcttgtgtatactgtctagtccaatctttgctcactttatcagtgtgagatcatctgtgatgtagtctgtatcatcaattaaccagcggaagtttgttatttaggctcatctaactgccccttgacggtattgttatactagtattattttggcatatgaatccaggatcatcaattttatccactaaattaaagatagcctaacacacctataacagtgtggaatagtttcctgagtggtgggcataatcattttcctgatctcactccaaaccaactcaaatggtccacatttgcagaacttaggccacctgattttgaaacaactgaaatataagatgaatttgaaagtttggagcagctgcagccttcagcacactctgtattcgtgtgcagtaaaaaaaaaatccatttgctcacaatcataaaaataatattaaatccgatcgtcgcaaaggaaccaacaccaaacagaccaaaagaagacagattgtgcccgaaggaaatcacaaacttcctttcgtgaaacaaagctgctgcattagatccccttttgatttttctagattagatccatctcacactcatacaccgctttactacctctatatcatggacgcaatcacctttgctagataggccctcacccacctgcctttgctgctagcttcagaaacggataacgatacgtactttagccataaaaagatgatttcatctaagcatcgagctgaagtactagttatacaactctaacggatagtgagttcgttcagtcggagacagagtgcagtccagcagagttcagagtttcagatggcttgtgcgacacaagttgtgtctgcttcagatggaattggaatagtgactgcacgttaacgactgcacacaatttcgaccgtccatttttacgatcaacggtccaaatgtaaagctacagtaaccgatgtgaacagcattttgtgctgtagtattactgtattactactacagtactgtgaacagtacgctgctcgctcaggccgtccgatttgtatccgatgatgcataccgctactgcttaagttgcagtcgctccaaatcccttgagatgggcctctaggaggtgaggcccaagttggaagacgcccacatccaaaattagagcggggataaacgcagaaatgctattaggcgcagttttgttgatttcgtcgcagaataagcatgctaatgtacggttagaaaacaaggcagattaacgacgcatgcacatatatataatctatataaactttatttatttcgttttatttgcacaatacatctgtgtttcactagtagagaaaccatctttggtcggtcgacccaaatccacaatagtcccggttccattaaaaaccggaactaaaaatgatttttagtcctttttaataagaggaagatctttaatcccggttgtcgttaaaaatgattttaactccaacagagactaaagttcatttttagtcccggttgattccatgtcaggccgtgtcagggccctatgatctttagtcccggttagtaacaccaaccgggactaaaaacctatttttagttccggttggtgttactaaccgggaataaaaatcaaaacacactatataatccatagtaccgatcctcttttcccgtccacacaacaaactcctccctctatctctttttttcctctctaacttcttatctctttccttatctctaactcccctcctctctttccttttttccttcaccacagtgcaggcggccggcgcggcggcggcgcggcggtgccgggggctgcgcggaggcggtagctgcggtgggcggccgctcggcggcgaccggcacggcgctggccggccagcgcggaggggaggaggggaggcggcagtggtcgccggccggattttttttctttttttagatgtgaatctatgatgtatttttgtgtgagatgtgaatctgtgatgaattttttagaaccctgtgatataatttttttaagagtttgtgatgtatttggagatgatttgtttgaggattttgagatgttctgtaatatgtgatgatttggatatgggaggggatggtgtgaaatcaatattcaatattaaaagcagaaaaaaaagaaaaaatatctttagtcccggttggtgttatcaacccgccccaaccgggactaaagatgctcccaaccgggactaaagattgatttttagtcccagttaagatagcgatctttagtcccggattcctagtcccggttgaaaaaccgggactacaggagggttaccaacccggactcccccaactttctccgccagtgtttcttcgtagcagtaaaactgaagctccttgtaaagcatgcaggccaagccattcgattttagtagcttccaaacaagatcggccgatctatatacttatactaagctggattggggcacatctgatcagtgacagaataggttgagttcggacggtcttgccgcagaggcccagaatcaccctgatcgaggaggaaggacgccatagggcctttgagagccggcacaggcagtcagtggcgcccctgctggatagatcctccagcggtgggcaacactgttgcctagcctggcttggatttagtaccagatcgaataacgagag

SEQ ID NO: 37935 - DNA, 6965 bp, Oryza sativa
cggtggttgcattggtggaggtgacggcatcggcgccagaggtggtggcatcggcggcatgggtcctggggacggtggctgtgttggcggcggtggcgacggcatcggcgctggtggtggtggcatcggcggcatgggtcctggggacggtggttgcattggtggaggtgacggcatcggcggcatgggtcctggggacggcggttgtgttggcggcggtggcgacggcatcggcgccgggggtggtggcatcggcggcataggtcctggggacggtggttgcattggtggaggtgacggcatcggcgccggtggtggtggcatcggcggcatcggtcccggggatggtggttgagttgggggaggtggtgacggcatcggcgccatcggtccgggagacggtggttgtgtgggcggtggtgttggtggcattgttggcgccacaatgggtggctgtgttgtccgctgagcatgggcgaacggcgagatcgggaggacgatggcaacgaggacgaacgcggcggacgccatggaggccaccatcgttagctactacgcaccagcgctgatcagctagcttgtgtgctttccaaacatatcacctgcatgaacaatttataggcagcatctgcctagctatagtacggagcacgcgatgcacctgccgtgtttaattcattaattgtctcgtctgcatgcagcgtatgcacagagtcaaaaggcagctcttttgatctctcgtgtactaggcgtactcgctttgtacctcgtatccagctacgtatatattcaaccgacggagtgtgggctcgtggacattcggaattccggggatgattggatttactcattccatttgatattatagaagtcgctttaactttttataaaaaaaacatttttaactttaattaagtttatagtaaactataacgatacttataacatcaaattaattttattaattaacatttattatattttgatagtagtatatttgttttgtgttaaatgattgctatatttttctataaagttaatcaaacttatcgaaatttaagttttaaaaatatcataacgtcttatgagtcagagggagtactccgttagcttcaagagcactgcagctaagtacaaatgtacaatcatgtattgctcatttgctgcttttgctagtctgctcgtgagccaaaagtctggcgttatactgcatagcttggtgaatggtgggtctgggggcctgggttttggcgttattctgcatagcatgacaaagaacatgcacagatcagatgtaacttcgtctaactcagcaagtacgtacgtctatataagctgcaaaatctctcgagtcctagcttataggagcaagaaaaatacaagagcatggcacgtgcctgcgtggtactgttgccgcccttattatccaagtcaacgacgatgagtcgttgatgacagctgaacacatgctcattttatcccaaaatagacaaatctaatttagactatgatacattttaatattacaaatctgaataaatcctatctaaattctgtaatgctcgttctttgtggctttagcgggaaaatttaatttttaaaaaccctatcgtgaaagttgttctttgattgaagagtagctgtgttgccaagatctccctccaaatctctgatcaaaccaaaattccagcgaaaaattcaaattcaaataaaaaaaatcccaaaactctctcaacaaattcatggaaaatttcaaatcatttctcatttcattgaggaagaagctcaaaatcttgatcaaggaaagtcacattcgatcatattgagcccataatttgaaattaagcactttaattttccaaattgtgcatctctaggttacacatggaaggctcggccgcggtttgcaatatagccgccaagccctcctaacttgctgcacaaacttcctttgctaattgagttatccaaaacaccccttgtcgtctaccttgttgggtttcagtatttgtactcttgagtatcaaaaccaaaggcctttctcaaattcaaaatgatcaacattgggtaaaaattgggttttgttgaatccttagaaaaacccaacacaagggttggtgcattaaaaagacgtactggtggtgtagtcttaccattctcgtatctaaggactgattttgttcaaaatttcaccaagcataacatagtgtgaccgcatgggtgaagtgggacaccccctaactgagtaactagctagggcagggaagccttgatgccgatggacaagtagattcaccgggatggtgtcgggaaggacccctaagcttcctggtgcaacatggtctgagacctaacatgttcttggtccatgagacccctccagttggcataaggtgaccccatgtctgctttggaaataccttgtcacgaaagcttcaaagtccttttgtctctttggccaggagccattgttgttgatccaacaatgatacactacactcctccgactgagtgagactcactctcactctggtcgtcgagaagcactcactagacgaattcaaaacttgaaaataaacaacctttcctctaaagctagcattaaacacttaatacccctaccttggtctgtataatatatagtacccacccttgctctctatataaatatctactcccaactctcgaagaggaggagatggaacccgaagatgagttcttctaggagcaaacgacttcagtcaatcctagagtttcggccaagtttccaagtcacacctgtggtgttggtcttgtttcacttccgttatctttggcactgactcattgtgaactcagggtatgtttgtagttgcaacatagatgtaaaaatattgatattagtgaaactctattgctgtgatactcatcttcctgttgtaccagcgctgcttcctatgactggtacaggttcataggttaatgaatcgtcctaagatgaccttctatatggctagtccggggcgtgacagattcgtagtgtttattttaggacggtacgtggctgatagtctgaagcagaggaaagaatattccttatgtgtgtgttgtgcctccttgtaactacaaggtaaagaaaaaaaattgagatgggaaattaaataggaaggaattaatatatatgcaccagatttaggagcgtgtgatggattttctagcaaatgatggagcaagaacgttcattgaaagaaaaccagaaagggaaaatatgaaaaatactattttaaagatatgttgcaagatatcataagaatgacgcatgggaccaagacccatatgtcaatcacataaacaatgttatttttcaactctataatactttttatgagaaaacccatgccataatgttatgggcaaagaaagagatacaagtggccctgtttggatcaggagattctaacaaccgtagctttttctaaaatctttaccttagcttcccccaaacagttcatatcgtcactttgattctcgtaatctgtagcaatagaatcctgaaaaatgaacttgaagttagaagttgagaaacacatctttttaatatatttttagaagctagctaccaaccaactatttctcacagttccctaaaatggagcctgttatattgtgcagagatcaggacgtgcaaattgattggccacaactgcgcggtgaagatatgtaaaatgcaaatacaatccacagaataaactttcttgtaatgcaaaataactcatatgcacaatcacattgtgtattcactggtcttctcaagattttgttatgttgaagtttctcgtgctaattagagagaaggccacggagaaagaaattctctctctgggcatgagagagagagagagtataagtggattcaaattaggaaatttaagaggtccaatttcgagatcaaatgcctgagatatgatcaattttcaagtttgaatgttgctaaagcataaaactgccaaattatccaactattcttctgtaaaaaaattatttgtggtgcctgtcactcgagttgcgtatatatcacttcaattttgcaaggtatctagcaggtgaagcccatggactctttgacacatggtctcatagattggtcgacgcccactccacaaggattgaatggttagattacgccggttactgagtgcgagcctcacataccatccaccatggaggccaacatgtggaacacagtggtcagcccagccaaagcaagtccaatgcaacaccctcgtcaaatggttttcgatgaccatccactcggccgcgtgccaagctgagggaagaaagcgaggagagtgtaggatcaaaacacaagaactaagccaaccagaggggagtgaatggttggtatacccaaaaatccaaactttttgcggaattaaaagttaccttcaaatttgacggatcgcggtctgaccgaaggtgttgcgccggtctgaccgcttggaagccgtcggtctaactagagtagatcgtccggtctaaccgcccgaagaagctgcagtcgcttgaacctgccgccggtctgactgccgtgtacccaccggtctgaccgctgcgatgccgccgatctgaccgttggtgtctcgctgattagaccgctgaacccgagaaaacacaaattgaagaactctagatgtagatgataactttattacttctctctgtgtttacaaagtgcaacaacagcactcctcacgaaaatcttgacaaaactcgaaaccctagctaaacttacaactcaatcgctttaaaaaacgatacaggcttcacgctccctctctattatatatgaggtaggtagcctaaagccacgaacccaactcatactagaagtcctaatccaactagtaaatcttcccgtacaagaaacaaactttacaaactccaatcataccaaatttggactcctaccaaattcgactccgcatccaatacgcacacaatacctccatcgtatgccatatggatcatcaccaaccacgtacattgaactctagcctaagtatctcgcatgatatctgaccgtcacggacgtcgccttatccccaagtcgactcccgatccatcaccggcaatactctaccgaggcatcaagtcacctacacatgaatcaaacaaagaaaccatattccgagaccaagctatcttcaacttgactcattgttagcaaacaacagtattacatacgcatagtatccatctagaagccaacataaaacaatcacgaatatccaaacaaacaacccgaaaccaaaaccgacacagagttggccagcccgacgcgagctggccggtctgaccgcgcgatacacgccggtctgaccggcaaccacttcccggtctgaccggacccaaatcacagcagtacctgtaaatcacctgtaaaatccaatcatctccaaaaccacttcgccgataatctctaaatatcaaaaccaataatctcatatgccaattgttcatcacagaataagaataaaaaacactttgattttacagggagctcacccgtgggcacggtgagaataatggaaagtcgatggcagcggaacagagcttgaagtggtgacgcacttcgggtaggtgtggatgatgtctttccttagatcttcgggtggcgttgatgtcctacgtatcgaagacgagggcacgaaaaagatgccgacggaggtggctcctacaagtaatcagaattctattggcaaccaaccgattttgttggtgctatgagatccttcgatgcctcgaacgatggcaaacgacggccggagccccttggatatggagagagacagaaaggagagctttgaaggcaccaataaaattttactcaatctgacaaatcaaggccaaattgaatgtgaatttagagagggaatgaagcacatggttggggtcatgactatgctttcgagttgtggattggagtggaatcacgagtagtggcgacgtggggagaaagacgactactatgctgtgggatgcaccacttattagcatcgcgggtgagcgacctggtcggaccgactgttgtatgtacttatagatgtggaggaagaaggtcggactcgttggccgatgtggggaggaaggccaaggtgacacgggagtgggctgacgcgcggaggcatcccatgtcgggagtaaggagaaagagaggggggggggggggtttcttggttttcttgggtttttcctttcggtttttgtctggttcttcttatgttttttgggtttttaatatatgaaaactttgtatacatgttgtttttgttttttatttttaaatatgtatgtatataaagtttgtatacgtgaatatatatttttatacattaaaagtgtatacatatatatatatatatacatacatatatatatatacatacatatatatatatatacacacatatatacatatatatatattatattatattatatgcatatgtatacactatatacatacatagcaactatatatatatatatatgtacaaagtttatccgtatattcatacgtatatacgcgtacagaggagagatgaaatgggccgcagcccacctcgggcctgcagctttgcaggcaaggaaggcagagtgggagagagagaagaagaagggggaggggcgagggtaagcccggccggctacgcgtgaagagatggaaagggaagccttttttgaaaacctggaaagggaagctttcggccggatttggcttaaaggttgttctctgtttaagaatttcatcagaccaagtgtttttccgtacacaaacacggaaaattgtccatgtggactggagagatgacacgatcacaaaatcaaagtcacgagatttaacatcaacttttattcaacgatatattgtaagacggacaactagctagtcgatcaatcaccaagctagcacacagaagcatgca

SEQ ID NO: 37936 - DNA, 1639 bp, Oryza sativa
acgcgagtgatgattaattaattgtatagcttttgatgatggcaatatggcatggagctgtgcactatttatagcctaggcaacgtagaattaatccatacatgatactacatgtaagtaccgcagctggtgtgccttgtttgtggtgttgaattgaagctagcatacacgtacgtgctgcattttcgcctgtacttttgctagaccgccatacttcttctgaagctagcggagccgtgcatacgatagattatatatgtggagcaattaatatcactcaggttgatcgcctttgacaagtactgtactgtgcgtgaaccaagacttctacggcccgtataaatcccctagcaaaattatacatcctgtcacatcgaatatttggacacatgcatggagtatcaaatataaaaaaaaactaattacacagattgcgtgtaaattgagaaacaaatcttttaagcctaattgtgccatgatttgacaataatgtggtactacagtaaacatttgctaatgacggattaattaggcttaataaattcgtctcgcgatttacagacggattctgtaatttgttttgttattagactacgttttaatacttcatatgtgtgtccgtatattcgacgtgacacacaaaaaatttacacccctgaatctaaacacaacctacgtcgtccacgccaatagactttggctcttttagatcccatcctaaaatttttcaccctgccacactgaagtttgaacacttacatgaagtattaaatataggctaaaaaaattatgcacatattatgactaatttgcgatacgaattttttaagcctaattgctatatgatttgacaatgtggtgctataataaatatttgctaataatggattaattaggcttaataaattcgtctcgcggtttactaatggattctttaattagttttttttattagtgcccaaacaccccatatgataccctatataatatccgatatgacacgccaaaactttaagctcctagatctgaacacccctttgttagcttagctacagctagtagctgcacccctatgaacaacatgctgctcaatcgtgtgggaaaaaaaaaccccgtagtgtcgctgccgcctgggcgctccagtgggaaggttggaaatatatcttgaaaaattgagcacatgtgaacggtaatcatgggctagtaaaaatgggggcaccgtgacatcctgaccgaattaatttgaatttagtttgtatggacaataaatactgtgtacgcatatttagtatcacatgccatttaaataagagcgaaatcaacttataaggacttttctctccaaccatattaagtagtgtagtatgtgtgagtggatccgcccatcggatgagcatatagagaaggtgacgacaacggtcctccagcaagccccctcctctaccgtcaacttccaggttagttctttctcccgcaccctcaccgtgccactgcccgatctcaccggcgtcggaaggtgtcaacgtgccgacgcgaccccacccagctgacctccttcccctccctccaccacactttgttcctgccaccaacattggcaccacccccccttgtgtctcaccacccacccttgaccatc

SEQ ID NO: 37937 - DNA, 23465 bp, Oryza sativa
  unsure (1)..(23465): unsure at all n locations
cactcaggtcatccttctaagcccgattctccacttccccctccctcgcccaccccgaatctctaaccctaaccagtcttgcgtgcgacttatcgtgacgtcacatgatttcctcacctcgtgcgtgtgcgcgaattaggattcccgcctttccggatgaaacataggcattgctcgaacacgtagagggctggtccagctggtgatgagctggtgacattatacaactatggaaaattacaagagtaatgtttctattcccgtctatcagtgatggagtcggaaaattttcagagcctaggcaagctaaggattgataatgagcaaagatctttcatacatgtaagattcatcatggttccttgtatcaacaaagcaccgtgtcattctgaaatttgaggaagagctagctataagtaaagcacagatgatccaaattcaatgcaaatgcaattgattaaaatcaagtatattatcacaataaactactcactaataaaaaaacaactcctatactcgtgctggttggccaattactgagtttgctagtactgctccttggcaaatcaacactttatttgggcagcaaggataaccactcgattgttgcatggagactaaatgatcataattttttttaagaaaaatgataagatggattaatatgtaatatataactctacaaacatataagttaaaattcaatttctacaagttgtaaaaaaatagcaaattatactatacctagtaaaatagcaaatttgagtatgtatattcacagtcaaatttgttattttttataagttgtacaaattaaagttgaacttatatgtttggaaagcgatatattacatattaatctatcttatattttttaaaaatattttataaccattgttgacatgaaaaatgagtgtaccttgacccgaatgtttaaaagagtttccctagcaatgattgcatgtaatttcaccagcacaggagagatgcagcactaactacatgatagattttcctggacgccgtccccttttgtttccatgctgtccgtaagtggaaccacatggaaaaatagggggacaggcgccgggctgtcgcccgtacgggaaaacacattatctgtgcgggcggctaagccaaccgcacacgaattttcacccgcacgggcccaccgcttttaaccgcgcccgcgcgcaccatctcccactccgcccgctcctccacctccctctctcccactccactcctctcctcctctcctcccactctcctctcctctcttcccctctctcttggccggccggcggcgcgacaacatgcggccggcgcgcgacccctccctctccctcgactgcgggagcaagcggcggcgggcgaccacggcggcccctcctcccctccctcccctccccttgaagatccagcagaggggaggcatgggggtggtggatccaacggtgcgcgcccctcccctccttccccttgcagatccggtggcacgcggcccctcccctccctccccttgcagatccggcagagggggcggtggatctggcgacgcgtgacccctcccctccctccccttgcaaatccggcggaggggaggcatgcatgggggcccggcggagcagcggcatgcgtcagcggtcggcgtggagatggggtgatggcgtcggcgatcggcggatctatctctccccctccttctctctttgttatcctctttgttatttgtgattctttgtggtttgtgagatgcatttttggagttcatttgttgctgtgagatgtgttcttgtgatgtgacagttcatttgttgatgtgagatgtgttcttgtgatgtgagatcattgtgtgtcgatgtgcgactacggatccggcaccggcgacgggagcgggtggcggatctatagccggcgacagcggcgggcctcggctaggcggcggcggcggattagggttaggttttttttcttttttttttgattttttgtttttctgtgttggcagcgtaagctactgcatgcgaaaatcacgattttaccagacgactgggtgtgtgcgggccaccctcccgcacgtaaaaatcgtttagcccgcacgaggtaatcggtattgtagtagtacatgccgaggagcctgggcgctgctgggccgtagatcaacctctgttgacgagggattgcgaattgggcgatggaatatgcccccaaactttttatattttaatctatactaatacatcaaaatatattaaagggtattttctctacttttgaaaaaagtttcaatcttacttctttatttattaatttcgctagaataggcttgttagtgttcagtgacaatcatgtctacgtaaaaatgagcttaatttggctcatgatgacgatatgaataagccttgagggctttaaagatttcatttgcctgcttaataaaaattaatttaatgtaccaaggtacgatttttcttccaactttcttttataaaatatacttctgatatagatagaacgtcactattaatttattcttttgtttcttagtatttttttaaacatatggcctctatttgtgtttcacacgggacctcacattcttaagtacaaccctgtgtttttagttttgaaaaagtgaaccctggcacatacatgaattgtctacgcagagagatcgacgatcaacatgatgatcacaagatatcaaataattaagtcacgagaaacaacaaccttttattcaacactgtatatttcgatcatacaagccggatagccagtctaccaccaaattaagctagcacaacgatgctatacacagctggtagtcgattagaagcgtcaagctacaggatcccaagatcaaagtaattacgagtaacatactacagtctacagtacatgcaacataaaatagtttagggtggagtaataggcgcctagtgcgtgcatacatgcttatttaattagccggccactggctaggctttgctgcatttaggggtgaaaatggataggataatatccgatccgatccgctccaaatccatccgtaacgagaatatggtatgggttttttttttttgaaatccggtggatatagatgtgtggggatattatgatgcggatgcggatgcggacgcagtatctctaaaatccagcagatgcaaattatccgatcttcctaacggattatctgataggccgtttgccggataatccgaaattatcaactcatgtaactactctatatgttgcataaaacatgagccagcccatctaacgacccaattcatcaattaacctagctagactctttagtttgagactttcatgctctcatctaacacttcgtagctacatttttatattatggacatcatatatttatgttgtttagcagttaagtatataattatttcgatggatcgtttattgactatttattgtagtcccttgcattgctaactcgatgttgtattgattgacatgtaacatctgaaaaatttaatccgtttccgaactgtctccacaacatttttaacatccgaaataatccgctccttataccatccacacccgcttgaaaatatggtttagactatggtatgaccactatctgtccgaattcgctctattttcacccctagctgcagccgagagcgaaggaagccttgccgcattctccgaggattccatccgcataatagctcctaacggtgatgggtattcctctagccgtgggagtgccgcacacgcatctggtggcgacgtttgatccggagctctgagatcagtgagcagtagcgatcgaagttgggaccaaagggcggctgaaattgtagagcataacaaaagcagtcggcgagacttgacacggttcctgcggcacactgcgtagctggagctggtgggggtggggcattggtggtctggccgctggcgaaagccaacagtagagaatcaatggcgaggaagaacactatgggccagtttggttgagtttaagattctgagaagcagctggttggtagcaagcttctaagaacccttaatttccaggttctgacttctagctcattttatgaactatacaactacaacttcttagaatttggaccaaaagatggattgtttaaggaaggttctaattctaagagaagctgcaactccttcaaagtgccctacggaaggatctgaaaggtgccactgtggagtgatgatttatagctagcttgaatgcttgatgatgcctgcaacgagttacgagtagtatagctagcttttggtggtgagagagacgtaggtgttgcatgcattttcgtttgtactttgccagaccgtgatacttcttctgaagctagtgttgccgtgcgtacgtatagattgtatatgtggagctaatccctcaggttgttgatcgcctttgaaagtatcgcactgtgcgtgaaccaagatttctacgtcgcccacgccaatagactttgtcactttgttagcttcgctagccggccgcaccctagctataaaactacaagctagctgctcaatcgtgtgggaaaaaaaaccgtagtgtagctggtgttcgagcacgtacgtatatatatgcacatagtccgcagtcaggagtaataatcgagcctaagtcaatcgcccagtatattaatcatgtaaatgcactactgcagatatcttaattgataccggttgaaaatcttataaagataccggattttctaaccggtgcgtagcaggcgacacttatgtagagggaaaataggtgttagtttaagaatgaccggtacctttgaggttccacaaataaaaaaaaatatcggtttgattcaagcgatgcatcaagtagctcccatcacccatgagatcctcatccaacaacaaaatcatgaaaaagaaatcatagaaaaaaaaaaaccatgagcttctaaacatagatctgtttcccaggaggaatatttatttaaagaatttcagacttatttgcgtttcccaggaggatatatgtgcttctaaacatagatctgtttctaattaggaaaaaaacgttcagatttcaaaattgtccactcaaagttactttcttataatttttcagaatttcggcactctgcagtgtttttttatttcttggtattttctaaatataggacccctctatttgtgtgtcgcacctggatctaaaaatttttaggtacaaacactttgttttttattttgaaacagtgaaccctggcacaaacatgaattgtctatatacaaaagatgaccggcatgactttctttttttttttttacgaatcgaccgacgccaattttatttaatagagtaggagaaaaaatttacaaagaaagcaagacctctgtacaagctaggcgataggagcctggttagtgactaaggtaaccaagaagctagattcctagctcccgctcgggtctaaaaattttggcctcctcatttatcttgtttattactcactccgttccaaaatatagcaatttttagctatgaacatatacacatagttgtccagatttataactaaaaatccttatattttgagacggaggtagtaggttggacaccggaaaaaaatataaatgacaaagtataattgagcaccagaacatcgctcttttgatggtaatggatattcctccgaccatgagagcgctgcacacgcatctggtggcgacgttgttcgggagctcggagatagccaagcatgcagccaggggtggaggtagagtatgggagggaggtggcaagaaacccggtcaagaaatttttttagctatacctcaccaattttcaccatgtgtgcaccccctaaatacaaacttagacacctgtatcagcttaaacttaaactaaagttaagtaaattaagcaatagacaccctcctccatttcattctaactctacccatgcatgtagcggtcgaagttaggtccaaagggtggctaaaaatcatagtgcataaccgatgcagacggcgaggctccgcttgatacgattccttcgttttggtaggtccagatgcaaacgtggcatcgatttctcagaatttgtcgacgtgtgcgtgccgctcgggctgaataccacggtattgcattgtgaaggcctttagtgaaggcgatggtgggggattattggtagtctggcagctggcgaaagccagcaggagatcaagaccaaatggcgaggaaaaacggcatggtggacttggagggcgccattgttgtttgctttcgatgagtgaacgcggatgacgatttctaggttgatgttaggcattgagatgtgtagtatttatagcctaggaggctaggaagcatcgaatccgtgcatgatatagcggttggtaccttgggcatgcatgatgttttgtctatacgtactttgccagaccgtaatataatatatactgcaagtctttacttcttctgaagagtacgctgtacacgtttatacagccactagtttcttttttgccacacaatcaatccgcatatttgtcaaggacttgatcaagtacgtatgtacagttgattagaaacagtgcacgtgcctaactcagccagtacatacatatagggctacaagttcgctgaaagtatgcatgcgaagctgtgaaactatccaggagtcatctcaatacttgtgctgaagatccagttcgatcttagggataattgggccaggtgaattagccgattgtgtgcacacggatgaaatgttgaagcaggaaacacgctggtgcggcccatggaacattgcacgagggagtgcaaatgttctgggccttggcccttggggtcataggacaaagtaggaagtagatcttgatcctaagtgaacatgggggatgtggccgtgtgggcttggcaccaaagattttgattttgcactcagacctccacaaattcgatccttacgcattaataatatttgtggacatcaaaatataaaacgtggtgagtgcagtatacagctacaagcacgactgcaccacaacactaaccatgcttctcagagtttgattctctaagtagcgaaaaaaatagtgctccaatttttaaaattcccatttcaagttcccattttgttttgtaaaaccttcccctgctagaagcagctacgacgaacttgggcgctagtgaagttcaagtactgaaccactagacgataggggcatcactagacgatagggccgtatacccattgataagttgtgaagagtttaaccataggtaatctcttacccatccggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggagtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcctacttcacacctcggaacgcactgttcttatagagagaaaggggctttcccatcttcttaacccgaaatgaaatggctgaggagagggaggttccttttggggtacccccgggaagagatccagtggagacggggtgggcctgtagctcagaggattagagcacacgggactcccggatcactatggccgggagaatccctctcactttaaaacactagagttttgggtactaaaaaaacgagtggtttctgggctcgcctcttcgaggggcctccgctcgtggacaaactctttccgggtcttacccaccctcgagtccaatctcgggtgggcgcttagatataccctattcactagaccggaatccaatccttggctagccttcaatggctaatgctgaaccatggaccggttgacagacaaaggtctagatagccactcgtgtatccactgtgtggttctgagcctgagactatgaaccacatcctgatcgcctatgcatacttgtgacatctctggcaacatatgatgctttgcagccggaatttagggtggtgccccaaccaatcactcggggtgtgtttagttcctgaaaaaagttagaagtttgaacaaagttgggagtttgaaaaaaaagttagaagtttatatgtgtaggaaagtttttaatgtgatatgatgtgatgaaaagttaggaataggggagaaactaaacacggcctcaatctagttggtgtggtggctcagtacaaggaagtttctgcccaagacgtggaagcgtggcttcgactcactcgtcatcctgatgatatggtgtctttggaaggagcggaacgccgaagtgttcgatgacgtcctcactttcgtgcaagctctgatttcttccatcttgcaagaacctgtctctggatgcatggaagagtggggactcatgcaactcggtttgctgttggcctctcttatttccgcggtgatcctgttcctttccctcgttggctttgtggctggagtttttttttagctctccataacctgtgctccaccctaagtaaattccaacctcttgggccactactagtgtgtttcttttttcgtttttgctcttttctaatacattgatcagcaaggcctcttacgtgtttgaataaaaaagttcaaaagggctaatctctcgatcgattgcctagcttgacaagtattgtactgtgcgtgatctaagacatttgctaccgctgtactgtgcgtgatctaagacaataacgttcacgtcaagacttttgttagctctctaaaaaatgattttagatcatgtgtagcaacaaaagaactagtgtcaaatggaggtgttggaacaagcacgtacagtcgatcaggagcaatgtatgcgcctaactcgatccggctgtagtatgtaattgatggggtcatccttttattaataaagttctttaacatcgagggcctccctgctgtatttatttaaagaaaacattgatggggcacatacatacgacgcaagtttgctgagagcattgaaacagtggagaagagtcttccctcttcagtactgtgctgatcctgtacgcagatgtaatgtatgggcgtgcgcacaaagtgtcaccggagcactaagttttgtctgggcccagggaagttggaaatacaacttgaaaaaataagcccatttaatggccaagtgaacatagctttttacaagtactacttccatttcatattatataggtcgttttgatttttttaagtttgtttaagtttatagaaaaatatagtagcatttatagcacaaatttaattttattaaatctaatattgactatatttgatagtttctttgttttatgttgaaaatattgctatatttttctataaacttaatcaaagaaaaaaattaaattagaaaaaagtcataacgacttataatataaaacagaggcagtagtatatttgaggttggaagtatttttataccagcaaagaaaattgtagcagctatctcgatttcgtttgagagctgttatcaaattttaagcttctgacctctgccattggattcaccatttccggttcccatcttcgtgcattcgccttccaatgggggaacttgtgtagctgtgtacatgaagaactggtgaagtttacatggtggaacaagtcttctcttttgtcttgggggaggggggttagcaggagttaggtaaatcattttcagaccataatataatagcactctctttattttatattataatttgtttttattttttccagtcaaacttctttaacattgtaaacgacaccaaattagtttattaaaaataatatttaatatattttgataatatgtttgttttgtgttgataatattgctatatttttctttaaacttaaatcaaacttaaataagttttgacttaaaaaaatatcaaagctcttataatataaggacgaaaggagtagctatcagtatgaagagggaaacgaggaaatattatcatacacctgtacccactatatttcgattttgtaggcatgcatgcatacacacagatcagtacaaaattaattcttccaggctagcacgtacgcataataacgcgtaatatgatcaagtcatgtgtgtgtgtgcgcgtgcacacacatatagcacagtcccagatcttataactttattattcttaaacatacatggatattaagaccctagcttatagctacctcaatgaagaacggcacgtacgcgcacgcacgctgctggcagatatatattgggtcatccaagtttaatacagcatatatgtagaggcaaacacgcaacatatatagatgctgcatgcctatatatagcatgtacatacatacgtatacttacgtatatatgcatgcacgctatctctcaacgtactgattaattaacacaagttacagcggaaaccttgccgcatgcttttaggatgttggggacattgaccttcagattgacgagggctttcaccttgatggcctcgcaaaggcagaaagcggcggtgtcgctcgggaggctggagagttgcgagcagcactgctggttcaagagctggttgccaagagcaacattaaggcacacaccaagatcagctaacggcagcgggcacttgggaggcggcgctggtgatggtgtcgggaccggagttggtgcgggcgtcggtggcaccaccagggctggtgctggggctggagtttcggtcggggttggcgccgtggctaggcatgggctatggccatgtagcactagtcccccgttgacggcagaagccaagaccaaaataactgatgcaaagaacaaggcagagttcattgcccgtttgcttgccattgttggaatatgtgtgtttgatgcttttagggtatgtgccttgtagtatttataggtatgtagcttgcaagttggtgtagcttaagtcaatagaaaacggaaagctttttgaattttggcgcactgattaacaaatacatttgtcagtctctagtttagcttaactccatacacctcattctcttctcatagtacaactcgtgccacaaactcgatctctgcacataatctcacatagattgcacacatgcgttgagtacattattcaatacattattcaacactgtatatttcgtacaagcctgatagccagctgtctagcacagcgatgctatacacagctggtagtcgattagaagcgtcaagctacaggacaccaagatcaaagtaagtacgagtaacatactacagtacatgcaacataaaatagtttagagtggagtaattaataggcgccagtgggggcatacatgcttatttacccggccgttggctaggctatgctgcatttaggccttattcggtttggaggggagtggggaaataatttcacaccataatagatgtggaataaatcccctccaatccctccctcataggaattaaccgaacaaggacttaggggtgaaaacggatcgcataatatccgatccaatccactctgaatctgtccacaatgaggatatggtatgggcttttaaaaatccgatggatatagatgcagatacggatattatggtgtggatgcggattatccaatctttctaatagattatctgataggacatttgccggataatctgaaattatctactcatgtaaccactctatatgttgcatataacatgagccatgagccatccaatgtcctaatttatcaattaacctaagctctttaatttgaggctttcatgctctcatctaacacttcgtagctacgtttttatattatggacattatatatttatgttgtttagcacttaattacataattatttcgatgggtcatttattgactattgtattgttgtcccttgcattgctaacttgatgttgtattgattgcatatacatgtaacatccgacaaatttaatctgtttccgaactgactccgtgccatttctgacatccaaaacaatcctctccgcgtaccatctgcacccgctctgaatccacttaaaaatatggtttaggctatggtatgatcactatatgtccgaatccgctttgttttcacccctagctgcagtcgacagcgaagaaaaccgtgtcatgttctccgaggattccatctacataagagctcctgactgtgatgggtattcctccgaccgtgagaacgccgcacatgcatctggcggcgatgttgttctggagctctaagatcagcgagcagcagcggtcgaagttaggaccaaagggctgctgaaattgtagagtagaacggatgcaatcggtgagacatgtcatggttcctacggcacactgcattgctaaatctggtgggggtggggcattggtggtctggtcgctggcgaaagccaacagtagaggagtagtggcaaggaagaacactatgggtctgtttggtggagcttaaaattatgagaagcaactggttggtagttagtttttgagaatttgaaaaagctggtttcccaacttatggcttctagttcattttctgaattctataattatagcttttcagaatctggacaaaaactgtactgtttgggagggcttctaattttgagaaaagttgtagcagttagaaactcctccaaacatgccctatgaaggacttggagggcgccattgtggagtgatgatttatatctagcttgaattcttgcaattcagcaaataattttgaacacccaataacaaattaactcttttattgggtgaaacaacacgtgtgttcactctaaataaatctgaagtgtcagtcctagggtggtgaaaataaatgtcctttttcactctactagaatatgattctaatactaggttagccaggtgtgaagcgagctagaggcggcctggctgccccaacatcccaataaaaacacccctcctccctatatagtgttttgcctttagaatactataggtgtgttcggctgcaccacttgaaatatggtgcggccatctttcatagtactttgtgttagcgtagcagttatatggcttcattgcagtggctacaattatacagctgaacattgcagtggctatatttttgttattctctctgtccaaaagtcttggtcctatatatttcatttcatggttttttcaaatcagatggactacaaataagtctccatatatctaaaacttaaatgaaaggattgtctttccgttttaacgtgctaaatattctgattgattgcgtggcaaaaaagcaaactagtggcgctggttttggatcaagtacgtatatatatagttgattattagaaacagtgcatgtgcctaactcacccagtacatggggtacgtacgtacatatagggctaagtatgcatgagctgtgaaactactatcaaggagtcatcaattcttgtgctaaagatcccgttcgatcttagggataattgggatcgtacgtgcacacagtcgtgcttgtagattttggcttcaattaatatattccgattgcgtgcacgcggatgaaatattgaagcaggaaacgcgctggtgcggcccacaaaacattgcacgagagggagtgcaaaactactgcaaatggtctgggccttgggtcataagacaaagtaggaagtaaatcttgatcctaagtgaacataggcgatggggccgtgtgggcttggcactaaagattttgattttgcactcagacctccacaaatacgatcattacacattaatatttgtggaaatcaaaatttaaaacgtggtgagtgcggtctacaagcacgattgtaccacaacaccagcaacgcttctcataatttgattgtctaattagcgaagaaaatagtgctccaatttttacagtttccattttgttttctaaaaccatcccctgctggaagcaactatgatgaacctgggcgccagtgaaattcaagttctatccttgcatggctagccttcaatatggctgatgctggagctggatgatggaccgcttggcagacgtttagatagccactcctgtatccgttgtgtagttctaagcccgagactacgaacctcatcttgatcgcctacggatactcgtggcatctctggcaacagatgcttcttgatgccaacatttaggttggtgccaatcttgttagctagagtggtggcttactacaaggaagcttctgtccaaggcgtggaagcgtggcttcgactcactcgtcatcctcatgatatggcgtctttggaaggagcggaacgctcgagtgttcgatgacgtcctcactttcgagcaagctctgatttcttccatcctgcaagaacccgtctctggatgcatggaagagcggggactcggcagctcggtttgttgttggcctctctgattttgtggtgatcatgtttctttccctcgttggctttgtggttggagtttttttttcgttaagtagctctccataacctgtgctagctccaccctatgtaaattccaaacctcttgggctccactgcctagtccgactgatcggtctgtatatttcctttgactctttatctgcataccatctgactccgcgctgctctgcaatacaagcaacgttcaaatagggtctaactctacttgtatctgattgctctttacaagatactgctacctgttcgctgatctaagcacatcctgctcactgctgtactgtgcgtgcatctaacacatttgcgttcacgtcaagacttgtttagctctctaaaaagatgattttagattgtgtttagcaacaaaataactagtgtccgatgaaggtgttggaacaagcacatatagtcgatcaggagcaatgtgcgcctaactcgatctggctgtagtacgtacatacattgatggggagcgcacgaagcgtcaccggagcatgaaggggttgtttagattgatgtcatttcaaatcatactattttttttataaaattgttaaatatatgcatctatttagttttctaccaaactctagtaaatacataagtaatcctaccaaaacttggtaatattgttaaattgctaaaatttggtaaagtttattttggctacaatctaaatagtccggaagttttgtccgggcccagggaagttggaaacacaacttgaaaaagttaagcccatttaatggcccacttgaacatacctttttataagtatttcttccgtttcatatcacataagtcgttttgacttttttaagttaatttatctgaaagtttgattttatataaaaatatagtagcatttatagcacaaatttaattttattaaatctaatattggatatattttgatagattctttgttttatgttaaaaatattgctatatgtttctataaacttgatcaaagaaaaaaattaacttaaaaaaagttaaaacgatttataatataaaactaaggtagtattatatttgaggttggaagtattttgtactagcaaagaaaattgtaacagttaggtgccggaaattcccgatcgaccgggtgtcgtttccatttaaggggtaccgtttccgaccgtacctttttggctatttttaaattttgttttttttttcgaatttctttctgtatcatattaatgtcgatactgagtagtttaaatgataaatatggtcaattaacagccgatcgagaatcgttttcgaagagatgctacagattccgaccgtttcagatcgttttcacccttagtaacagttatctcgatttcgtttgcgaaatgctatcaaattttaagcttatgatatctgccattagattcactatttccagttcccatcttcatgcatacgccttccaatgggggaacttgtgcagctgtgtacatgaagaactagtgaagtttacatggtgcaacgagtcttctcttttgtcttggggaggggggtttcccgcaggagtcaggtaaatcattttcagaccatagtataatagcactctttatttatatattaagttgttttgatttttttagtcagacttatttaacattgtggacgacaacaaattagttttattaatattaacatttaatatattttgataatatatttgttttgtgttgataatattgctatatttttctttaaacttgatcaaacttaaattataaaataagaaggaaagagtagctatcagtatggagagggaaatgaggaaatattatcacatacacttgtacccactatattttgattttgtaggcaggcatgcatacacacagatcagtacacaatcaaatcttctagcacgtacacataatgatatgatcaagccacgtgtgtgtacacatacatatatagcacaatcccagatcctgtaacttaattattcttaaacatatatggatattaagaccctacctccatgaagcacggcacgtacgcgcacgcatgctgctggcggatatatatttgggtcgtccaaaagtttaatacagtatatatgtagaggcaagcacacagcatatatatatatatatatatatatatatatgctgcacacctatgtatagcatgtacatacatacgtacgtacgtatatatatgcacgctatctctcgacgtacttattaaacacaaactacagcggagaccttcccgcatactttaaggatgtcggggattttgaccttcagattgacgagagcattaaccttgatggcttcgcaaaggcagacagcagcggtgtcgctcgggaggctggagagctgcgagcagcacgcctggttcaagagcgggttgccaagaccgacactaatgcacgcgttgagattaattaacgccagcggacacttgggaggcggcgtcggagatggcggattgacaggggcaacggtgggtgaaggtgttggtgccggcgatggcgtcgggactggagttggtgcgggcgtcggtgtcaccaccggggctggtgctggggctggagttccagtcggggttggtgccggtgcttggcatgggtttactttgcccattccagcagaagccaagaccacaacaaccaatgcagagaacaaggcagagttcattgcctgtttgcttgccattgttgcctatgtgtgtgtgtgtttgatgctcttagggtatgtagccttgtagtatttataggcatgtagcttgcaagttgctgcagcttaagtcaataaaaaacggaaagctttttgaatttcggtgcactgatttacagatacattgtccgtttttagtttagcttaactccacacacttcattctcttcccgtagtacaactcatgcatgccccaaacttgatctctgcacaaaacctcacatagattgcacacatgcatcgagtacattcggcaaataattttgaacatccaagaattctttttttgggtgaaacaacatgtgtgttcactctaaataaatgtgaagtgtcaatcctagggtggtgaaaataaacacccttttcactttcgtagaatgcaatactagtactagggttagccaggagtgaaaagagctggaggtggcctggccgcccccaacatcccaataaaaaaaaccccctccctttatagtcttttgcctttagaatactatatttttttgttattccctccatccaaaagtcttggttctattttattttctgggttttccaaatgagatgagcttatttgtagtctccatatatctaagacttaactgaaagtgttgtcttttttttaacatgctaaattaaattgttgactggaacccaagcaggggcggatccaagaacaaaaaaattggagggggggctcaattacacagtttcttcaacctccagccatctaggagcctttagtttattattcatggtgaaaaaattgaagggggtgctccgggggtatccatgggtcttgtgggtgtagaggggactcgagtcccccctgcacccacgttggatccgcccctgaacccaagcaaccatcttaatattcattggttgcatgtatgcatattgtttcttagttttgttacatgagggatgagggatgagtcaattctttttggtcttgatgataaaagaaatatgacttagaatttagggttagaaaggggtgtatagtagttattctaaagtcacgtcgaattggatatgggtgacatagaaccaattcaaacacggataacgtaccaaaattttaacgaaaacattttcaatttttataataatagagatagagattaagtacgaagggagatgaccatgtgaatagctaaggagtgagagagtggttgagagcgagatttggtgaaaattgaattgaggggtggtggttgggtggggagagtagttcttagtattccgagtaattgtatcttatgacaactgaagacaaatggagtaaatagtaatccatattgtcaaaatattttgcaattattcatattggttacaacaaactaggatatagacattgagtgcttaaaatgcttcccgccttgttccagtccttcacatttattttctttaagaaaaaaaaactagagtttacttcaaacaaacattgcatggggttgaagatagaccatgtgttatgtacaaaacagtaagagaaacacagagggactgcctaacaagtatacacacatgtattcaacaaatggaacgttctctcagagacattgtaggatgatcccaagacttttggctcaaaatccaatcaatgttgcgtgcggttgggggttggagcagtcggtacgtcatgacaaacactattgatcatatacattgctccctctcttgttcccctccattgagaaaaaaaatgaaaaaaccacctagaaattactttaagtttaacattccacgccataagtcattttgttgcaaatgctcacccctatactcggttttgttgaaaatccaccctagtgcacacatgcttgaccgaatcaatatattttcataaattgtgaaccgtcaatgtggtcttcacataatttaatacttctagaagaatagtcttaacaatttctttttgagattctacatatagaattgctaatgaaagcttaaaaattgctgcacctagttttgctatatgcagaaaaaaatataaagaataagtttaatgcaaatactaggacaagattgactcaattagcttaacctgtggtggctctacatcagtgataacaagctgatttggttaagcatatgtgcactaggatggtttttacaacaaaaccaagtatagggtggatatttgcatcaaaatgacttatgagatttaagtaaaaaaatgtcttatatatgagatggaatatcaaacttcaagtgacttttgatatgttcttttttaaattttcccttaatggagcgatcgaggttggcagcgaacgcacacaaggacctgaagaaaggttaacaccgcgcgtcacctcacctccgtcgttgatgcatgtacaaaacctctcacggtcaagagcgaagtacatgagaataccgggttacaccacagagaattggagtttcctcacttcttccttttctttttttaaaaaatcattatattaaacattaaaagtacagtacatggataaaagatacatcttcagccattaaagttgattaaagaacttccatagtaggataaccattatgatgatataagtaagaaaaattttgacaaactgttttagtagaactattaatatttgtccctagattttttttaaaaggtagtcagccatcttattcatttatcttgaaatctatcgaatattgtagctccacctaaaattgatttactcttgatagaagaggaaacaagctccagggataactggataaggtttagttatataattctgctatcttagaagtagtacgtaccaggtcctgattgatttgaaatgataagttccttacatatgcaaattgtcagattgatatacctgcaagtttagcttgaatacaagaggtataagaaaagattttgcttgaataaagatagccttgagagttatggagtcatgaatgaaaatgccaaagcctgattgatcttccatccgggaggcatcaacatatatagcatctattttcaggcaaaacattaatagagatattaggattatcttccagagttcccatatagtcatcccttgcttcaaagctcaacattttagtgaaattattagacatgacatctgctgcattacatataatatacttacataggttcccattcttaatttccttttaaagtaatatcattcctaactttccaaataaacccagagcattatagcatgattttacgtagtattatcagatttaacagttgctagtaagcaagctagaatgtctgaaatactttgcatgttatctactatgagagttgatattgtcctctcttctgttgatgaggctttggctagcatcagggtttccaaaaccgtcggggccagggttaccgcaccccggcggtaagcacggttaccgcgcggtaaccgcggtaaccgtgaaaaactgtataaaaccgtacaaaatttatcaaaaatttaaattattttttaaatttatttgaatttaaggaggttaccgcggtacttatattaccgtaccccgcggtaagcccggtaaccacggtaaccgtacggttacctacggttaccgacggtaagtcaaaccctggctagcatccactcaaggactactaaagtatatgaaattaactaggagaagattttgattggttgagaagtaaatctaggtgaaaatattattatagtttagaaaaaaaatttaaatgctagaagttattttattttagaatggatagagtactctacgtccggaagcaacaggcttgaaattgaataccccgggattagattaattccccctgccgtgaccactagccgcacgtgtccctggcaacgaaaatgctagtcctcacagttttcttgttttagaagctactgatataaaaatgttttgtaggtaaaatttatatttgtgtttacaaatcaaggctgaaaaatgcgtttccaaattaaggctgaaaaatatattatgataaaaaaatccaaaatcaatcataaaattaaattttgagtaaaatttaaaatatccacctttatcaagttaaagttataaagttataaaaaaacactactgggcaaagccccggtagttctttcagtcaaaaaaattatagaaaatcgtatgtatctgtggcacataaccacatgagattttataagtgttttataaaaccctacctttattcaaatctcgattaatttcagcatatcctaaacaataattttttcaaagtagtgaagttaaaatatcaacttaagaactcaataattataaaaaaaagagatcataattcatagacactatatttttaaatgtaagtatacacaatatatatcgaagggttttgtaatactttataaccacaatgccctaatgttatgtgccacaaatcaaaataactagggctttataccacgtaatttaactataaatatagggttctatgaaatttactgttaggttttagctgcaattgagccaaaaaagacaatattatagaaacgattttttcggacaaggcccctctaagttgtatatgggccataactgtcgtgcctacaaaattcgctcccctgaaaagcgaataatgggtcgcccgcatgcgaaaatactaatttttgcacatacctaggtgcatgcggacgtccaaccacatgctaagataggttttgaccgcttgcaaaaatcttttctgtagtagtgagaaatcactgctcgtacgtatggggacgctgccagatcgagaaaccatgtacaagatcacctataaatccaaaatttcaaaccgatgatacaaaccatgtttggatcatatacagcgtataacctagtgttcagtcttaggccccgtttggtagggctccaaactccaactcccaactctcaactccaactccagagagagctagctcctataggagctgaagtgggtatgaaagtgtttggctagattagttagctccgcgcaaatacgttccttgttggcatttcgtcgaacacctggttggcgtcgccttgctactgccgccgccgctcaacccgtgcgccgtcaccgccacccgcctccgtccccgccgccagcggtcagcccacgggtcgccatcgcagccgtcgtcacacgtgcgtcgcccggccactgcccgcacgcctaccgacgccgacgtcaacgcagccgacgccgacgtcgacgcaaccgacagccccgtgccgccctggccagccgccgggccgtttggcccagacagcgccaagctccgccggtcccgcggtggccctgggcccgtaatttggttcngnncgccttaccaanannattccgccttccnncctgggnananaagncngnanattannaattggnnggggggggggggtttttcccccgggggcccnccccccccggggcccaattgggcgnanaanagnnnactaatntnnttcgcacattatctannggtgcaggcagacgtctaaccacacgttaagattggttttgaccgcctgcaaaaaaattttctgtagtagtgagaaatcactgctcgtacgtatggagacgctgccagatcaaggaactctgtataagatcacctataaatccaaaatttcaaaccgatgatacaaaccatgtttggatcatatacagcgtataacctagtgttcagtcttaggccccgtttggtagggctccaaactccaactcccaactctcaactccaactccagagagagctagctcctataggagctgaagtgggtatgaaagtgtttggctagattagttagctccgcgcaaatacgttccttgttggcatttcgtcgaacacctggttggcgtcgccttgctactgccgccgccgctcaacccgtgcgccgtcaccgccacccgcctccgtccccgccgccagcggtcagcccacgggtcgccatcgcagccgtcgtcacacgtgcgtcgcccggccactgcccgcacgcctaccgacgccgacgtcaacgcagccgacgccgacgtcgacgcaaccgacgcccgtgcgcctgcagccgccgccgttgcccgcgcgcagccgccgtccgcgtgcctgccgtaattgttcgcgcctacaaattcgctcccctggaaagcgaataatgggtcgcccgcatgcgaaaatactaattttcgcacatatctaggtgcagacagacgtctaaccacacgtt

SEQ ID NO: 37938 - DNA, 21929 bp, Oryza sativa
  unsure (1)..(21929): unsure at all n locations
caagcaggaaagatgacattggaagaacaaatgttggatggttttgtctttatgacaaaagcaacactttcttactaccttgcccgacatgtcatactcttaaacttgtgctaactatgccacacttttgaccaactatttattggccacattttttccactatgccacaacttggctaagcttagttataacaatgtaggcatagggatggtaacgaggctacacctgtcgggttcaattatcctattcccatccctattaagaaggaaatcaatctaccccatccccgcactcggggaagggtttcccctatcactgtccccgcatagggttcgaggcacacccaccgaatagtaggagtgcagcaggccagtatgcggcagccatggcgcactcctgccgctgctgcttggacgcgtcatagcatcaggtcttgcttggaggcaacaatgacaacatgatgcgtatgaaaccaatgtggatgcattagccatggcacgacgcgaatgctcagcatggatgtggcggtgcaaatgtttagcatggagaggacgcgatgaggaggcgtggatccagtggcacggtgcaaaggacgagacgaggacacgggttggtcgcctggagtcttggcaggcttgatctagagcactcaagaggaggggataatatgcctagggtttccttactttctatacgagggacttgtgaattgggcctctcctaagtggacttataatttttatatggattgtgcgctcaagcaatatgcacatatgcctaccatactcaggggctcatgggaaattagggacggggggctagggaacgtcctcgttcccacttccccaatgcagacatattttgcccgacaacaacccccatgggtgatgattttatcccatttacatgccctatagagtaatccccaccggggttcaggacccctaccatccctagtcaggcatcaaccaaacattccctcaatagtacacaacgctacgatataggcatctagataggatctttattttaagaggcatccttaatttccataaaacattattactctctatataaccattgttgatcaaggctaaatatatagaatggaccaaaaattaattaaccactgtgatgaagattccatctaaacatacttttattatcatttagattaatctgcacaatataagcaaccaagttatgccatagcacaaggttttgacccacaaatgcccttcaagatacattgtgtgtaacagaattcaaaacaattgcaattgatgcactttttctacgaactaacttatatagaaaagggtattgctccttgaaagaagaattatcaatccacttatcttcccagaatttgatttgttaaatccaaccccccctacaaatcactaatcattccaatctcctaccctcaacttaataaaatcatcgattgtatactataaaaaagtatgtattaaatctcatgcccaataagagaagacatagggaacaacttcgctcaccatgctagcgatgcacgatgggataaatcactagtacagatccttctatctgtgacgggctctaatatgcttagaaatagcgggccgtcacaaggaagtcatctcaatcgggccgaaaagtgcccgattgagatatggtcgcacagacatgttagatgggtataaaacttaagcccgtcacggatgacacctatcagtgacgtgcaccaacttgaggcccgtttgagataacaactaggcccgtcacagatgactcatcagtgacgggctatatacttaatctctatcgagcattaagagatatgtgttatatattattcacaaattttacatatatgtgttatagtttataaaaccagataagagatatgtcaattttgtaaacaatgttactatcactttgtcgtatgaagaaatgaccaaaataaaagttttagatcttgatgagttattcaactttgttgtggatgactttttcaattgatatcatttagtatttgaaaatgttgtttgaagttgtcatattttcaaattcaaattcaaacggttcaaaaaatgttatatagaaaaatgaccaaaataaaagttatatattttgatgagttatacaactttgttgttgatgactttttcagttgaagtcgttcactgatctaaaattctatttgaacttttcaaactttgaatttcaaatttcaaattgtttaaatagagtcagatggagaaattaccaaaataaaaattttgcacctcgatgagttctacaactttggttttggtgacttttccatttgaaatcatttaataaccccaatttgacatcctggcctagggcataataggattaatagaatactcataccaacatgttacaattacttttccggaagccaatctctaaagaactttgacgttaagtgtgcttggtctggagtaatttcgagatgggtgaccgacctttctcatctgtgacgggctataattaatgcccgtcacagtcacagatgactcatctgtgacgggctatagttaatgcccgtcacagataagggtcatttggcgctagttgtggcccgattgagatagctcttcacatcagtgacttctagcctgtgacggacgccatgcccgattgagatggggcttaccgctcgattgagatgagggtatccgttctagtgaatcactgagcacataaaagctagatagaggtggcacgttgtaagagaaaatggacctttgaggagtattttgtacgaaattaagctataggcgggagattggaaaggacggtgacttgtaggggattatttgggttttccaaatattaataatgaaagtgcacatacttaagaacttgtcttttcataagtcccgacaaaaaatgagaatcaccagacattttcacaacttgtataattgactaattatttacatatttccttctaagtaaactctgccaaagagcatcctcatttatcaacatgaaaagcttgactacaattgttatggtggagcttgagggctgcattggacaaattctagggtagcgaggcgagggagctcaaggatggcggtctgggattgggtgcacgtacgtgagagatcgagagccgtggccagcgcacaaactcgatggcggcagctgggggtgagagcttgagagtcgcgaccttggggagttcaatgcatgcagtggcttggcacaagggcacggtggtggccaacacaactgtggcaactgcggggggatcgaacttgaggttggcggcaatgggtgacctcatgccatgaggagtttgagggtggcagccttttgcaatctcgcagctgctaaaattgaactcaagaagaaagggggatcgatggagctggccggctgccctgtccatgcctgaactcgattgcctaagatggagatgaacaagctagtggaaaatggaggtaacattacaggtatttaacttctttttttttttgcggggaggtatttaacttcttacttttgaaggaaatgaaaatgaaggacacttcatagaaattcggacggaatgctatatggaggaacgttaaacttaggtgatttttggtgatattaaaatggtttagatctttcaaatgttatatatgtaattaagcttataacttccggcgctacataactaattttgccctataactaacctacagttgacctgacccagtaatgatcagtacaccaaaaagaatctacaaatccagtcatctgttgctttttcatgaaatggtggatgccatcagaaaacattcatccatctatataagcttattatatatagtaattcatcagtagtaatttctgttccggtaatggtttgtgcgtccacaattagtagcataacgggaaaagaaattacaaatagtactgggtcaccttgctagttaatcggctatatattacaaattaaattaattagtaaattgtacatcccttaattagcttgagcgtccattacgtacatcggttaagttaatacgtaccacattaattaattaccgacacattgagcatttgatttgagcagctatagtagctagctagcacctcagcgatgcatgcatggaaccatatggatcatcactattcggagcttggaggtgcaggagggaagctagctgccgcaccgccatggcctgcaaaaccttgctgcccttcctcgctgaagctgccggcggcgccctggtccacatccggcgctgctccttgctgccacgccgggtcccacgccggaacatgccacgccggcatcatcggcgccggctgccccatcggcgggtagtagtacggcagccccgcggcggggccggccgctccaacggcgccggcgggccctcccgccgcgaacccgagcgcgctgccgggctcctccttggcctcctcccgcggcacgatgtcgacgaggaagtcgaacacgtcggtgcgcgcgatggcggcggcgacgtcgttgcgctgcagggtgcggcgcttgttctcctcggcgtgcagccacgagcggatggtgagctccaggatgaagagctcgcacgccttggcgaacagcacgggcgcctccgccgagatcatgcgcacgtcctcgtccgccttcatgatcttcttgatccgcgccagcggcagctggtggttcttgaagtccgacgccgacgcgcgctccgcctcctgccgctggtacgcccagaacgcctgcagctgcgcctgctgctgctggagcaggtggtggtgcggcaccgccggcggcccgcccgcgccaggcacgcccggcaccggggctccggcgcctgcggccgccggctgaccggcgtagggtagctgctggttgtccattgtcacctatatatacgtaccttaattacagtcgatttgtagctgtgtgtgctgtgtctgcatgggcaaaattacggcgattaatttacgtgctaggaacgaatgatcgctacatgctccacgtatgtaacaatggctagctatacatgcaaagtgtaaacgacgcttgtaggtattgtctgtgagagatcgaaggattgataagcatttctcaatatgtgtgcaaactgcaaaagtaagtagagattaggagacgtactctagagcttcgttgctccacatgtgcgacggatcaaacagatgagaactcgaggctggctataggtggcgaagtgcatgtgtgggggctacttatcttctatccagagatcatatcatgcatgaaaatgaagctaagcgcttgcaaacacacagggtgttcccaaaggagatctggaaggagagaaacaggagaatcttcgatcacaatgagacctcagtgcctggtctcctcgcagaaatgaaggaagaggcaaggatctgggccttggcaggagcaaagctactcctacagctcgtacactaaactgcttttcctttttctcctttacccttcggggttgtatttcttactgctatatattcacaatctcgtgtttggttccattcaaaaagttagttatctggtatatgataccagtaggatttgacgtggtccgacatttcttaatttcatatactactagatgtttcttatttttcagagatccataattttcctaaaccattacagatctcaccgaaacaaaagaggatcgaggccggatgacttcagaataagtcgatcatagcattatgatggctaaggattgtcctttcgttcaggaaaagtacaaaatcaaggaaaatgcagatagaacatagaacagtgatgactgataagtgaagagaactagctacttcgatgatcaacttacaaaaagctctagggagccagtcaacaagctgttttcgtttatgtagaagagggggaaaaagaactctggtttgcttttctagttcaagaaagaaagtgaaggaagaatagagaagaatgatgcagaagttgaagacactgcaaatgtaacagaattgacaaaaaaaaagctggaacaaatctaactatccattagaaaaaatgcaacaatagattcacgcatccatgcatgtcgatctcaactagttaattaagttcttaccagaaagcaaaacaggctagcctgtttgagtgaacgagctctactgcttcagatatccaaaagtatcagggtaaattaaagaacagcacagcaaaagtatcagatgcttcggcacgcatggggatcgatcgtcaggggaagcaggagtgcaggacacactcctcaccgtcctacccactgcctagtgcctgaacaaaatggccatctccactctcaactggggttcttgccttcttgctgcaattaagctgaaaaaaataaaatccatgaagtggacggagaccttggatatctgaagcatgcacgtcgttctcaggctctcggctgcttggaagctagctagaaacaattttttacagtgttcgctaatactttccactcctgcagtactgtcagcataatacccagtaaaatcgatgttactctgaaagttttagccaaaaagaacagtctgaaaagggataaacacgttgtctgcaccgtgacactgtccgtgaaaaccgatcaacgggggttgttgttgtgttgtgatttgttgttttttttggcttgtacctgaggataagaaaagatgaaggggagatccgggagagcgcgcattcgtggccaggcttggtcttttcggatatggatattatccgttctggaagtctggcagcctcacaaaattctacgcttagatttggggacgactgccccctgctactgctggatgcggccgatccatcgccgaaatctaaatctgcagcatggccgactgcacgttatgatttctggcgtgtggggttcacgtatccaaccactgctgatgaacactgaacagtgccacacgaggaaatatcttagcatggatgcatgaccaaacagatcagagatttaaatagtactactgccactacaccagaagcttgatgaagcagacactcagacagtcagacttcacagtcatactgttgtgagagatttttttcgcatgtgaaatttcgagtgtttctctaggtagtacgtagtacggagtagtaaaactccatgattgcaaagctgctgtaaataacctgtgttacagcttttcataagttttttctgcctacaataattacagtttctttggatcagcaaagagatctcatagttgatcacaccgtggtcagcttaaaatatgtagcatatgttcccagctcccacaaaaaggaaaatttctagtagcatgtttctgggccatgtttctggaaaagtacaatgaacaaagtcagaagtataacacaaccatgggcttaagtttggacctttttttgaactttaagttttgggccttaggcccaagtgaaaatgtaaattagcctgtactggaacctaaaacccaaaggaaaaagtacactgaaggaccctcaacttgtcattgagttacaaaatcatcccccaaccacaaaaccagatatattacatccctcagcttaacaaaaccgtttactttagatccttcggtggttttgaccccagttttatccgacgtagccgctgagtcagcgggagacccacgtggccccacatgtcaggatgccaactcatcacctctctgttatttcccctcctccccctttctctttctctctctccctccttctgctccccagcgtcgagcaccttgttgcaccgcacgaacaccggcgggatcaccagctccagctctgcatccttcgtcttcacgacgctcctctcacctgtcagctcgtggatctcctcgtcggtggtgaagagtcggtacaccgccgctagcctcgacatggcgctcatccacagcccgggcttgccgctgcccggccacagcgcccgccagttgtcgccgcggtactctagcctcccgtcctcgttgtcgactggctcccccgtccggatgtgcctcgcaaccacgcactccgcggcgacttggtgcggagccgacgaggaatggggtcgacctacagccagagcgccgccttcctccacaactcccgcagcgagagcacacgaagaggaaggaggcggggaggcaggcagcagctcgttcctcgtcgtcgtcgtcgttcggcggcgacgccggccgccggacctcctccccccccccggcggcgcgcggtggaggaagccgctgccggcgacttcgcctgtaacaccgccgccgccaccgccagctcccgtcgatctcatcctccacgccgtgctcaaacggcggaggatggggcacagtcgtgggcggcgcgcggcgggtgctgacgctcttgggttgccctggctattgctcccagacgaagggcaccatgccggggtggcggacggggccagagttgaggtcggccttctagtagtggcgcaccgaccggagtggtgtgcccaggtcctcagcctccgcctcgtcctcccgcgcctgccctcccacgtacgccggcacgccgccgtggcacgcccgtactgccgccgccacaggtttcagctcctagcgcagacgaagacaggcggtggtggggaagccgcggtctgcgccggccgcccgcgcgccgctccgttgccagccgcccacgcgcggctcctccccccaccgcctacgcccgtgcagctgctccctcgtgcggcacccgtgaagaagagaggagagaggaagagagatggagaggggaggggaagaagaggctgacgcgtggggcccacgctgagtcagttgccgtatcggacaaaaccggagtcaaaaccaccgagggacgtagattgcactggttttataagttgggaaacgccggatatctggttttgtggttgggggatgattttgtaactcgatgacaaagttgagagaccttcggtgtactttttccaaacccaaacttacgcccaggattgtgatgtacttcagactttgtccattctactttagcccaaaaggttgtccctcccatttgacgggctatgtactttctacgtgtcccggcctgttttgagtttgtgatcgacctgacccgtttagtgacatgctatccacaactctgataccactcggccccacatgtcggtgacgctgctacctcccgcgaaacccagacgcttcacgttcggatccgaaagcttcgcagcccggggcaatcacgaactgccaccgcaccgtcactgacatcctggccccaccccgtcaggtgggggcccacagcccgcccccccaccggtgccccgccgcgccacgtccccgcataatagcacatggtcgacaaccccccgcctgtctccccgttcagcgagccagagaggaaacgaaccgatcgatcaggccgtcgctccgctcgccgccgcgcgacgcgacgcgacgcgacacgccggagacggacgacgagcgctttgccttccccgcgcgcgcgcgcgcgcgcacggaggcggacgctggtcggtttggtcgggtgcgaccgggaacggcggccatggcgcgcggcgggggcggcgggtgctgcccgccgatggatctgatgcggtcggaggcgatgcagctggtgcaggtcatcatccccacggagtcggcgcacctcaccgtctcctacctcggcgaactcggcctcctccagttgaaagacgtaagtccgtatatccgctacccccgtcgattcggcggctgttcgtggctgacaaattcgccgagagagggagggggattcggagtggtgcctgtcccgatcgtgtcgatctgaggcgggggatcggttggtagtgccccgtgctcgcgatttcctgggaattagcgggcgtttcccgtcggcattgtgaatttgggcattgagattgatgtggtgttacggcgtctacttgttcgcttcactttttttcgttgaaaaccgtgatattgtttgcttcactttttttcgttgaaaaccatgatatgcaggttttgcattggcgcgattgggtgacaatgttgtttggaacagaattcacgtagggatacattattctaatttcgatgcagtacagagttgtcttctctgtaatgcgcccacactagcaatagcaagtttaaagttacttttactctgttagactgttagtataaaattgtactcctgtattagtagatcatgggaaatgctgatatagtttgaccctcgcaattctggaacaactcaggatgctgcctttgttttttgtcctatcccttagaggttaaactgatgattttatttttttttcctcagcttaacgcagacaagagtccttttcaacgaacatatgctgcccaggtactttgctcgtttatcttttttttatcacttatgttatgttatggctgagactaattgataaaaagctttttacagcatgttgaaactgttattctccccttgttcttatatagccctttcagtaatgaactagagtattatctattgagatttaaaaattataagatgtgacattggtataaatgaggaaaaagtccaaatatccccccctaaactttgaatgaaagtccatctagtacactaaactttaaaaccggacatctaaccccctgaactttgtaaaactgttcatatttctatctaaagtttaggatggtatttggactttttaaagtttagggtgctatatggatttctatctatatagtatatctcatgttcatagttttcattaccttactgccttatgttaattttccctgttttcatgctgggatctactcgttgtgcagataaaaaggtgtggtgaaatggctcgcaaattaagatttttcaaagaacaaatgtccaaagctggcatatcaacttctgcacaattaactgaaatttcgttggactttgatgatttggaggtgtgtcaatcgaatggatttttcctgattgcatgcagaatataaatctagtattattttaacacttttgaataacagataaagcttggannnnnnnnnnnnnnnnnnnnnnnnnnnaatgcaaacaatgaaaagttaaagcggacctacaatgagctgttggagtacagtactgttcttcaaaaggtatgactctgttatcttcagtatactttcatgaatattgtcaacatcatgttgaacttgagatatagcgtgtctgttagatcttttgcaaaccacttgtttccattcctggttcctcacattgttgccagaacaatactatatgaaattgccactatcttaactccaaatgatttcacccatggggtaatgtgcacatatttttacagtacactctctctcaagtcatggtcgtactacacatgtagtacctaagtagcctgtttctctcgccaatctgctttttgctgactctttatttattattattttctttcattttcaggctggtgaatttttctattcggctcaaagaagtgctgcggcgcaacagagagaaatggaggcaaatcaatctggtgagagttcactggagagccctctgctggagcaggtaaaactatcatactgctcctccctgtacatggacattcatgtagtaccattgccatgatgtgcctcaagattgatgttgactttcaaattttaaacacacaacatcccatattgtagtaataactttaatcattcacaaatctcagagcactttggatttacaggatagtacatggaccatacatgcatatacgtgtgtaattgcaacccccaccttttttttttgttttctgtttgcctctctgatatgatcttggttacccttttaggatacgttaacagatgcatcaaaacaagtgaagcttggatcattgagtggtcttgtaccaaaggaaaaggcaatggcttttgaacgcatcttattccgtgccacgaggggaaacattttcctcagacaagagtctgttgatgaacctgtcactgacccagtctctggagaaaaggttgctgttatattttctgacgtttacagtgcattttttgttctttgtatattccaccatgttgtcctttcaaagtaatcttggtatttggattatacatctcggttcatttgcgccctgataaaaagaactttgttctatgagtgatgaagttattttttatatatcttacttcctgtctagtcatgaagttattttattatttgttccaactctaagtcttcattctttgtatgataacacaggttgccaaaaatgcatttgttattttctactctggggatagagcaaaagccaaaattctgaagatatgtgatgcgttcaacgcaaatcgctacccatttccagaagatgttgctagacaattacatgctgttcaggaggtcaggtcttggaaatgtgatttgttaatattctttgatgaaattctttctagtatttcgaaatttagatatagtcctgaattgctttcagaaggtagtgaggatgccaaccgttgagagaatcatctgcacgagttgccctttatggacattcttgtgctttgcttgtgatatgtccaatgttaccatccctattctgatgtcactgctgtcatttcaatttcgaatttgaaaaatgttaattaattattatagatttataatagctagactttgttctgtgccttccaatcattacttttgctgttggtgactaatgaaaatgatttgctgctattgcatcttgtttgcaccataaggagatatgtcattgggagaaacttgttttgcagttgtactactatgaatttcagtcaataaacatataaagtctatgcttatgaatttacaggtatctgcaaagatatcagagttaaaggcaacaattgacatgggattagcacatcgtgacaatatattgaaaaatatcgcgtctgagtttgagaattggaaccgtctggtaagctatcctcttatgtgataaattccatatgttagaaaattccgaaatccaccagtcaggtcattatttcagttctatatatatgatactaattagcatacaaatgctccaggcaaataaggaaaaaataatttaccacactttgaacatgttgagtgttgatgtgacaaagaaatgcttagttggtgagggctggagtccagtttttgcaacaactcaggtaattgatacaccaccctggtgctaacaatttattagcctactgtttccatttgtttatttgggagattattcttcatgtgatctcaatgatttacaactttattttgcagatccaagatgcgctccagcgagctactcttgatagcaaatcccaagttggttcaatttttcaagttctcaacacaacagaatctcccccgacatatttccagacaaataagttcacttcggctttccaggaaattgttgatgcatacgggtatgtttcagagggctctgagatgctacttttggtttctcttttggctttggaactgaaaataatatattttcttgtgggttgttccaagttgtttatagcaccatgggatatgagacttctattattgtccccccgcttttggtttcatctcagaaatgatgctcttttcaccattcttttgctggactcactattttcatgtgaaatcgacaaacttttggttcgcttaaagaaaagaaaggaaaattgccataattcactgttcctcttcaataggcaaagacatgccatcattccctgttatttgctcctcaattgtgcattctaagtgaaacatttccttttttgtttcccttttgtggacatgtctaccacgttgaaatcattgtgttcatattgtcaaagaagcacttaaacttgcaataggaatttccagaatttttgtgcttatgggaaatatattattttatctgaataaaattagcattgactcctgaaaaatcaataaagagcttgctgtttgtttgggccaaatggtttagttaggaactgctaactttgtattacatctgatacaggatagccaaatatcaagaagcaaaccctggtgtattcactattgtcacttttcctttcttatttgctgtcatgtttggagattggggacatggaatttgcatattggtttcgacactctatctgataatccgagagaagaaatttgcttcacaggtttgcatactggtcatcattttactattgtgttgacaatcattttgaggactttgttctttggaatatgtagtagtgatcccaaagagtttagagcaagtatttatattctgaaagccccaaaaatttacatatgtgataaagctgtatctgatgtctgtttcttattgcagaaactggagacataatggagatgatgtttggtgggcgctatgtaattataatgatggcactcttttcaatctatacaggattaatatacaatgaatttttctctgttccatttgagctttttggtaaatctgcttatgcatgccgtgatccttcttgtgggtaagaaaaagtttcaaacaaaaccacgtttttatccctttaaaaaagaatatttatgcctacttattgtttgtcttgtggatttagagatgctgcaacagaaggattactcaaggtaagacggacatacccttttggtgtggaccctgtatggcatggcagccgcagcgagttgccgtttctcaactcactgaagatgaagatgtcaattcttcttggagttgcacaaatgaaccttggaattgtgattagttactttaatgcgaaattcttcaggaacagtgttaatgtgtggtaagtttattgtctcgtgttgaatgcccttttatgtaacactctactttgagatgagattatgaccagattattctctattgctgctgtatgcttttgtaacaggtaccagttcatcccccagctgatcttcttgaacagcttatttggttacttatccatgctcatcattatcaagtggagcacgggggcaaaagcagatctgtaccatactatgatatatatgttcctcagtccaacagatgaacttggggagaaccaattatttcctggacagaaaacagtgcaggtccgtattcgttattgttatgcagaattgcagactatgacatgaacttgtggataaatactaaaattttctccatttcttatgcagcttgttttacttctgcttgctctggtgtctgttccctggatgctgatcccaaagccatttttcttgaagatggagcatgagcgagtaagttgtatatgatatttcaaattctattgctgtttacgtgttgaattactaatgtgctgacaatacttctgtttgattctatcagaggcatcaaggacaacaatatgcaatgcttcagagcacagatgactcagtggtagcggagatgggacatcataatggctcgaaccaccatgaggagttcgagttcagtgaagtttttgttcaccagttgatccacacaattgagtttgttcttggggcagtctcaaatacagcctcatatcttcgtctctgggctctcaggtacttctagacattcagcatcaccgcattactttgaacagccttactccctcatcatcccacttttgatctataacaatgcactccttgttagccactaataatcgattaaattgtattctttatacagtcttgcacactcggagttgtcaagtgtattctatgacaaggttctcctcctagctttcgggtaagaactaagaagcctccctctccgcctcctctccttttctccctatctatgtagccgctatctggagctcatttttatgtgccttcttgtaggtacaacaacattcttatccgcatcgctggcattaccatcttcatctgtgcgacagttggtgtcttgcttgttatggagaccctaagtgcattccttcacgccttaaggctacattgggtggagttccagaacaaattctatgagggcgatggatacaagtttgcgcccttctctttcgcactgatcagtgaagaggaagactgagtttgcgcaattattgcatctattgtagcgtgtaatttcttggggcgtccttttttctcaaagcgtcaagtatttatcacggaagaatcataaacctccagtttgttccttcatcaggaaagggactagcagcatcattttttgctttgctacgaatgattcgtggcaagatgattttttgggtggccgttggcacatcgggtggcatcacccttattttggtgtaaggctaataaataataagtaaattctgcactcgggttgccatttgggcaattagttttctgcacataaataaacattgtatcaaatgttaatattccattgggttcttttattgtcaataaagagtgcggcctacattctttaaaaggtttgtagaattgtaggaacttggaatttgtctggaggtttgtagaattttctacctgttatttgtgaacggtaaaggcaatgagcaattttgttaagctggcccgtttatatattattgattcagtagtctgaaatcaatgaaacatgtatgagtatttcccctagtttcatgcctaatctcatgctcaaatcagccctgtttttcataatcaatatataatacgaacggaaagaaaatatctacatgataaaactcttgcggtaacattgtcatccatgcaagaccaaagaaaagaaaacactacactgataaaccttgttgtaagttgtaacatccatgcaacgcaagccaaagattatcgttgattatgggaaaccaatgcctatcactagtgatgtactaagctcccaatttcgggaaatttattcgtcaatggtgggcacgctgctggcgctgcgcctggcgctgctgaacgggccagtgacggtccggccgacgaacttgccagccttgctgaggccggtgccgaacgctccgatgccgctgcccacggcgccgatgcccgtgccgaccagccccacgccggagccggcggcggtggcgcccgctccgggcgcggcggctcccgcagcgacgcccgccccagccgcgggggtcaccgtggacgtcacgccgctcgccgcgtccgcggcgccgctgacggccgccgtctcctccttggtcttccgccgctcctccaccgtcttcttctccagctccagcgcctcgagcgcctccgccttggtgaacgggtggtacagcacctgcgtattatcacgacggtcagcgtcgaacaccttcgcgtctcttgtcccaagaacccaagacgcgccgccgtgtggacatgagctcaccttgatggtgagcacgcccctgtccttcttgtccttgaccttggtcgtgtccagcgacgacagcagctgcaggttgatctcctgcacggactccatctccaggtcgttcaggggcagcttggctatgcccagcctcttgtcttgcttcagcttgtcctcgtcgaacacctgcagagcagaacaatttcagaccccccaaaaagaaactaaattctccatgtgttcgatcaaagcttgagctggggaaatgcacctgaaggatcagatgctgcgtctccttgtcctcggcgatgagcgagaacgtctcgttccactcggggttgaggttgtcgtcgatgacgctggtcttctccttgaacattgggcggatgtacagcaccacgtacgggtcggacttgccgatcagctccttgttcttgagcgactccgcgcgcaccacggtcaccgtcagcttcccatgcggcttcagctcaaggtcactgcagaagagctcgaacggcagacagatcaacaaactaggttcaaacaaaggcttttattttcttttttggaagaaaatttcctgtgacaaattcagttgagctctaaaaacactgcaaaattgggcagatcatgcgaaccttacgtcgacgtcgactccgcccagtgggacgacgattctgtgtggccattggagcatgtcagcgatcaaagatgccacggtgtcctacacaaggcaaatgaaaaaaacatcacatttctccagacataaacagttaaatttctactatttgacaatgcaggtaaatgcatcagatgacatacgtcgatcatatctgaaagaccaggcattgctgtcaggcttcctccgacagccttcagtatgtagtcgatccttggttttggctgccaaagacagaaaattcatttgtcaaatcaaacagatcacgaaaccacttcttaccatgcaagtgtgcatggcaggatcagctggttagaatgattataagaagctcacctctgccagaagagcaacaacaacagcagagatgcaaggtatttcatcacacaattggaagacgacacggatgatggtgtaaacctgaaggttcttgaactgtatgcatacagaacaaacatgccaaatgttactaacatgtttaactgaagtaatagtacagtaccactagaaaaacaagaacatgaattactaatgtgaccagtaggttttacaaatcatggctagcggttgcgatttgaatacctgaatgggaagtgaagcaactagagtgtcaactgcaaggacaatattaggatccccgccccaacgaaagtcgacgtccattgtaatttgccctttcttgaagctctgaatccgaatgcctgaacaaaacagaagcaaacagatcaagatgtcatccttggaggagaataaaatgcggtaagactgacgccaaactttttctctgaaaccttcaattttcggaggaacagtccccagggagagtttgctgaacttcagtgaggatatccctgccggcctgtaatcatcaagtataggctccaccgaatccctgatgaccatagttgctgcctgtaaccaaatgtaactgcaaatcagaggcggtgttaacagcaagatgatcagaagttacttctgtggcttgaaatggaacttcatttgaagcctatgtgattctctcctaaagttctctataagaaacaaattgaagttatttgtatgtacctcttcaacaaaaggccaaagcttgctcaattgtttgttgagccatttaacctgaataacaaagcaaaatatactcaaaacatggatgaacttaagcatgccattgaatactatgatgaacaatcgtatgcctaggatgttggtctcagttttctgaatattaaagatgctatgatgataaataggcacaccaaaagagtatcattgcacctgttcatactctgggaatgacacccattctgggagattttctccacatattttcttcacgtcttcgcggtcgagagatgcaagtgcattgacatctgcagcctgatacagaattttttttaaaaaaaaaaaagttagccacaaaccaatctgtttgcaccaaataacgtctcacttatcatcaccattttatatcaacagtatacaaattcaactaaacatagaattcccaatatgaatatactccactgcatcagtcatcatccccagaaaactaagtcagagttaaatttacaatgaggtaagtccctcttgcaaaacatgtacataacacaaacgatcataaaaatcatttctaaaaggaaacaatgaataacgttcttaagcctgaatctttcagacgattcaacacattcaaagcagatatatccaaaaaattttcttcagcctttcacgaaacccttaacactgccattcatgcatgagtcgtaacagatgtcaagaacaacagatgcaaactcgtcaaaaacaaaaactttctatgactgatgactcgaaatcaaggcgtgcatcacatgcgatgaatttatgagatctgtcatgtggttgtggatttgccttggcactgcgtttggcggcgcggcgagccatcgcgcgcgaccagccggcgatgagggcgacgccgatgatcattcccatcaccacccccgatatgaaccccatttctcctctcctccttcccccctcccaacgaaaaaaaatagagaatttgaaaaggagaagattagaagatcaaacaacacttgtcgtgcaacaattttttggatcatattgacgcctaatctctctccaaattgttgatctgctgctaacgctccattgatttggggccgagtttttcgcgtgctaatagtgaagtactgcaacgagagggagagagagatgcagaggggcaaaggtgtaattacactacgtgctattggtgtggagatggctgtgaccgtgagcacaacggtgaatttcgcatgggtgcatcagggcaatgcacgctattcacgcatcaaacctagtgattagcgcgtctcaactcaagctggagagcgtaccatgaggtacgagttaccataaggtaccaatctaatctaactgttgtttagcaggggtatgattgggctaacaaaatagcgacatcctctgagccgccctcttctcccctcttccatctgccgcatcacgtcgtttgtgctggccatctgcgccgcgccgccgtcgcacatctaggctgccgcgccgccgccgtcgcatcgaggccacccccgggaatgtccgcagggttcgtgaccttcatgcctgtgccctcgccgccagctctcgcccgctctgttctcgttccaattcaccgccctcgagatcgctctaaatcatcaagcttgtccgccggcccgtcgagctcgctccgattcttcaacctctgtccgtcggtgcactcgagctggctggtgcttggagctccttctttgcagctccgtgatgttctgtttccacaataacttcaccaatgaatttaacctgggcaaatctgcctaagtgttcatccttgttgaaaaatctggatgagagaaacccaacatctgaagttcttgatattgatatagatatagtatgtatgcatgtttcctgttcaataagccaatttatctatcaactagaaatttcaattattcagaacgttgttttcacccatggctccatcaccagtcttaaaaaaaaaactatggctccatcgtcttgccctggacgcgtagctgctgcctgctggtggccttggcttcataccatgatgcaggggcagcgtccacctcctcttccatgcacaactgcaacagttgctgcggcggcgaagctcagctcggtgcctcggtctgcatcggcctcttagcacaatgaggaacaacggccaccatccgagaggtctccgccaccgtcgtccactcccatggccgccgcctccgctgtactagcgctgaggacgagggaggagatagggtagtactctgcccgcatccccatataggaccacctcccccgtggtcaccgccgccgggaggccgactgccgcatcgggttgctcgatttgtggcgacgatagcaagcagtgcgatgttcccctccaattcatatgcgaaagtactactctgcccttccaccgttgaaaattactcggtacctgctttcctagagacgcggtaccgcgaggtaccaagcctttgcaaccgttggatggtgcgtaatggacgacttggatttggtacctcctttcttcaaggactgtaaaaactctccaagctggaagctgaaggatttgtgacggtgtccagtattaccgactacttgggccaatggtctcatgggtcacggcccatgttcattagaggctgagctgaatatagcaggcattattgcagcttaattttctttttcaacgtgtcgatggagtttaaagtgtaaaatgcaccagcggtacttaaacttgtcgggaagtttcacttaggtccacgaacttgcaaagcacatatcaagatctctaaacttggtttattgtatcatcccggtctaaaaatgcgtttgaccgtggtcttgtctacgtggcacgccacgtgaacgatgacatggaatttttttttatttttttctcccctcttccttc

SEQ ID NO: 37939 - DNA, 13178 bp, Oryza sativa
ccggcgcccgcgctgcggaggctgtcgtgccagcagctgaggcgcgcgacgggggggttcgcggcggggagcaagctcgggcagggcgggttcggccccgtgttccgcggcgcgctgccgaggtcggggcaggccgtggccgtgaaggtgatggacgccgcgggatcgctgcagggggagcgggagttccacaacgagctctcgctggcgtcccatctccttggctgcggccacggccacggctcgccgtccatcctcctgccgttcgcctactcgctctccgcgcagccgcggcgccgccggatgatgctcgtgtacgagctcatgccgaacgggtcgctgcaggacgcgctgctcgggaagaggtgccccgagctggtgtccgagtggccgcggcggctcgcggtggcgcgtgacgtggccgccgcgctccattacctccattccgtcgcgcaaccaccagtgatccatggagacgtgaagcccagcaatgtgttgctggatggtgagctccgtgctcgcctctcagattttggcctcgcgcagataaagtcggaggagagggatgaattagagagtgctgcaattgagggcaatggaaatgagagtagcaatccttgtggcggatgtgatgatgacatgtctgttgctgatgaaaatgctactgctgttgctgtcaatggggaagacaatgctgccaagtcaccggaagatgatgaggggtttaccatggcttctcctgcagaggcagcatccacttcaggatgtgataagactagtgtcagtagcggattgaatggccgaagctgcaatggtggaggtgctgcagcatcaggagctgggaatgactggtggtggcgtcaggacaatggtggtggttctggtggtgtcaaggactatgtgatggaatggattaggtcggagatcaagaaggagcggccgaagaatgattggattgcaggagcatctgcaaccacccctgccacctcaacagagagaaagaaaacaaagcgcagggcgagagaatggtggcgtgaggagtatgctgatgagctaaccaagaagcaaaaaaggcgagcacttgctaagtcaaggagtgagattggtccaatggctagcatgcagtggtgggagagggactgtgacttagaggagaagggacgatcaaggtggagaatgatgaaaagctggagtcgtaggagcagcaatggcaatggcagcattgattggtggattgacggtgtgagaaggagcagcagggattgggctagtggggaattcgtgcccaagagtggtggagcagtgagcagcacaccaagcatgcgtggcacagtctgctatgttgcacctgaatatggtggtggtggacctctatcagagaaatgtgacatttacagctttggcgttttgttgttagttcttatttctggacgccgcccactccaagtgacggcctcacccatgtcagagtttgagaaggcaagtcttatttcatgggcaagacatcttgcccgtgttggccgcttgcttgatcttgtagaccctgcgctgcgggatgttaaccgtgaccaggcgctgcgatgcattactgttgcactcttgtgcatccagagatcgccaagtcgccgtccatcaagtgaggaggtgcttgaaatgctctctggtgagggtgaaccaccgaatctcccagtggagttctcaccgtcgcctcctggtgggttccgtttcaggtcccgcaagaaaggtcggtgagtttattttgttggttagatgaaataggtagtgttacttttctgctgctgcttgccttatcttgtacaccactaatttgtgtacactaccactaatttttctgttgaattgatttgtttataaagatcttgatggggaaaagtgacggtttcagtttcaaatcttaagaactaaggttcacataatgcaaaatgcataattgcagtttggcaatttatgtacaacactaacaaatttatccatttgatgtatctttgtacaaagatcttgatagggggaaaggtctcagtttcagttaacatttgataaggactcagtacccatttttcgaaatgcataaccgtggtttgatcactcctgaattgcaaatttagtatataaactatgatatcaatacattgctgtacagagatctttatgacagaaatggttgtaatttcaattcaagtttgacaagaactctgtccccataaatggcatacatcatacatgatgatagttggttaacaccaggaatgtggaatgttgtgcgtgctagaaagacagcttcagaatatttttctattttggattggaaagctcgcttcttttgctggtagactgggaagcatcttgcttttggatgtatagtgttttgctgggccctgtgatagtagctgtttatttcttcccctggacaacgactttctccaggcgtacccagttatgtgataacttttcatgttcacagatctcttccacttctttttgcactgagatggcattataactttattcagctagtatattctacatattgctgcaaacagcttagagaatgctatatgaaaagggcttctttagaatcttttgctagtgtagtgtggtcactggtcagaatttggtaaaagatggtttaggtatatgcatacttttcttgtgagatctgattgcttgatgccgtagagttgcccgtgctttatctacaatgtggtgtgcatttattgtcacctttggatttagggtaaccaattcaacaatgcttttatctacaaagtgatatacatttattaccaccgttgggtttatgataatcaattcatcaatgccttatctaccaagtcatgcattttattatgaccttcggaatgatgataattcggtcggtcatgccgtcagggtatccacatattatggactaaacaatgtataaatgtatttatgatggacaaataatacatataacatatactataatttatgatggagtagtataatttgtagagatatttacaagtttaaataatatcaatattaataacatggactagtgttagtgagctcggctacaattaaaatatcaagaggtggggtgaaagtaaaagaaggaagaggaatgcttcatgctttggcaaatatcccatagtaataattttcagatatccgtattattatattattatttgtacatgttagaagctttagtttcgtatttgtatctatgaaaaactatccatatttgtatcattatcagtatctgtaccattatcagtagacgattatctaatctgaattatatccgcatttgtttttcttcgaaacggactaagattgtgttcttttaagaggttcaggcttcagcacccgaagcgagataagccattagcacattattaattaagtattaattattataaacttgaagttaaatttatgtgatttttttataaaaagtttactccctccatttcatattaccccctccattccataatataaggcacaaccactttttttagatgttccataatataaggcatgcgtgcatgtagacaattaactatgaccacctctccaataaattattactttttaaaatcctacactcttatgctctctaattctattggatgtatgtattgtatttattaagatgataataattatttcttggtctttggtttagaggtggttatgccttatattttggaatagagggagtacttgtcgtcttaacatttacgcccctttacattttaatacctgttgtttctacattccaaagcacttttaggggcgatccttctttctaccccttataatgcacctttatcttctccattggcctatgttccttgaaaaaaataattgagatgtatttaatcagtggagatgtatttaatgaggggtaaccatgtaatctgccatatctccttggtttgagtgagatttgctagaaccaccaataatataaaacggaaggagcatataagaagttttttcacgaaacatacagttagcaatttaaaagatgtactgtggtaagctagtagctggagtagtaactaagcataaaactatccactctatttttatccctacgtggaagactttgatcggtcccccaaacatcttagacgtttcaaatgcctaattaagtcctcggaagttcacttcaggttaaaaatgtcagacgtcaataagtccagccaatggacatcaaacctagatgtaggctatgttcaatgggaaaataaatctcaaaagtaagaaaaagtattttgtttgattcgacctgcagtcgggtatgaaatgaagcacattagcactcactagaaaatactatccgagaggctaatttctgctaattgatgttatctaaggatgattttgaccaacgaaagcttggagagctttggatggacacctttggggcaatttataatgcactggagaaagccgcattatgtcccagtagtctgtttcttaatactgctgtcgctacccggctcagggggagaacggcagtgaagaaatttagcatgagcgaaaattaaacattaaacctgatcaagcagattattgcccatcagagctattcagcacgacaaaacaatagtatgacaaactatcatttgctaatagtatgacaaactatcatttgttgttacaacttacaagggggtatactagtatgaaaaatatgaggtcaatcaagaatatgtgttaagcctgtcacgttctgcaactgcaagcatctactaattttcaggatagaagggcaggcatgctaagctcgagccaaggggagcataacagcatacacaactctgcaggttttgtcattttatttatattcctctagaaggatgatgtacttctggccattgatcttctgcaggtgtgagattttcctcagattggcgagaaaaacttccctgtcctgcagtacaagaagaataaccaagacatcaacattttgcccatgcattgatttttgggaagtgtaatgactgtaacagggcattgacaacaaagtatttgacacaataacagaaatgcggactatggactcttactccctccggtcataaatatttgacatggttgactttaaccataaagtttgatcatttgtcttattcaaaaatttaatgtgaatttgcaaaaatataagtcatgtttgaagtaccttttaatattttattaaaacaagtcccaacaaaataaatgtaattataaaataaaatgtaataagaatggttaaacttcagggtcaagatcaattgtgctaaatatttattactggagagagtagtaatcaacaaaaaaaagtatgtgctccatacagtgcctttatgtgatgtgtgtgtcacgaagaaagatatcaagaaactcaagtagcatttgataaattcaaggccaaaaaaataaaaccttgaattccaaaacgtgcagttagaatatgacgtcatgctcagtactgtatttgtataaaaggattactagatgtaacagtccagaacagaacaaatcagaaagataaaacatcctacctctggacttcttagtcgaggcgaaaatctgggcataaaatcttttgaaaaatctcgcattgcgataggtgcatataaacgaagtaccaccctgatttcctccactgtaataggagatacatttgtatcacttctcgctgaggcaaatggttctgaagttggttccaaggaacacgaggtctcctccttcacgactatcttcttggtatcctgtaccaaatatatcattagagaaacaattcagtgcaatgtaattaaatggttaaaaacttcgttcacatgttttgagtgaaatgaagtaacttacaggctctatcttcggctttttaggggtagcacaagtttttgaatcatcacccctttgtctcctcttttgattggatttggaaacatgtggagtgctataaggatgtccgagaactgttggtttagaatggttgtcttcctgtggttcacttttgagttgatcctgctgtttcggagcaagtactggcgatggtgactcatcttcctgtttagatgaaacaactgtaagcataacatatattccacaaaagcatattatatgaagattttcaacaggaacaatgattaaaaattattacatccgtgtcttcatcgtcatcatcagactcgttttgtcccgcggcacggcggagcaacttctttagttccttaccagatttgctcaggcctacccctccatgtttctcattatcatcctatgagtagtcacaagttcatatttgaaaatgtattagcaatactgtggtaaatgcatcagcaactgtaagccacaaaatggtgtactagcaggatattgcacgaatgccatattgccatgttgactgataagtatgatccccgaaaaaaaaatgataagtatgagcacaagtgcatctatttctgtccacacctgcttaatttctggtggagcagggatttcaggatcagctaaatcacctccttcctctgggtcaacgtccacagcttcatcatcatcagtaaagatctcttcatgttcccaatcatcacctgataaatagcagggtccagctaaagaacttcagaagcccattaaagggctaacatacatgcattgatttacagtaatggtttactttattatacgtaacaattaataactatttggaataaatagaaataacaatgtccttatgatacataatttataaaaaaaaagaatagtatctagccagcttacccttttcaatttcatcatccaaatcaaagtctctgtctttactaccttcctcctccctaccctttgtcataggcacatgcgctctttcttccccactgcctttatcagatttattttcatccccattcttgttgcctttcttcaggtgaacctgatctgtttctccttcattagcatcatcgagctgcgtcacatctgaactaaaagcagcagctccatttgtagccgccttcatcatccaccgtccatacccagttgctgtgcttctcctcctgctcatcttctcttcagcttcttccaaagtcagctgtttgtactgtgaaattttactgaagttatacctgtaaaggcataccaaatatgcaagcattaaaagagtgattcctgtttgatggggctcacagtattgctattccttgtcaaaaagattttggtggtgattattgttgaaaatgaagtggaaaataaatcaacatatatatcgtgagtaccaggaatcagcgggaacagcgtgtacatccttgccatgcatcatcaacaaataatatgtcgaggctgcagattgtaagccctgaatttgaccttggtactgatagtcacctgtatcatcttccaaaatacatgactttctgttgctgcaattctcctgttatttgacaaatatgcgtgccacacgttaagaggatcaaaagcaaaaggcagggttaagttcttgagtttctatcagtcaatgaaaacaatttattgcagataggtctctttacatgtacattttccatgagataagcgatttaaagtttgtgccattaaggccatctaatagcatgcgaccaatcaatgatcttagatatttattgcttcgctccttgttgcttcgaatttatcgtgttatgcagatggaaaaaaaaaactatgatgatcatccatgataacgaattaagtagtacccatatattgccggtaggttgccgtccttgctgtccctcgggatgaagagaccagctgcggctccccgcattctccctatcggagaagggcggcacaccggtggtgaatttgccgatcgtatattgcttctctccggtggtatccaccaggacattgtactcctgcgcacgagcaacgggaacatcaaaacttcaggggaagggcaagcaattcccaaaacagccaagcggcggcggagacaatgccgacgcgcacggaaccaaaagccctagggtcgccggcgcacggggagtactaagcagtagtgcattacccggatgaggctggcgatgggggcggcgcagacggggcagcaatcgccggagcgagccatggcgctgccgcaggagacgcagagggtggcgtggcggcaccccgtgccgtggaggtccgacgacgagccgcagcgctcgcacgccgccttgagcacgaggccgtcggcggagacacccatgccgtgcgccgagcgcgctctctccgccttcgccgccgccgccgctgctgctctgctctccccctcttcgtagggttttggtttggttcggttccgttttgggcggagcgggggaggcgacgagagcgaggccgaggccgaggcgcggtggagtactggcgtgacgtggcgccggttagctagaaggggggaggggctccgagtctgtctcagtttggtggggacggaaacggagtcaaactgatctgaccggtgccccgcgcggcgacaaggtagtggaccgtgctgggctgggccggaccgtgttccatacacgggcttccattttgcagtggaaaaagtacgctgaaggtccctcaacttgtcatcgagatataaaatggtccttgaaccacaaaaccaaaccggatacaacgcatcctccaacttataaaatcagtgcaaactgatccctcggtgattttgactctgttttgtccaatgtagcagctgacttagagtgggacccatgtgagccccacccgtcagcctcttcttcctctttcctctcttcatctctcctctcctctcctatacacgggcggcgggggagggggggagcagctaggtgtgggcggcggacggcaggggagcagctggctagcttgggcgcgggcagcaagcacaggcggcggacagcgagggagcggctggctagctgggcgcgggaggcgggcacaggcggcggtgggaggagctgcgcagggcgggcagggaggagcgacacacgggcggtggttcctcgcactctctgccaccagagccgccagctcctcctgtgcgggcgctgacggacgcccgccgccatcatcaccatggccgctggacaccgacaccgatgtggagcggtcccctccagcggtcgcgcccgctccagcttcgactccaaccaggcgaaagagccgcggatcgtggcgccgcgatggtgcctagctcgtcgggaggtcgaggcaagccaccatcgccagactccccaagctcccgcgagctcaccggcgacaatgaccgcccctcttgcgtgttccttggtgagaaaatggggatggctggtcgagctcggtgacgacgccgcgcgcaccggcctgccggcccttctccccatgccccatcatcgagaagatggggacggccggtcgagcttggtgacatcgccgctcgtgcctgagcgccaccacccagctcctccccagccggccgccgcccgtgcccgccgcaccggtcttccacgcccagctcctctctgtcgtgcgaccggttgagctcggtgacaacgtcgcccacagccgcgcaccagcctgccggcccttctctccatgcgtcgccgtcgagaagatggggacggccggtcgagctcagtgacgccaccgccctcgcctgagcaccaccacccagctcctctcccgccgaccgccgcccacgcccgccgcatcggccttccgtgtctagctcctctccgtcgggcggtcgcccatcctcacccgccgtgcccagctcctctcccccgctaccggtcgctaggaaaaggaggagagatgaagtgtggagaggggggggaagaagaggctgatgggtggggcccacgctgagtcagctaccacatcggacaaaaccggagtcaaaaccgtcgagggacctagtttgcactggtttgtaagttggggaatgcgttgtatccagttttgtggttcaaggacaaatttataacgtgataacaagttgaggggccttcggtgtactttttccttttgcggtcgcgcaagcctgggcggcatttcgcatcttggcccgagcatgaaagaaatttgcaagaattataggatattgtgtgctccataaagggaaatttgctaggattataggatattttatcctatatcatcttattacaaatgctcattcctatttaattttgttacaaaactaccctggtgcgcacgtgattaacccgatcaacatgttttcttaaattatgagttaatagtggtatttacaaaaattaaatatgtctagagtatagtcttgattttttttgttatttcacaaatatagtcgttcatgagagctggaacattgtcatgttgagtttctctatatgaaaaaaaaataatgaaatatgaagaataagtctaatgcaagtacttcataattcggctaacttagcttgcagtcttcctacaatagcgataacaaaatgatttggttaagcacgtgtcgactagggtgatttttgtaacaaaattaagtaggaatgtcaaaattcaagtgacttatggggtggttttgtaattttcccttctataaaagatgaatgaaggtgaggaaatgctttttttttttgctcgattatatggaagacgcacatgcactcacaccgtgactaaaatggtttaagtgaattttcttcaaacattaacttcctccacctcataaaaaactaatttctgattatgaatttaaatgtagcctgctttcagcttttaaattttatatgggacgaaggaagcatgttttagtaactccagaaaaaaaagtatgtttcaataacttatatggggcggggtagtagttttccgccttggtagttggtagtagtatacagtatatttaaacacatttatcacggtcgaagcgggcaataatacacagagtacacatctgatactctgatagagcttggcggatcgaatcatccattttctgaaggaacaagctatcgacttgagtcttgcaagcaagtcagcaaccaatgtctaatggaacggctcaacttgtgttatacgggatctctctttaactaccatacgctaaattaagcggcattattggtctctttaactaccatgtgcgctagttaagcgtccttgtttgtctttattgtggttaacaagtcttctcccaacggtgctctcagtactaacagagtgtgaaagccattaaacatatggatcgatccagccaagccagctgctgcaagttgatcgagtggacatgcttgagaattgagatgagacgctcgaacagtgcacgaaagcagcagctaccaaactacgcttgtcggctgatcaggctgcttgcgcgtgcgttttctccaagctgggcgtctggtggtggcctggtggagagcgctgtacgcgcttgacgctacacaatacactcgccagctgagctgagctgagctgctggccctgcgcgtcttaatagcaggattaagctgcagattgacctcgcaacagtcggagatgacatctacacaataatacaaacgttgccgatcgattcctggtgttactggtcattatcactcgttgttatcgttcatttatgaatttaaaaacttaactttaagttagttttaaggttttctcataatgatttatttttcaacattaacttttaaaccattaaaaacacatatttaagcattttatatacttattacaccatttatttcatattataagttgatttgatttttttaatagtcaaactctttttaagtttgaccaagtttataaaataaatatagtagtattttcaacacaaaacaaacaactatactatcaaaatatattttatgttgcatttaatgaaactaatttaatgttgtagatgttgctaatttttttataagtttagtcaaatctaaagaaatttaacaaagaaaaaaaaatcaaaatgaacttatatgatataaaacacagagagtattatttttctacctgatgtcggatgatgccatatctacagttggtgggttgcgtcgtcacgctgtgtctgcctacctgggccctggggaaaaatatgaggtattcctacaaaggcggcttagcgctatagtcaattacccgtgacctaatactttaatactactatcattccccatcatgcagtctgcataaagcggtgtttcaaccttcgcttgagattgagaagttgtgccatcttcaaagaatcaaagtcttcgacgtacctgtaatttttaacgtatagactgaaacaccgggtgagagcatgcaggtgaaactctaggttacgaccggcgcacgcagcttggattaggtttgggtgggagggtgcagccgtgtagaccacggggagacggcagaatttaaagcgtacaaaagcatttctttttgcgaatttgtggtaagtttgttattattggtacatgatgaaatctcaaatgacaaagtatagaataatttctaccatgttacaatattatacatccgccttgtggggtcagaagcggtaaagattagatccgaagcttattcgcccggaacttttgacagtgaacacatgccaaacaacccgatttgccggtaagtaaaaaggtactaccaagtaaaaagggaaaaaactcagtggagaaaaaaaagaagaaaagccaacgtgacaaccgcccatccagaaagcaaagataagaggtcgtgaggtcgtttcgtcactatagggagtgtacttggctatggagagtccatcgctcgtcactctcccaatctaatgctgatgctgatatgattgccaatgtgttacttcctccattttacagtataaaattttatagtattgttaatatttatttatatgctaataaatctagacatatatatatatatgtgttagatttattaacatatatatgtatatggacaatactaaaaagtcttatatcgtgaaacggagagagtatgtatacttcgagaattgtcgatactctcggtagataatgccatggcagcaaccaaccaccaccagtagtccagtacagtagtaccaatatcatagtggtggtagttgcagtcaatagcatggtctcctcctctcgatcgatcacagcctgctccttccggcgtgtacgtcgctgccggcgccggtgtggcggcggacgaagtcggtgacc

SEQ ID NO: 37940 - DNA, 25050 bp, Oryza sativa
tattcttgtttgagtcggtttttaatttcgttcgcttttggaaatatagggtctgttccgctgcacgttacagcccttcttcacagccaagctgctgcttgtggatgcagcgaaagaactagcgactagttgccttcagctgcctagcagctactgtaacaagcagccgaacaggtccatagatttgtgtttgagtcattcttttttatatttgttcgcttttgaaaatataaaagaagtcgtataagaaatatcattaaaacactcacatgctaacttgagacgaaagtccaactcctaatcgcaactcatgattttctaaaaagaaaattcaagcgagtttctagagtaaattcaccctggctaaaccgtataacaataataagattaaaatggtcttcacacgttgcaacacatgggcaatttttttctagagagtgtgtgtataaagtacaaaatgtacaataaatatatattgcacgaatactacttgcgctagtgtttattactatactagcctatagctcgtgcgttgcaatggaaaaacaaattgagtttgtagcttagtaaattagttaataagtacttattagtttaagtaatagtataatttttttgttgaacaagtaagtgaatttaaaatttggagggaatcaatagtgaaattgggagaacctgttgaaaggtgatcgaatagtatagcttgtggggcctagatgttagtggtaggggtgtggaaatggacaccaccactattaaaatattttaagtagtatatatatatacggcttatgcataagagttaaaaataataattcaaataactttgtcacattttatttatactgcgttaaaaaggcttttttatgtcaatgatagttatgtttatttgatagagataagtgtcgattttttaggtcacgactatacatggtatggagatcgttggtaccaaggtatatgcgagattgagataaaagagatggagacaaggattttatacagatttgggcgccttatctgacaggtaatagccctactcttgttaaccgaagccgatgttgcttttattcttcataatcacacaagtacaataattgggataacctatctaactatcatcgacttggtggcatagatcaccaacatgtattcgatgacagggtagtctttctcctcgagtacgaactcatcgagatcggagatggcgctagatccctcttgtcggcctctgtaagcactagattgggtttgtctaggcttatctctgatgtcgatgtctggcggcgtattggtttgttctaacttgtgtgtcccctcccctcctaggggatgttcccttgtccaattagaactagggagaccaattaatatgaatacaatccgagtattacttatagttttcatatagaactttatttatcattccttatccggaacttcttctatatataaggtataattccatataaaacttggtatatagtgggccccgtctaacttagtcgattactattagttatatggtatccataatcatgataataagcattaaacgtgaagataacatcttaattgcattattcacataaaagatattgttcaaagaaattgcaacgtagaattttacagtatgtttatgacatgtttttgcagatgcaaatgaggcaaaagagaataacgaaagtgggttctcaggaaagagcatgaagacgagctaggtttatgcgtgctccaagagttaaggaagagaagaaaaaaaaatacctatgctattttatattattttaaatgataatgttagtggtggtgttcgaattgattccaacttcacaagctgacatatggggctataagatcaacgcatgtgaatgcacgtttttgcttcggacatggcattatatatctaattaactaactatgcaataaaattgtattttttgctgaaatttttatctctataacatccgttgcaatacatggtccttttgctagtaagagaaaaggttatacctaggagcatatttgaaccactaaaatgatagcttatactccctccatttcaaattgatctatatatagttttttttgaggttattcctaaatgatctacatatttgtattcatttattaagtctattcgttatttgtgcattagagtaaatggacattgatgcatgcatccatgtacacaagtatttataacccacatgcaatatcttgatttgctattggctaagaaatagtggggatggtacatacattgagtttgttgctagagtaaatatagtatgggaaagttattagcttttcttggtcttggtgtacctatgaaatatgtagatcaatttggaatggatgaagtattattaaacatatggccttcaaatgaaatacttgtgatagtatgataatagattctaatatctgaaaaatatggtcattacatgcttttacttcttgaatacacgatatagatgatttattgctatgaaaaaaacttttcaaatgacaatactatgtttagtactccctccatttactttggatagtaatattttatcttggcacacagaccaagaataagcaattctacttatcatccatttaaatataccactagtcattcctcgtaaacaagcgattcgttaatatttacatttctcgatgcccatgtaaccaatcttgtgtggaagaatggagagtcacgcattaaatttgagaaagtcattaagatgataggttgttggattgaaatatgcctatcaaaaataaatttttcagatttagaaatatgactatcaaagatagatggagagagtaatatttgtcactaaagttgctctatgtactgtaagagaagaaaaggaacaaatttgagtgtgatatgctcatatgttagatttgtccttttcaaaatataatatatatatatatatccctccatcccaaaatatatttatcttttgattgtttttgtttattccaaaataaccgcatcttttaaacaatcattgcatcgggttttatgaaagtaagagataaatatattataccaatcctaacccaagacactagacatagttttcataaactccacatcatcaagaaactagtattagacactactctttcaatacaaacaccattgtttcatacttaaattctatactacttatctcatatgatatcttaaatgttgtgtgaaaccatgtctcatgcaagtcctggtttcttctctttccttatttattcacttggcacatcatctttcattctaagtggtaaattatttaatgctatcgacacatcctagttattgggttgggactggccttaggactagatagtgggagacaattgtattgatatttgaaaaaagtaaaaggtattttagttttttatttggtatgtgtagaagagatgataagagggagtaagtgtgagtcatgtttatgttttttttatgacacatattgtattaaactattaatgctgtcaagtgctataaacaattttcatagcaattgcatgatatttgacgaaacgagggtcgagggatatacccccctcgagtctcatggactggaagggttttctcccgtactaaagtttgttagtgttcactttcatgcacttctcattttaattttttttactgatatgggctgcaagcctccctttttctaaacacgtcactcttgttgaactcatcacgcatgactcgccgattttgcaccgagtcccattcaacaatcagcttgcgatatactgtagaagttctaattagcggctgaataaacacgggtccctatcgtttggcttatttcctaataagccaaaacggcttattgggaaataaaaatgaatttatagatgaaacttttataaatgtgttcatggtgacttaaaagccaatgttataaaagaaactatattgaaaatatctaaaaatcaatctcaaaattaagtttaaaaatttaaaatttagctttttctttgactgatttagccatccgatggcagccacgggcggcgtacattcagacttcaacaccagaggtgtacggtacggaggaaaagccacctcgccagcaacatgcccatcgcatcgcgtgaaacacggtgcatattgttcggtagcccctgcgagattttgtctgcaactgcaaagctccaaaagcgcactgggctgggcgagtgagtgtgccaaatgccagtgtgtgcttcgtccggtggctaatttagctgacctctgagactggccccagttatgcaactagccccgcaacttttttttttctttttcggtacaccgatgacaatcatgccaaggtgcgtcccgttccgtcccctttagctgaccttgatgaacctgatgtgggtatcgccggaacagagcccggatccccaccgtacctttcatggcatcgctttttggggtaaggacgggacatttccggcgtacacacctgcgcggctggtgggagccgtcggcatcggctgccgtccgtcccctggccggctctcggcaaaccggacgacccgagaagcgcgcagcccgtagctatcggcctatcgcgcgcggcgcactaggcaggcatcctagtttcaccgggttgcgctgtggtatgggcggtgacacccgtcgagctcccgacccatgcgagctcgcggcgcgcgctaaaaaaacgaagcgacgacgccgcgtcgctttcgggtatcggcacggaagcggcacgcgcgcgaccgcatcctcgtgaagattggtggcaacgggtttgaccgatcgggagctaagccggcgctcttccgctcttggacggctgggagaagttttatgggtgggtcagctcctggaacccggaagaagtggacggaatttggaatcggggatctttccgccatgtgcgtgtccagtcgccaccgaagaaaaaatagacgcgccgttttatccattgctttttctaaacgtgactgaaaggaggcaaaaaaaaaacaaattcttgatttatttctgtgtatttattggaggaaggctacagggaaaccactaatagaagatgagtcaaatgatacagcacaagcgcatcatctttgttgtgtccgcataaacttgccctctcggcatcggtgctcggtgaacctgtcgatttcttcagcttaagggcattagtagtgtgcccacttattttcgtatggtcatgtactccacctagacaaaaaagtgaatgaagccacgcatcacaaatttcaatctcccacagtgcaccatggtctcagctgataaaatcaataacccaccggttcggggtcccactcgtcattctaaaaaaaccaatccttatcttccttcccagcctccacacgcacgcggctacgcaaagaccgtcgcctcacttccttcgtgagcccttccctaccgtcgccacttcctccaacgccgacgcctcacatccctggctggcacccctcctctcctccccgaccggcgccccgctcctccccaggccgacagctgcgtccctcacctccccaggccggagcagctctccctccccctctccctccgttgttccctccccgcctccgacctctttcttcaccgagctctctagatccggcccgtggctcgccggatctagactcgagcggtgacaatgggggaagcagtggctgctcgacagcatcttgatgtggtaggcccgcggcggcctttccccttctcccctctagcgctggcgcgacgtccctctccgccacagctcagggagacggccgacgagctcggcggtgcggagaggaggagaacgacgagttcgccagctagggtttgagcaggggcgtcgacgagactctctctggcacggcggcagctgtctccggcgacgatcgccgccgcctcacacagggtgtggggtgtgggcatcgcacagagccacgaagcgcgaagccacgacccccacagtgcaccgcgccgttctccccacgccgcgcagcaacttttctgacgaagaacgcacgcccagttttggctacacgaacctcgttaggtcacgctctaatcccagctggtagagaatctcctacgtggcgtgggttggccaaatgccacgtgtgtgcactgtgaatgccctaacgaagatagtaagtgtcgacgggtgatacccgtagaccggatatagagggtattggggtacgttggtacaaggatctacgtagtacgacatcaagcaaacaaaagacaagaattatactggttcaggccccttgataggtaatagccctaatccagttgatgtgggattatatggtagaaaacacaggttataaagagaataagggaacttgtcggatccggcgagattgtagtcgagttgattcaactagctctcgatgacttggctcctcgtaagctccggcttcgtaggctgtggaggttatgttggctctgagattcgatgtctaaaccccccggggggggcccttttatatcgcagatgaggaggtctcctcatagaactcggaggtatcagaccttatacgatatgccaacgacccagttctgcccgagtaggattcttcccatctatagattccgtgaaaggtttccttagaatatacaggaaatatccgcctgtgcgtgggtatgccatatcgatatgtaacgtatatcgaagggcaaatggtatgcctaacccgtaaccctgacagtagcccccgacttctgcttaaattgaactcgtgcaaccatttgcgacttcgggtgtcgagactgttgtcattcccggtgcgagaaccgcggagatagaccgtagtcgagcacgccatttgaagcccaacggtcacaagcgaattttaaactgaagtccaaaaaaccggcgcgcgtaacgggaccagaaatttccggcgggcatctctctctgttccctggaatttgcaccgtcggtagtgcgcctatttaaaggaattttgggagtccatcttgaagtccgccaaacctgttaaacacacaccacctccaagcactctttgccttctctgccgccgcaagaaaccctagttcatcaacctaggctcgctttccggcgaccttcgatcagcaatggacctcggcaaatcagcttccaccagtgcaacgttgaagaaactccaggaggatggcgctcttcctagccgtggaaccatggagagggaagcaggaggtactaatcctcagcccatcttgggtcgcatggttgcgatcgaagattatgttctctgcggttttctccctccaccttccgaatttcttctcctggttttgaatttctatggcatctctcgtctccatttgaaccccaattccatcgccttccttagcatctttgtgcatctttgtgaggcctacatcggggtagagcctttccttgatctttttcgcttttactacgaactgcgttggatggaatccaacagggtatctggttgcgtcgggttccgacttcgggatggcctgaagtcacgttacattcccttccagtggccttcttctcgcagcaagtggaggaatatgtggttttatcttgagatcaaggactcgaaccctgtgttcgtggttcccgaagatcaaccggacaagattccgtcttggaccgcaaagccccccttgaccccctctcttcagtcgtttatcgacatcatcgacgatctccaagaacggggtttgttgggatatgaagtcgttgcagacttcgttggtaggcggatccagccgcttcaggctcgggcccatccagcttataactattccgggctagaggacacgacctgggtttctcctcggggtatctttctcgcatttatcttgacatacttgtgttcgcattcctcttgacttatcaaaggttggttctcgattaacaggtctgagcggcgaaaccgtggagcgccgcatcggccaagtgatgatcaatggcccgaccacaacgagtgacatccctgtgcccctttgtgaaaagggggcggcggaacgtgatgaagccatcaacgtaagtatattcgatgaacatcccgcattctcctttcgaaatcactttatgacttgattgagcgtaggcccttcctttgactgatatcatcggatcgctcgcggaccatcaggtggcgtcatctctgaaagtgaaggtcgtcaaggaggcgtctgattctgccaccactagcggtggcaatgttccgacaaagccgaggaaattctcgtctgtaatcagacaacgtcgcaaggcgtcgaccccctcggtaatttattttgtcgttaaatcatgcagcaagaaggatttttccttactttgcgttgattgtcttccaggcctcggacgcgtctcccccacctccacgacgacaacgcattgtgacaatcggcgagaagtaagtagatgaattcttgaatccctgcgcttcttattcgattgttgtctaactcgtattcgtcctgtagggaggcgcgggcaaaggctgcgcgagccaagtccggaggagcttccagtgcgtcacccgtcgtggcctcgacggatgtcgtgcccgcagctgggagccgggaggcgacgcctagtggcccagtcagcaaccccgcggcaggtcgtgatctgccagctacagtcctcacctgggaggagctccaagtcgagatggggcgcctcctcgaagccggtgctcgcggcatcggccgcgagattgcggaggcgaggtcggaagcggcgacggcgaatgcgcgtgctgacagactagtgtgcgagttggctaaagcccgtgaagacctcacgaagatgagggagttggcggccggcaatgagcgacaacggaaggggctcgaggaccgaatgtcggaactcgggaacaacctatctgagatccggggctcgttgagggtcacctacactggccttcaccagctcaccggggaatgcggcgtcacgtccacaatcccagcgaatcccgatgagttttcgctgacctctctcgcggaactggcgacggcgatgggggaaatcccctccaagcatgcggccaggattgcggaggagacgtcaaacggaatctacaccggggcgtgtcatgtcctcgcgtgtgtaaggctgtcgcgtcctgaactcgatctgcgcgagatcttggaccagggggcggccagcgacacgcgtaaggaggtgatggaagaagtcggtgatctgggggagtctgttctcccccgttttgaagagtaggacttcttgtatttcctagataatgtgtaaaactcgaactttgaccgcctttgtgcatgcgattaccatcccggcttactttggtatgctgacctcgggaacttttgtcctctgtagagatactgatgacgaggatgtctagcagcgcgggcagcccgagtcactggcagtaattccggtactcgagttagaaccatacgtctcgcctgaccatgtggatcaaccccttgatatagagggaaggatggcgacgactgcctcaggttagtagtcccttcaccccttaatgcccacctgactaggttagccatgttcccgaaagagatgtatagcttgacttagtggttatcacgtttagcagatctcgagggtgcccttgctagccaagatcgtcgtatccaatactggaagacgaagtttgaagtggcggagctcgagagaaccatgctggccgtgaagaaagagcaggttgtggaaacgctccgaggccgtgaggtatggtttaactcgtacttgaagagttgttgcacatccatggccagggtatgcagggagcttcgagtagtccgcggagatcccgaggagtcggcggccgggtacatctcgtggcttaatggggcctgtgcccagctcgatggaatcagcaagcgtatcgacgaggccttgaagcaggagtgtcgtcgatcgagccgatatgccggggggcacgtgttggcttgcctacgagatcatcgcccgcacctagaccttgaatatcttcgtgagggttttgctcgttctcggaggactccggcagagatagaccatcttgcaaggtcaatgtcgccgttggccgagaagatcttccagtctatggactggtgttggccctcttggtagtactcgtaccctgtgacaaatatcttaggaaaagatgtaatgtagcgaaagatttgtgaaaaaactgtaaggagtatttgtgaataaagaaatctatctttgacaaatgtctcttactcttgatgtcatgtgtaagagtgcgttctcagttaacgactttagtcagccgtttgagtggtacactctccctatcccccaaccttgtcgtcagaggaattttctcggaggataaggctcttggacctttgacctggcttggttgaataagctctgatcctagcccccagccgtgaagttggaaagttgatttccgatttcacagcttggttaatacgcacggcgagaactcttacacgaccagatcttatatggtctttcgtctctacaggatctgacaaggccttatcggttctgggcatttccagccgaagatcccttaggttcctcggaggccttgtcgagacggcgtaaagggacataaggacaggtttcaacgctaggtgtcatcagagtgagggatcatcgggcgaaacacgttgattgtgatatgggcctagaaatagcctttattgatactgtaagggtgcttacaggtatggatgatattgactcatacatagaatttacgtaattggtcaatgttccaagaatttgctaattcgcgaccatcgccgtctgcgattttgaatgcgcctggccgcaagacttgtgtgatcgtgtaaggtccttcccatttaggtgagagtttgtttcgccctgcttggctttgaactcgtcggaggacatagtcgccgatcgaaagtatgcgtgcacggatgcgcttctcgtgataacggcggagggtctgttgatagctggctgctcggacggcaactcgttcccgatgctcctcgagaagatttacatcgatatcttgctgcccctcctggttctcgtcggagtacttctgtactcgtgtactctgatgttgtagctcgcctgggagcatggccttagagccgtgcacgaggaagaagggtgtttccttattagacgttgtcggtgtggtgcgtacagcccatagtactgatgggagttcttcaacccaccttttgtcgtgtgacatgagcctgtcgtagacgcgagttttcatcccttgtagtactatgccgtttgccctctcgacttgtccgttgctttgagggtgagagaccgaggcgaagcatattttgacccccagcccgatgcagtagtcctggaaatcggcgctgatgaactgggagccgttatcagttatgatgcggtatggtagtccgtatccgcaaaatatccctttgatgaatttgatggcgttgtcggccttgatttcccccgtgggtactgcttcgatccatttggtgaatttatcgatcgccacgaataggaatctgtagtcgccctgtcctcgtgggaatggcccaagtatatctagcccccagcacgagaatggccaagtcagagggatagtttggagcgcttgcgtgggtagctttgtgtgtttactgtggaattgacaggattcacatcgctggaccatgtcgcatgcatctttaagggcggttggccagaaaaagccttgtcgaaaagctttgccgaccaatgtccgaccggcggcgtgtgacccacatatgccttcatgtatgtcgaggaggaggtgtctgccgtcgtcggtcgagacgcatttgagaagtaccccgtttggcgctttcttgtatagatcgttgccgaccatacagtagatctttgctttacgggttattttctcggcctctgtgtcgtcctcgggcaactcctcgctgctgatgaatttgattagtgggatgcgccagtcgtctatggtttcgatgtcggcaacggcgcgttctgcctcggtgatgtccgagctaatgtcgggggtgttcgggctgacttcgctgctaacctctttcaccgatggcttcgtcacgatatcgagaaaagtgccgggctcgagcgattctcgtctggacgcacgtcgtgctaggtcgtctggctcgacgttgtccttgcggtaggcgtgtcggacctcgatcccatcaaactttttctctagcttcctgacttctgcgagatacttggataacttggggttagagcatttataatctttgtgtacctggttcgcgactagttcggagtcccctttgacgattagtcgcttggccccaagtgtagctgcagctcgtatcccggcaagtagtccttcgtattctgcagtgttattggtcgccctgaagttgaggtggattgcatgcttgaattgatctccggagggagatgtcaagataaatcctgcccctgctccttggctgttgagtgcgccatcgaacgccattgtccctgttgcattgtcgccttggttgtctgatttgttatctggcatagtccaatcggcaacgaagtcggtgagtacctgggacttgatggttgtttgtggcacaaagtggacatcaaactggcttagctcgactacccatttcgcaatgcgatcgacaacgtctttgtttctcacaacttcaccaaaagggaaagaggagacaactgtgagtctgtgggcttgaaaatagtggcgtagcttccttgatgtcatgatgactgcgtaaagcagcttttggatctgtgggtatcttgtctttgcgtcgtggagagcttcgctgatgtaataaactggtcgctgtactttctctctctcgacaacaatgacagtgctaacggagtgtggcgtggcagaaatatagaggaataattcttcattaggttggggagcaacaagtacaagggggtttgataggtagcgcttgagtgcaatgaatgcctcttcggctttctgtgtccatacaaatttgtcttgtttcttcaacagagcgaagaaaggttgtcctcgttctcccatcctagcgatgaatctgcttagtgctgccatgcatctggttagcttttgtacctccttgagtcttgtaggcgacttcatattctcgattgccttgatcttctcggggtttgcttctattcctctgccagagacaaggaatccgagcagcttgcccgatggtactccgaacgtgcacttctcaggattgagcatgaggcgatatcgtcggaggttgtcgaacgtttcccgcagatcgtcaatcaatgagtcgcctgtcttggttttgacaacgatgtcgtcgacataagcctcgacattgttgccaagctggttgctaagtgcaccctggaccgtgcgctggaaagtatccccagctgttatcagtccgaacggcatcttaacatagcaaaataccccgaacggcatgatgaatgctgtcttctcttcgtcctcttttgccatgctgatttggtgatagctagagtaagcgtcgaggaagctcaataactcgcaaccggctgttgaatccaccaattggtctattcgaggaagtggaaagtgatccttggggcacgccttgttgaggtcggtgaagtcgacacacattctccattttccgttggccttccgcaccatgactggattggctagccactctggatgaagtacttctctgatgaagccagctttgagaagtttgtcgagctcttctcgtatggcttgtttccggtctggtgcaaatctccgcagtctttactttactggcttggcatcgggtcgcaccatgagtttgtgctcaatcatctccctggggacccccggcatgtcggacggctgccaagcgaacacgtcggcattgtcgcggaggaaggtgatgagcgcaagttcctatttctcgtttagtgtcgccccgatcttgacggtcttgtcggggttggcactggagagtggaacaatcttgatggcgccgtctggtttcggcgtcttgtttgtcttggtcactttcttgggtggctcagtcgtggcgggtgggctgggcgtttgctcgactatgtcgaggcttcgcttgtcgcattgcaccgctagctttgcgttcccttgaatagtgattgttcccttcggtcccggcatcttaagcacttgatatgcgtagtgagatgcggccatgaactttgcaagtgcagttctcccgatgatggcgttgtaagctatatcgaattcagcaacatcaaaggtgatatgttctgtgtggaagttgttggcttggccgaaagtcacgggcaacgtaatcttgcccaaaggtctggacgatgattggggagtaattccatggaagagttgatcagttggtatcaactcgttttgcggaattcccatcgcgtccaaagtgttggcgaaaagaagattgattgagctaccaccgtcaatgagaactcgcgctaccttgatgttccgaatagtgggttcgaccacgatcagatatcgtcctgggataacgacggtcttggggtggtcttctttccgagaactctatcttctgctcagaccacttcatcttgggtgtagccccctgccatgtcgagcagacttcatgttccactttcttgtattctcgcttggaggagtacgttgtggaaccgccgaagatgtgtgagacgtggaggtcgaagtctggatacgctgagtccggttcgtgaggagctgtctcttcgttcgtctcgacaacgtgtactcacttgcctttttcaaatgccatgtgcttctcgagcgactttttgaaaacaaggcaatcttccagagaatgtctgtccgtcttgtgtatagggcaccatgatttctttgtgtcgctgctttgtgggtctatgcgtttgggagggttcgcgtattctgctgcgaggacttccgcttgagctttccttttcccgtttttgcgatttttcttcttgcttgactcagatgtgtccgtggctggtttcttctctcccccggtcttcggcctatcgttcttgcgtcttagcgcatcatcagcgtgggcgcatcgctcaacgatctcgaataatctccgagtggttgtgatgcgtcttgtcgccaactcctgggtagtgtagcgatctctgacaccggatttgaaggcgcgaattacagaagcgtcggtgatttcaggaattgtgtttctgcactcgttgaaatgtcgaacatattccctcaatgattcacccgaattctgtgtcaacgcgtgtaggtcgtcttcgatcgcgtggcgcttgtatgttccttggaaattgacgatgaattgttgccacaggtctgcccacgaagagattgagtagggaggaagatgcatcagccatgaacatgcagaacccttcaacgcggttggtaaatagttcgctaacgcgttgtcgtctgctccggcagcatagagtactgtggagtagacttgaaggaactcctctgggtcggtgctcccatcatacttttctattgctccgggtcggaatctttcaggccatcggacatcacgtagggaacgaccgaaagccctacacccagcgttgggggtggtgggttgccggtggtcgtgtgtccttgtggatgtctgtctgacgatgaggaggacgcggatgatgacgatgacgatgggtcgcttggttccggcatacgattacgaggatgatggcctggatctcaggaatcctgtcgtcgtcttccgctgttgtctcggcgccgatctccatcatcatcgtcgatacggcggcggccatgaccagtattgtctagcacccgtcgttcgcgattgttgtgattgtggtggttgttgtggtcccggtcctcgtttgagcggtctcctcgatttccgttatcatggcgccatgaagagacatgacgccgagagcgattcacgttgtctcgtgtgcgtcgtgcttcccagcggccgttgatttgatctcgaagatcgccagtgccgcgaggagaaggggtagcttgttgaggtgattccctccgttccggatcttcaccattggcctcgctagttggtggctgctcctggtgtgctgcggtagcggcttcttcaaacgcgttgctgaggttagtcaccgattcccgtagtcgttctgtccaacgctcgaggtcaacgttcagaacaggatcgtaaggagtttccctcagtatcgcttgaacggccctgatgtgctgggctggagtagtcgattgattccccgcttctgtgttggcgtgcgctgacgtgccgatgtcatcgatagccaatacctcccgcggcgcactcgttgtcgatgacccatagtcctcgaggagatgtaagaccgatggttcgtgaggatcgatatcgattaccccaacgaatcgatctgaagttggagtcgctccttgttccttgccgttatccctgatggggacgtatgacttaggacactgagctttcatggcactgagaaagactttgcagctcgagaggtcgtgattctttgtcttgtgaataggacaatagacatcccgagttggagaagtacgctgaattccacgttctttgcaggcgcgaatttcagcacggacgttgaggaaaacccatcaatcttgcagagtgtgtttcttggttttgtggataggacaccaagaccttgtggcttcggaagtcatctttgttggctcatggttcatgtcggaaggacaaggtttggccatatcagaatccttcttgagcttggatgccatcgatattccgttctccgtctcgatgggaggatttttcgacatggaatcgccttggtttgtagccactgcgttctcgtctccggtcattggaggaccggttgagatcggcgtcgtggtgtaaaccgggaagacgatttcgccgacttgagtccataccagcattgttgaagcagggagtacttggctgaggctggtgctaacgttgttgtcgacgaagctagatgacatagtagtagaaccttgagtaccaaagccccctacctggcgcgccactgtcgacggatgatacccgtagaccggatatagagggtattggggtacgttggtacaaggatctacgtagtacgacatcaagcaaacaaaagacaagaattatactggttcaggccccttgataggtaatagccctaatccagttgatgtgggattatatggtagaaaacacaggttacaaagagaataagggaacttgtcggatccggcgagattgtagtcgagttgattcgactagctctcgatgacttggctcctcataagctccggcttcgtaggctgtggaggttgtgttggctctgagattcgatgtctaaaccccccggggggcccttttatatcgcagatgaggaggtctcctcatagaactcggaggtatcagaccctatacgatacgccaacgacccagttctgcccgagtaggattcttcccatctatagattccatgaaaggtttccttagaatatacatgaaatatccgcctgcgcgtgggtatgccatatcgatatgtaatgtatatcgaagggcaaaggatatgcctaagccgtaaccctgacagtaagtgacataacatggcttcaaatttcaagtctcggagtatttgacagctctgcttctaaattctgcagataaaaaaaccactctgtattgaagcatacaaccagtggtattattattaaaatttatataaaaaagtagaaatgttgactattattttagaaagaaaaataacacgctacatctttttgttgatttgagaagttcagttcgagaggtttttatatcccgataaatatccattaccttattcgctacgatttgtattcgctctgtttttatattctataatatttgattccgtttttatatccggggcttccgattcgattatgatttcgagaaaaatatggaaacgaaaacgatagtgttggtttccgtctgaaacgacagtgaatcaagaataaaaatatagggtgagctcatagtatatgtcaatagaacaaaaataaaatacatatcgttgtgcaagttaaatttagtgcatacatgatcaaataggaaaggaaaaagtctatttactctcttgactatggccttagacgaaataacccctaacatttaatttgatttacttaacccctggttctcaaatcctgatactattcacgtttccaacataatgcaaaccactttgttgatgtggcacatgggctagtgaaaaatgacgtcatcttcttaacctagtgaaacatgatctccaaaatatcctctgatctctagcaactacagcttgtccctatgcaggtatgacatccagatttgagaacccagaggttaataagtgaaccaattaaacgttagggggttatttgttccaaggcccatacttagggggaataaaatgtatactttccgataggaaaggaaacacataaaaaacaacggagtgccttgacaaggcaatatggatggaaaaagaaaacagtaacagaggcactgctctttatgcaaactataacaacgactaattgtaactgatgagcgaagccacggctgaattgctcgaaaagtaattataagtaatatagcttacttgttcatcgcacatttaccaataaataaaaaacctacagcacataaggctcaatctacctgagtgaaaggttaatctcacaacattaggagaatgcgccacgtcatacaaacattattagccgtccgatactaacaatgaaactttgcaaatggtaaaaacaaagtgcttgcatcttcgtgagacctccaaactttcaggagaagcttggcaattcaccgtgagaaccccgatctgagaagcccaagaaagaaacgttcaagaggtgagggaaagaagaaaaataaagaatttttaaaaaataattaaaaatctactttaaattatctggactcaaataagtataatacattgaaaaaaatattcaacgattatgcaactgtttgttcttcatgattggtgtcttttatttctataattttatttgaactgcactcattccgagcgttaggctgtaataattggttgtaactcgttgaataaagtccaagatattatattacattatctaaaacaaattctaatgaacactctataatgttgataattttcgatggaatacaatgagaaaagggcgagtatgagattagcatttatgctagctcttaagtctagatcaataagagggtaatgcaatagagatgccaggaaaatgatggctcaagctgcagtgaacaagatggttatccatactccaattttaaagtcaagtatatatttttaacaagttattatagaatggttagagtcgagtgaatacgccacttcatgaactagctttttctcatggatgataaatcccctcgtcggtagacaaaagagtagaaactagaaaggaatagagtgactcattgtgtcattcaccacaggtccacagtgcataagaccagcaacaaagtatatcagcagacaacgacctcctgcgctgcatgttggctcgctcggcgccattaggggtgggcaatttccccgttggggcctgggatccggcggggacccgcccctacggggacgggggcgggggagaattctcttccgcgggtgagtggggacggggccccgcaaacttccgaggatgaggacggggatcggaattaacccgcgggtgactcggaggggccgccctggatgtgagttactacttctctaaaagtagctcattgcaataatgtagatctaacaaacccattcaaaattgacatatgaaagctcaacaccctagttcccctcaaccataatccctttctttcttcaaccaacccacacaattgggggctattgaaattttatcataatattatttagagtattgcaatatttttacaaagtattagctccatccgggtgatgcggggccctggtcacccaccgggtcccctgtgggggcgggaacgggtgatgtttttcacctgactttctttgcggggacggggccaggatacccgcatgagggcgggggcgggggcattccgacccaacccagccccgccccgttgccacccctaggcgccacggtggcctgccccctggcggcccatgccatcgcggtgttacatggcaggctgttgctgcaccgatgcaactgttccctcccagctcccgcagtcgcccatccccgtcgacggccgagcaagccgttcaaccctcccacccgtaaatcatatgggatcgctaggccggacctaatactataaacaagatggtgtgggcttactatattaaattgatgaattggaccatgtaatgtgtaccgcttcgcctttcttcccccaatcgcagtcactcgacacactcctgttcatcttcctcaagcagccaatgcatgtttatctatcctcggctgctgctatgagacatgcttaagtctaatgaagcctactttactcctatcataactggatggtatggttaggccgatcaatttggctactactaacaatctcatgaaatgtcgacgtataacgaggcttcaggtaacatcgcccgatgaactatggttagactcggctaaaaaaagataatgcaaataatgacatcaattttgcttaataataaagcatcatatttttaactggttgtgttcactttttttctcactatgcaatatatgatgtttacctcttatctgtatgcaagtatattggtatcttccctaattccatcttatttatttttttcctttttcttatgtgttaacttggattaatatttttgttataattaaatagataataagttgtttttcgatttttctcatatacaacaagtatggaacattgtatgattttcaaattatattatataagtgtatggaatataatgtgtaagattaaaaaacttagtataagatttgacgttttcttgaaaacgtggcaccataagtataggtagtctcataaatattggctatccatataagaggactaccataaaaataatatagtcaaaccatttctcaactaaacttgtcaacagaacttcgagagaaggtaagaaaatgaggaggttagttaccaatcccacacaagggaaaatattgctcacacgcattgtatgacatatactcccattaatcaataatttactaatattattaaatttcacaacgtttaatgaaaatttgttcttttgtgacaatgtggtgcgagactaaaacttgaacaccatattcttctgttgtttcttattctttattgttgataataatatagctggaaccagccactagcacttcacctgaatactagcagctagttcatgtctatgtgctctatattatttatggttttaaatgagttagtactaataattgtacttaatgatgatattgtatgcatagaagtagtattttagaacttgagatatattttttctaaacataatttagaatactccgaggaattataatgtagagcatattatatttaatgatacatatattcattttttatggataatttaaatattgacatttgttataaatccaatgatcgaagtatactataaatattgtataagtgactttcactatttactaattacatgttgttagtttttgtctatactagtttctttctataacagactttgacgatgggttgtgtttttagaattttttaaatgcgtttctttaaagggatggagctatattttaaagcgagtttgattgtttagaagtaaagaatacgaatgtgcgttttttttccattatggttgattttttagagaaattttccattattttagtttttcttaaaaaatggtacttactatgaaaattccttattatatttttagtatattgtctatataatattcttatgaaaaaagaaaataaaaaatcgaactatggaatcaaccgtgcatattatataatatcccattatagttacatcatcccataaaattattcaattaaggaaaagtaattagaagtattctctgcagatgcaataaaacttccatcatagcgaaattaatatcactaatactaaaattatgattttttttgaaattataaatataaattcataaatattaaaaattttattctcattaggatgttatattgcgaaaaaacattttaagaatgttaggagtgattacactgcacttatacctcataattggtattattaataagaccgataatacatatgtacccattattagcataagacaagagtaaaccatgtttgttctaataaaaactcttaatggtttgctaatattgaggatattagtataaaaaatttcagtttatggatgttttgtaaattggtttttatttatttaattaattataatatgaaatctaaactttgactgcttttaatctaaacattatcttgtgtgagaactcattataaaactaaggcagataaaacgacgtttgaattggtttatatatttttggaatttaggatgtaactaaaatggggtgttgttatctccggcccagtcttccggaagtgctcataggggtagggtgtgcgtgtgtgcgttcataagggtgagtgtgcgcacgttgtgagcgcctgtgtttgtactgtgtttctcaaaaaaaaatgtcgaagatagattttattaacataaaatttgctccacttagaattccagcactgtcaaactattgttttactcgtgttatagcccgagtataatatatactatgtcacattgcatggacatatataactgaaatgaaacgttattatctccttaaatgtccacaataaattttattaacctaaaacttgcttcacttagaattccaacactgctaaattattgttttactcttgtcatagcctaaggctaacatgtactcagccaaaatacatcgacatatataactgaaatgaaacgtttttatctcctcaaatttctaagatagattttattaacctgaagcttgctccacttagaattccagcactatgaaattattattttactcttgttatagcttgaggctaacatgtattctgtcaaattacatggacgcggactccacgagaaatatcatatcttgccgtggtcaacatcacacaaagaataagcttcaaatgtgtatgtccggtatctctattctcgcccctgttcgtttctgtgaagtaaatctggaggttaaattcccgtcaaaaaaatctggaggttaaaacacgacaagaggatatgacaaatgttaataatgcatcaaataatccaaatggcatgtagcctaaccccaagaatgtttttagaacacgatgctttacatatgtctagaacacgaatcattaaaataacgtctatccatgtcaaccatgaaacaaaacgaggcaacaatcacatgataggatccttatagccacacgccaccactaatttgcaagatcgtgatggaaaccggtgtaaatatgcagggagtggagagttcctaacggtttgacgaagtgaatcgaactatacatggtcaagttgaggaagctcaccagacagagaggtaggtggtggtggaaccatggaagaatttagtgttgggccttgttgggacgcaagtccctagatccatccgctagatcccaagcaccttacttcactagctctgtgatagtttggtatacatgtcattttggagaaataagataactagatagaagtactgctttgttcgcttggatgccttttaatctagtcttatttgctatgatatggcccaattgaaaatattttagctattgttatgggctgagacctcatgattggggaatggtgtgaaattaacgagtaagacaatgtggttttcattgttaattacttatcaacaaattcatatgaatgatctgatttttgtttgatggtcagtggtgcttgaaattaataaagatgaagattaagttgacacacgtaaaacaagaaagctattagcacatgatttattaatttttaattattacaaatttgacaaatagatatatttgatattttaaagcaacttctatataaaaagttttcgtacgaaatgcactgtttagtcgtttgaaaagcatgctaatgaaaaccggggtaaaatctaaatattaattagaaaagtgagtttatttcaaacatagcgatatatacttggttcacttatctatacatttagttcccacctttgacactttattttcattctagttttgtcactgggtggaacttggccttggcggctgacagcttcacccaaaacccactcgcctgactaacgggatgcctgccaaagccaataaaatgattaagaagaatgaataaaccaaaccagccaatggagaggagggttcatgcgaggcactcgctggaaggcctgtttggaaaaacgtgagacttaaggcttgtttggaaggcctgtaattggcccaatgctagtgtaaacacaagaccgtaaaatcttttccgtgtaggctaaaaagcccgtttggacgggctgtaaatcataaaacattaggactaagttcaccagtagtccctcaactttacccgagtctgtctgaggtcccctaaccacgataccagaaatatgtacccctaaaccatgtaaaaccattcaaaaaaaaaaggtcccgaggtagtatagaagtctggtttcgctgacgtggcatcttactcagcaaaaaatataaaataaatatatgggggcctatatgtatgtgagagaaattggtatgggacccacatctctcctttctttttctttttctcttctcttctcttgttgattctctcgagcagtcgagcgggcgcagcgacggagggggggagaggcagccacggtggagcgggggcagcggcggatggagagggggagagatgcggccgacacgatggtggctactgttggtgactagaacggagggggctccaacgtctatgaccgctgcttcaaggaggaggcgcg

SEQ ID NO: 37941 - DNA, 14305 bp, Oryza sativa
  unsure (1)..(14305): unsure at all n locations
tttttttttacgattttacatagtttagaagtatacatttctggtattgcagttaggggaccttatacagacttgacgtaaagttgagggatggccggtgaacttattccaaaactttacagccgttttagcatgtaaattaaccgcagatggggcacaaatttttatccgtccgatatcgaacctcgcagcctcgactgccgtcgagcccgctactccgtgacgctccgtgctctgccccgccgccaccgcacaccactctccgcttcgtttcgttgttgccgctgagtcgccacgtctgcgccgccccatcgccggcgccgccgcgatccgttccgcaaccatctctactactctgcgccacttatgcaaaccggcctcgatcctcaccaccatctgctgcaccagcgtcggttcacgccgggtccgttgtctacccaccttcgctatccataagggaaggaagagctgatacaagcggagagggaatctagggcgagaacgatctgcgccgtcgcctcatactcaccggtccatactctgcctccgaccctttatctctcgtcccagcttctcctttctctgtacattcagcccacatcattggctcattgcttcaacaccctgcgagagattcggcttgcctaggctccgtatcgatatggctttgtgattcagatttgggtctattcatctttttccccttcgccatgttcgttctgtttcagagttcgtttttgttgcaatgactagccagatagatgtcttacccttaccaaatacccaaacggcctgaaaatttttgactgtatgaatcctcggtgttcccaagaataaaagtgaaaatattttacaggtgaaaaaaaaactgtattcccaagaaaatcttccttcaagaactgttggtaaaaggaaatgtgcgaatgaaaattcatttgcagctggaaaatttctgttgtctcagcaatagtttcaagaaaaatctaggtcgctgctcggtgaacccgtcgatttgttcagcttaaggaaagaaaacgataagtgacagaacatggcttcaaatttcaagtcttgcaatatctgacagttctacttctaacttgtgcagataaaaaaagtactcctgtatcgaagcagccaacagtcatccgagcagcagatgccgttcttattttcttgggcttaggtgaggcgcagttgttctgcaaagaggaattaatggtttaattaacaccagctcaaaattccaagtggatcggcctgacttggtttaagctgaatttgagcccatgaggtaatcaaagtttgggccaaacatgaactttttggcccaaaaacttgtcgccgtttgggctattaccttttttagagtatgtgggctaatactccttaccatattccgttgcagtcgattccattccatacatcaacacaagtcgaaaacccttcaggagcatcggttggatacgcgccgcacgcagccctacagcctgctgtcgcctcccggagcactcctcctggtccctggtaaattaactaggtttaattcctccatgcctctgatctcgtatttcttattaatcgatttatcattatcattagctctaactaattcggatttcgttgcatcctcgtgatatattcatgctgtttttcgttttgcgttcgtttgagcaagatagattatagatggataaacgtctcctactctctcatgatcaggctatctggaggcaggattaggagcacaggccatggatgagaaagacggcaacaatggccgatgcaatttcagtacggaagatcctggggaggacaaagccttcgctgcctcgcttgtagatcaagatcaggatccggatcctactgatgctgccctactggataatgagtgttccagagttgtagatcaagatcctcctcctgatgctgctgccctcctgtatgatgagtgttctgcaggcgntatggtgctcnatgtagccaagaagaacaaattnccgagggcaaaaggtccatncttggcttggccgnncccacaaaaataagaacacctagcttttgaatgctactactactgtttcaggatgtgtcctgtatacaaaatagtggtctgattccatttagtgacgcttaattcttgtacatgaacttggtacttgcagtgcatgcgggtgtcggacttgctatgaaaatagatttgccgttggaacttcaaagttataatctagtataccatcatgcaagctccattagcttatgaatgatttcaaataagaccttgaccacataagatgttctcttgtcacttctgcttgaacacttagcatgtcatcttctttgtgacgactcgtactgttatgcgactctccttaccttctgtactacatatatattagagagcattctcacatttatattttttttccatgttaggtcaaaggagcaaacgtggaaaactgggcatgtgtaaatttttctttaatgggtactacagaaacacagaaatttgcatctgagctcaaaaaagcgtgtgtggccattgggatggtaaatccgtccactctttcctgggcaccattactttggcaacatgtgacacatctgacattgactttacataataggatttgaagtctgttcatgcagtgttcgtagacttgaactctcccaataaactagaaagtactttgcatgatgtgcaagaactgtttggcggacaaggagtggaagtaaaccagataaaccttctaattgtaattcttccagaattcagacgttctgatggtatggaagttatgatttgcatcaaccgcacctttatattcttttttttttgttgacagttgcatgcgatgttttgcagcgaaagtcaaagatatctgtaagaaccttggattcttatatcaatgttgtttgcctgagcatgctaggacacccagcaagctatacctgaacaatgttgctcacaatattcgttccaaggtttctctctcattctgtttgatgtgttattgttcttttttccttttgcacaactctcatgctagagtttcttaatcatgttgctgagggcaaaacacttttttgttcttgtgaggagaagagggtaaatggcgactctgagaaagtctatggttctgatgagatgagagaagatagtgagtcagatctaagtgatttggaagatatgggagatgctgactcagacatcatttacttggaagcattccctacatcagatgaagagatggatgatgatgatgattatggtgatgatgatgaatatgtaccagtatctcctgatgaagagatggatgatgatggttccgtgcagcagatgagagagaatgatgaattatgtaaacagctccagcggctggaagagaatggacatgaacaggccgccaatagcgcagaaggctgcctcaaaacctacaaggaaatagagactcatacagcgttagcaggaagtacttattctgagttaagtgaaccgccttcatttgaagccttcctgtgccctggtaaaactcagtttctggtctagtccaaagttaatcaatctaccctaggccagcagcttgttcttaactcttttgtatctcccagtctagtccattcacctttcttaataatttcgtgtggcattcgttgtgccctttttattttgcgttgattgtcctttcttgtttatgctttcttgcttcttcctctgtctccaggggaacgcgagcacattctcaagacaggatgggaaacacaacatccatacaagaagcctagcggcgtgtcttgggatgagtactctaaggtgtttgacaccaatggctactacaaactcagcaacatgcctgtggaggataaggacttggttgctgcagaatgtaacactcctgaagtgaggcgatgggaaaatcacatcagtcatgactatgatgagctgcaggtattgctagttatttagtacttccttcactcataaggttgttttagaaattaacactgtcaaaagatttctgttcttgtagatctattagacctaatggacctttcgataacaatttttactatagagatatgtgcataccattttcatgctatcaatctgaatattgaaaaggacattgacaactgaagtttggaaaatcttttttgatcaccacctcagcctagcaactgttgtaaatttgctactttacttgattgatgccatgatattgtggttgaatcagtgtgttcttctgtttcggaattgtatatatttggtttgtcgattcaccttctttcttcaatgttcaaataatgccgcgaggacaaatattttgctgatgatgttctaagtatcatcaaacaaaatgtcatgcatactcaaatcaaattatgcatcatatagtcctcggatgagatgtgcactataccagcttgtgtgttacaactcttgtatgatagttaatgttgcgtgcttgatgcgagtttgcaagtcttccaacacaaaacaatatgagaaccacataatcggaaagttgtgttcaaaaccagggatctgatagtctgaatataatatttaccttgaacagttgacaaacatgattggggcaacctaagaacatacttggctgatggattcttggtatagttttaacgtttggggtttttggtattttcactgctatgcaactctctttatctctcgtcatgattcataatatctttatagaatcattctcaaacaggcatttgttcccttttaggtcgaacgtggaattgtgagacgttgggcatgtgtaaatttttcacctaagcgtaaacatgcagcgcgggttgtcagtgacattataggaaagtgtatagacatgggaatggtaaagccctgcatactttccttgaacaaggcattctactaatcatgtaccacacatctgacttaatatctttgtatgataggaatttggtacattaccaaaaatggatgtcgatgtaccccttacttcccttcatatacgacgtactttgctggatgtgcccaaaaagatagacattctaattgtgattatggcagatgatagaagttatgatggtatggaagttagttgtgtcaggttcactgttgattttcttttttgacagttgcatatgatatattgcaggggaaattgaagagatgtgtgagagccttagaattgtttatgttttctgtttaccctgcctaagcaaacggaatctgaagagagttgcacgccaaatacaattgaaggtcatttctctttggtctcattttgtttgttatagtgttatcatgtttttggtttattaatcaggttgtaaagagttatgtacgtcgtcagcgactgcacttaccccttgtgtcagaagtcccaacgattttttggtgctcacacgatacactatgatcttggagaggattcagaggcaggagtggattcagagggcattgcatctgtatgtctcttctgtaactaccatctcctggatttgcgttttgttgttacacaatccaattggcatcatattttttgttggagtcatgtaggtggcggcttcattggactggccaaaattcagaaagtatcatacattaatttcacatcaacctcataatggcatcataaatctccattctagacgtggtggcatgatgacgtaattctgtgttctacataatctgtagctcaccgtcactttgatccatttggtgtactaacatttttcattttttttccagcaagttctttcggtccttctacaaaatgataaaagaaagacccaagaggataatcttctacaggtagtaatacttgtattccttgattagtgtgatactattagatatatgctaacagtgcaacatcttgcacagaggtggattaatggaaggtgagatggagcgcatttgcctgcaagaaatagatgctattaaacaggtaggaatacaatatgatttgccttcctgtatcttggtttgacttgctcattttgatggttttgtgcttcttcccttgaaaggcttgtgcctattcctacaaagaagatcaaccatcactgacatatgtggtcgtggtgcctactgcatcaattggttagtgtgtttgctgattctgcttgtagtatttcctttttaccgagtgaggtgaatacacatacatgctacttggctttggtgactgggtattgtttcataggaactgaggctgacaccgctaagtataagttcttttgccgccatactactcataaggtacattttagtttggtgaatctgcaaatatactcataaggagttgtctatccttgaaaaaaatatattgagctagtattggttgactgtagtcaacctcccgcgtggtccgctaccacgttgtccatgacgacaacaactttctagctggtgaacttcagtctctaaccttgaagcttttcaccttgtaagtttcacagctctacttttggattgctttgctgtgatcaactatcagtaggcacttctgaccatatttgcaaatgcatgttcatacccagccgtcatcgtcgggaatacccaaagatagatgcaggtgagtccttttatactacctatcaatcaattattcttctttcttgtgtctgtgttttctttaaaaaaaaaggtgtgggggttccgtgttgtcgaaagggtagggggtattctggattttggaaaggaaagaaatgctgctccaattggttgatgagcacaaggggcagggcatgtccttttttgtgatttattttttacgagtaaccgaacaatgagggcatgtccttttttgtgatttgtgtgggagcatacattttgcgctagtaaacactactatccaaagtataatattttttttgttgtttgaccaagtttatagaagaaacgataatatttgtgatatcaaatgagcatcatttgtagtttacttatttgacatggtcgatgtattctttctacaaatttgatcaaacttaggatacccctccttttccaattgatcatcgtacaattgttttaggttattctgaaatgatcatcatactagtattcattttttaagtctattcattatttgtgcatggaagtaatggacatgtgatgtcttgtttgttattgggtagaacatagtgaggatggctcatatgagtttgttacctcagtaaacgtagtttttcttggtcttgttgcactcatgtaatataatgataattgggaatggagggagtacttcctagaaatgcttatattgtatgttctgcttatgccttgcacatcggatcacttatgttttattactcactgcttattccattctatctagttgtaccggcctactacgcagagcgtgctgcattcaaagcttatcgcgcagagtgtgctgcatccaaagcttcttaagaagagcaaagcgagatgagaatgttgctactctagcaaaaattaatcagatgtttatctaacttattaagatgtctggtgtattttgaactcaaaaacgagtgtgcatatggtaacctgttaccgctgttgatcagacgtgttatggcgcttgtttttgttaatagttcaatgctgcgggttttgaaattgcatgtagtattggtcttttttaagacagaacaatccttgtacattttcaaatttaatatttatatatatcatgatttgaatggaagtactatctccattccaaaatatagcaatattttttctatgtatttggatataacattgtcctaatagcttgaagtagttatatttttttgtgctgaacatggacgcgttgcacgtgctccggttgtccggcacaaatccatcgtctccgcctgtggtgttcgataggcagcgctttcagtttggttaatatggctgcggtaggttggatttgcaaggaaggagcgattgggtaagatgaaacctggaaacgatttgtgccgatttgagaatttggggtcttttcgccatttgcgcaaccaatctacactaaaaaaaagaatataaatccaccagaaagtgatgaattgaagccaaaatgataaaagtgatgaatagaggacaaaattaaagatatagaatgaattctaccgggaaaccactaccagaagaccgaacgatacataacacacctaatttcactgttctacgtctatttttcgaagtgtttgcaagtatgagcggcaacgggaatcatcggaacctacaaatgtacaggttatgtacattaaccaaacatgcacacagagattagtgcacagctcgtagagaaaggggatcagatgtaatctgacagaactgatgctgagacccgcttcaaggatgaggacactttggagatgtctgaatcggtgtggccggctgacatgaagaggcgtattccgacgggaagtttgcacctatccaaaggtgaccgctttgacgccacgataaaaactgaatcttccttcaatacctgttggaaataggatgctgtaaatatatgcaagtgaaagttcatttgcagctggaaaggttctgttgtgtcgacatggacttaccctctcagcaatagtttcaagaagatctatatcggtgtttgatgaacccgtcgatttcttcagtttgaggaaaacgataggtgacagaacatggctggaaatttcaagtcctggagtacctgacagttctgcagataaaaaacatcgaaggcatcaaggtgatcagcaggcaccagtaacgacatattatgcctgaacaaattcaactattgaatcccataatgtgtttcacaatttcaatgcagctgttttgaaactaccactaatgggaaaaatacatgataaaagtgatgccacaacattacatgctaggtattaaagcattaaaaactttacatctacattaatcacattaaaaagtaagtaaatgttggtcaaataagtatataaataacaagataatcttcttaacctttatgcaggaaagaaatgttgctcctcaggtctgcaagaactgacgggttcccctccaggtagctgacagcagaaaccgcagcgctggcaagataaggtggcagagaagccgagaaaacatagccagaactgcttagacgctgcaaaagcacaataacttaataggtcaagatatttaacaacattctattgcaattgattttccgtcaatctagagttgcattacctgatgatcaacaactctaacacttcctgtacaaaagccaccatcagtagctaatgcattccccattccagcagtgataatatcaattttgtcaatctgcacatgcaagaaaatgtaagaaataagatgtgccaatatatccaattaaaatggtcagtaacacaattttcataaattaacaggtgtctaccaggactccatggattatacctattctttttaatcttctactttggtgcgatgagagaacaaaaatgtcaggggtactcactggaactccataatgttcagcaaggcctcgtccagactggccaagcacaccaaaagaatggctttcctccagaataacacggaatcgatatttctccttcaatctgacaatctcatccaagggagcaatttgaccagaattctgcaatcgtcacagtaagagaggatatatccaaagtcatatgtttaaacgatttcatgattttctaggtcgtaaaaattcatgagaaaaatgagaaaaaaccatactcatgtccaatcagagttatcataaaaggcaccacacctggtagatagattctacaacaatgtatcgtctgatcttttctgctcgtttatttccacgtgtaagtttttccaaagtgtttgcaagtgaagccatatcattgtgtttaaaataaacaacagtgcttcttgacagatgaagaccattttgcactgcccagtgcacaccttcatcactgcaatgcatatagaaaacttgcttaggttcaaacatgaaaaatcaagaaaagaaaagtgctacctagtaaaagaactatccaggtatggagctaattgcatgaggaagaataacaactaaagaatagatacatgtaagaggtgacaactttgaagatcacaaggcagacatatacactactttctaaagggtttgtgcaggattttcattctttttttttggttggggggggagggggggggcaaggaagcagttttcatttgatttctttcttacaaaaggcaggtatataaaaaatgtgaataactaaaacatttatataagctgttgtactgaaaaaaaaagagaggacaaactctatatgtgccggtattgttcatattactatgtgggcaaaaggttaacttacgcaactatgatgtctcctttcttacaaaaggcaggtatcacactaaatattgtagaaatcccatatgaatacagaattgagtctggagttccaagaaacttcgctatttttgcctcacagtcaaggtggacatctgcaagtgttccacaatgaaaagataagtttctcttccatatttgcaacacagatcagtggtggcaaaaagagagtatacaaaccaattgttccataaaagccacgtggaccacaagaaccaacaccatatttctccagtgaaccaacacaagaatcctgcaattcacccatgtcaaatatcctggaagaagtgtcaaaataactcctaaataatagagttttggcttacaataatcttctcattgccaatcaaaccaagataatttgctgatgcaaagtttataacttctttcccatcaatggttgtatgtggagcagcagcactgtagcaagaaacgtaatagtgttaagacccccaaaactcaggagaaaaaacatgcaatgcccaagaattgcaggtattctgcaaacataaacattctcaattccagcattacacatccataaacaaggactcatcaaacagatgatatatcatgcattgcaatatctgagggaagggcaacaaaatgaatattctacgagtgagagttatttgagattggccacgctatgttagggatgctggaagttactcctaaatttgtattattcagaaagctgctgtccattattagtgcaacgcaagcacataaatggagtattgttgataactggataaagatacaagattataacagatggaggacaacttttataacaaaatactagcaagatgcatttggcagcatgtattaagtcatttgatgttcttattaacgtcgtaaaaagaagaggaaaaatgtttgagaagatactgcaagttacagaaagcagatggcgattgcgaatcaactataataacttcaagaaaagttagtctgcctaaagaatagaagattgtaagcatttggaaagcaagggatacatgatacttcaagtgattcatgatgccctgtattcgtctaaaatttgaccagatttgtggcatgcaaatcatctttttgcatgcagtatttgtcaagaataaaggttcaagtcaatattgccttcccacatgctgcactgcctagttaagttaaccaatgcttgagcttacaactgccccaatcctgtcatgctttctctcatagtttatctagtaactcactacttatgaaataatatagaggaatactgaaaacgaattatttcctgcaaggagctttaagaaactaccttcagaacagacactatcaaacataaaaacttccttaaagtaagaaaaaagaactcccatatggtgcatcaactaccgtttaaactttaattagaatgtaaccatcatacaaacctttccaacattggtgtgtcaattcgggccccatccttgatcggaggacacagaggttctggctcccattcatcacatagctcgtcaatctcctgcaaagatcaaaatgctaactttcaccaacaagttctggaaagcaatgaccaaaaccaatactctaacacaaagtaacagcgaggaacaggcagaagataactttaccttttcactgagtggcttcttgggcggtttgtagctcttcctagaaagctgaaacactatgaccgctataaggagcccttcaacaaccaggtgccctgaaaaatggaatgttaccgaatgtcgatcgcccttatcacatcacaagttcctcattgatgtggacgtaagaggcttaccatcgatatgaaccccaaagacaactgcgcgggcaaaaggggcattgaatgcagctgagacacgagcaagcaccgctgcggtggcattcactattggcaatgccatgtccatgtcctaatgcagcttttcgtaacacggaatggaaactttagcgcctcaaatctgccaaaaaaggcaatgggctgctcatcaatcaaccagatcggctgcagagcagaatcaatgttgaaattcatataagagtaaattttactttgggccaccttttactactggtgttttgctttggaccaccctttaactaatattttcactttgaaccggaaaatcttacctttgtgtcactttggagcacactcaaatcttttatctatctacatcaaacttgtcatctgtcaaataaattgccaggtataaagcggtgggaattcactgatgaatcggagccggcgtactcgaaatcgttcatatgcttgagaagagagttagggtagtccaaaatgcaacaaaggtaagattatctgatccaaagtgaatacgttgattaaagggtggtcgaaagcaaaacaccggtaataaaaagtggtccaaaatgaaatttatactccttaaggtcaaggattgaactatagacacggaatgtaatcctcaggtccaggggcgaacgatacgtgcgccacggcggttgatactactactctactagtaaaactaaggctactaagaagacaaggtgaaaacctagcttccagatctagaagagaagataaggttactgcaaaattcgagagaaggcgtgggtagaacgggatggatggggaaagagagaggatgtgaggtcggcacgggtgctcaccggagccggaagggaagcggggagcaggacgacagcacccggtcaccgctgctcgtggaacggatggagatcggcgcggcgcggcgggcgaaccagcgaggaggagacgttggggatcgacttgggcgcaaaacgagtcaaagaggggagaagagtatgcggcggccttgcgacggccagcgcaagccggatgtgacaagtcaagagagaagagacccaatccgttatgcttgcacgttgctttgttgtttggctttccaaatcacgttttcgatctgctaaagggccgtttggcacgaccttagactctagcttcatctctactcaagttaaaaccaaaccaaacgattaaacgattttagttccaccttaaaaaatgaaactggctaaaatgctctcacaatataaattagagatgtgaaactatgtttatgtttagtctatttcagacctaatttttaaagttaaatttaaaagttggtgttctattaaacgggtaagtctatggctttccaaatcatatttttatctattaagtctgggagtgaccgaaataaaccgaagtagcacaatttatatatgttatttggtggtcacttatgaaagacgatatatagcctaaaatagcgcaattaataaatcatttgtcaatttaatttaatccgagacgctttttaagtgaatatataagaagactgcgaagaacctatgttacttatttggttttcagtgatgtatgtagatattataaaatgatataaatagttctacaaatatctgtcacgacaattggaccaggtggtgcatgagtttttttttatccagagcataggtggcggtctaatctagccactaagatatatatttctatcaaacttttatacttgggagatatttctagtcgtttctttcatatatttttttggccttgtgcattatatgcagaggtcggggatcactcagttagattttattctcttgatgtaatgttattaactaagtttaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37942 - DNA, 166 bp, Oryza sativa
actctgccttgttctctgcattggttgtgtggtcttggcttctgctggaatgggcaactaaacccatgccaagcaccggcaccaaccccgactggaactccagccccagcaccagccccggtggtgacaccgacgcccgcaccaactccagtcccgacgccatcgc

SEQ ID NO: 37943 - DNA, 156 bp, Oryza sativa
aaaaaaaaagaaagaaagaagaaggggtttaacatactgtgtatcggatgggacgcggggtcggaagatttgtttgatcttgttattctcgatgtcgatcatcctctgatagaacctggccatctgcgccttggacttgcggaaagcgggcttatc

SEQ ID NO: 37944 - DNA, 529 bp, Oryza sativa
gcattaatttcagctagttcagcttccagttctccaagctttatctgttattcaaaagtgttaaaataatactagatttatattctgcatgcaatcaggaaaaatccattcgattgacacacctccaaatcatcaaagtccaacgaaatttcagttaattgtgcagaagttgatatgccagctttggacatttgttctttgaaaaatcttaatttgcgagccatttcaccacacctttttatctgcacaacgagtagatcccagcatgaaaacagggaaaattaacataaggcagtaaggtaatgaaaactatgaacatgagatatactatatagatagaaatccatatagcaccctaaactttaaaaagtccaaataccatcctaaactttagatagaaatatgaacagttttacaaagttcagggggttagatgtccggttttaaagtttagtgtactagatggactttcattcaaagtttagggggggatatttggactttttcctcatttataccaatgtcacat

SEQ ID NO: 37945 - DNA, 784 bp, Oryza sativa
agcccgcggcgtacgagcgcacccaccggaccgcgtcggcggcgtcctcgaacgcggcggggaggcggtgctcgggcgcgaggcggtagtcgacggaggcaacgaccgcggggatggtggccgcgagggccgtgcaggtgttgtggaacggctcggacgccgcgcggaagaggacgtacccgccgccgtggaagtacagcaccagcggcagcctgcctccgccgtcggccccgacgcatgggccggacggcacgaagaggcggacggtggtgccgttggcgtcgttgagtggcgcgtcgttggagtgcacaatgcggcgcgccggcccgttgaccccgtcgacgggctcccccgccggcgccggcgggaggagcctggccgcgccgttgcgggtgagcgagccgtcggggttgaaccggatgttgaggtacttgtacgggtccatttcgcgatcgagatcgagcaccgcgctccggaggaagtagtactgttggtggtggtagctaggcaactcgccacggagcatggcgcgcgcagcgcagcggatatatagctcgcgcggcgggggcgcgggagactgtatgagggagccgacggtgacggcgactcaaaatactactccttccattcggtgatagtttttctttgcatcgtttgaccacttgtcttattaaaaaaatcttgtataaataaaaaaacgaaaagttatatttaaagtattttagataataaagtaagttaaaataaaataaataataattataaaatattttgaataagataa

SEQ ID NO: 37946 - DNA, 29916 bp, Oryza sativa
attgtactgtttgcagaaatgcagagagcggttttgtttcaccgttattccattgttggagaggagaacagtgaaaaaaaacgagggggtggtaagagataaactcaaacgaggtgtggtaagagagaaactgatgccgtttattatggaacgacgatcgtatcaaacggtacaaccctgtaaaatatgattggtgtgtcttggttgagttttttttttgaacgatgttctcaatccagtgtgagatctatttttggatgaattgatcgtgtgttaaattatgcttaggagcaatttatagcttttgttgagttgtgtgtgcttcctctatgaaaaagttatgatgcacgtttagataaataccggaaaaggagaacactgaaaaagatagatggtaaaagatgaactcgtgtcatctattatggaatgttgtcacgcccagaactagtaccgaccggaactagcccgtgacgctccaaattaacctattaatcgataccagtcccaggaaacagtgctggtatcacaggaagacagaatatcacagcaatagaggtctctttattatagagtaggagtacaatcaagtcgggctgcggacagatcccgagctcacaactgcattacaaaagggaagcggaagccaggacttggaccaaacaacacaggcgcgacttgggaactaggccgaaaccctaaaactcatcgtagccggcttgctcctggaagaactcctcgtcagcgggatccgcttcatcttcttcagcaactgggggggagattatttatatagagcaagggtgagtacgggagtactcagcaagccatgggaaataagtgtttaatgcaggcttcaaggaaaggctgttgtttttgcaattgattttatttgaactcttttctgaaagcaactaagtgagtgcttctcaaacgacatggatgagacagtgcgtcttgtccggtcggagtatgtgcaaatgtatcagtctttagaattgatcaagattggcacccgaccaacaactttcaaacggccacccgggccaacaactttcaaatggccacccgggcctagctgatcccatcagctgcagatttttcaaacatcgaacccctttccacaacagcaatttcacaagcagtagtcaaacaaaactacgctaggaatcacctcacatccacccatgaccgtgggcacggctgttcgaacagtttgttaacctctgcagagggggtacactttatccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaaacccaggggtcctccccgacaccaccccggcgaatccacatgtctctcggcatcaaggctcccctgataagctagttactcagccaggggtgtcccattccacccatgtggtcgtacttgtcttatgtttggatgaaattccaagaaaacggtccttaagtgcaagagcgggaaaccgtacacccggtacgttccccggtccgcggttttggaaaattcatttagttcgcaagcaccgacccaggtgtcgggttttccaagtcttttgtaaaacccaagttttacctaagaagtttttcagattttaagtttgaaggcgaccgtcgatactcgtgcagagtgcacgatttccgaggcgcaactgggtggttacaagggaacatggtataacaattaacaaaggaaggatcaaatgcaacaaactaggtaggtccgccaatctgccttgcagacgggacaaacagattaagtgcgatcctatcaatgcataatatttttcaagcaacataattaaattcaaatataagctcaagatgttcaaaggtggcttgccttgctcgagatctggagcttgatcctcgaaatcctcgcactgcgggtcttcgggctccgaaactacgcgcaaaacgggacaactcaacaaacggcgaaaataaagccctattaatgacctctaagcgtgccattagatagatctcgagatttgagggattttggaagttgaacggagtcaaacggatttacggttgggaagatattgaatttctaagattattggatttttggtctacaggaaaaggacttaattaaatcctttttgaaaaagaaaagaaaagaaaagagggagggaaattagacttccctcgggcggctagggcgcggcccgagagaaaaggggcggctcggccgagctaaatgggccggccggcccaaggcacgcgcgcgcgggaggggaggagagagagagccggtggaccgggctcacctcgcgtggtcccgagtgggacccgcttgtcagcggctcggctcaccgtgcggagagagcacgcggcgcggcgctaggatgggggagagacgcggtgcacgcgcgcggttcgtggaggacgcggatgcggtgggcccacgcgcagcctcacggttcgcggtggaccgcgcgcacggggagggagcggctaaccggggtcgactcgacccggttttggccgagctggcgccgacgtggcgcctacgtggctgccacgcgggccggcgggaggtcgacgacgacgccggccggaacggacggcggacgacagcggcgagcggcggagcgaaccatggcgatacaggcgaaagcgagcacaccgggtggttgcataggacgaggggagacgagccaacggctcggattcgccagaggatgcccgacggcggcgaattgcggcggcggcaaccggcggcgggagaagggggaaacggcgacgaggtcacgaggggccaattcccggcggcgagattatctacgcggctacgggaatctgatgctagcgttggattgggcggagctgcgccgagcgaggccggcgacgagcggcgcttccgagctcgggcgacgacgacggcgagcacacggcgagcggcggcaacggtcggggtgacgcggctagctacggggaggctactcgtgctactacccgagtctaaggggaggagatggagcgaggagggagaacggggagatgcactaccgtgcgggcgggcgcagtgacgagaggccgacggcgcgggagtaatctctccggcctcgggccggggaagaggaaggagagggcgcgctcggagtccccttccgcgtccttgctcgtgccggctcctccgacacgcgcaacgacgaacggcgacggcgaacagagcacgggaggcggcggcaatggcgtggaggcgaatgggagaggaaaggaaaagagggaagcttgggtttataggatggcaatgtcagtttgggaaccgacttagggcggtcaaaggagagggctagcgttcggcggtcgcggccaaagcggcgacagggaggagggaggaggatgacgccggcgggaggaaaaaggggaaaagagggagataaaagggggcttgtccccttgcctctttgggaaaaggaggagggagcgggggcgactcggcagagggaggaggagctctgcctccgtcccttggcagcttgcgcgcggagtggcgggggccgggcgatgacgacggcgatgacggcggggcggtttggagcggggcgacgacacgggcggcaggcgcgggcaggcacggcagaggctgacggcggcggcgaccaggcggtcggccaccacggcacgcgcgcgcggttgcaacgggaggcgcggcggtttgagcggcacagctcgggcacgcgcgctggcttgcggggccgagcggctgcgcggctgcaggagcggcagggcagcggggccgggcggcgcagacggcgcaggcgcgacgcgggcgacgaccacgtggacgcacgcgcgaacaacaacgcgcggggccgattccgcgggcggggagctctccagggatggaggcggggagaaggagagcgaggggaagggagggcctcggcgcgagcggctcacgcgcacgcgcgcgggcagagcggaggggggagcgctcggcgcggctctcgcgcacgcgcgcgcggcgcgcgggcggagcggagggggagggagagaaagagagagagagggcgccgggcagggagggggagatgggccgagagagattcggcccatcgaacccggggaggcaaattagacttttgcggaggaattgatttgggaaggatttggattcgggattgaactcggcgatagatcggggatttgagatctgagatggcacggacactagacaacaagcaaagaaacagatttcacaaatagagtttttaagagatagttttcccgctaggcgccacgacggaacgggcgctacaaatgtcgaccgtttcgcatggtacgagactgtaaaatgcgattggcatgtctcattttggctttctagaaagatgaacttgatcccacataaggtatctatttttaagatgaacgaatgaccacggattaggttacgtgtaggataatgttgagctgtaattcctccataaaaaaatacgatgtattttatatttgggaaaaatattctttgaacaaaaaataaatcaaattatatgtgtactgtggtgcaaggcacacatgcacgacttcacggtccctggtttgcctctcttttaattcgcacctcgtgtaaaatgttacggcctcttcaatttcttttataagactaagaatatggtttaaccgcctttttttttctgtgctgcaattgcattgaggagaacgattttgtttaccactacgccaatgttggagaggagaacagtagaaaaacgagggggtggtaagagaggaactcgtggcatttattatggaatattgactgtgttaaacggtacatcgatatcactgtaaaatgtaaaatgtgatcggcatgtcttgattgggtttttagtacgatatcctcaatccaacatgagatatctatttttgatgaatggatcatgggttaagtcataattaggagcagtttatagtttgtgttgagttgtgcatacttcctccatgaaaaagttacgtcacatatgtttagataatattggagagaacaatggaaaagagagatggtaaaaaaggaacttgtgccgtttattatgaaacgttgaccgtgtcacatggtacaagactctaaaatgtgattggcatgtctcacttgagctctccaaaacgatgccctcaatcccacatgaaatatctattttttgatgaatgaatgatcacggattaggttacacataggattaatttatagttgtgtacttgtgttgagttgtacttcctccatagaaatatattatgaagtatgttatattttggaaaaggtatagattttcatcaacaattaatcttaatcaaattataagtatatttagtatataacaattatatcaatcaaaaatatatatcggtttgtaaaaatgttggctccatatattgtaagaaaatctatttttatgaacaacatctaaaaacttattcaaactgaaatgcatctatattttttcacataggggggttttattgagtataagtcggacacaggcacgacagttatatttttaattttatgtagagatgaaacatataattatggtttgtattacaaatcatattaattttagaccaaatattttattcatctatcatgcccttccaattgtttcaaaatatatgcaataatattgttggttatatctaagatataaaaaaaatattgtgtggataagccaaaatatcataagaagttgtacaaattatcgcaatccacctcaatggcaaacagtcttaacctaccaatatatgtattatttatggagatataaattaattaaagctgaaaaagataaatagagatataattgtgatctccaccaacaggtgaaccttgtggaaatatacaacatcaatagagaattagggatagagcggccggtctaggatttgaggaaaaaatgtcgatagtacacataaaattttctatacatcagagcgtgatgtatacaatgcgaatggtgaaaaataacattatctgatatgtgcacatgatttttgcaattacataaatgacgcacaagcatgcacacgtcattctatagtacgcatgcgccataagtgcgccccttaagaaatgtccagagaaaaaaagggagtaattaaccaaaagttaagaaaaactaaacggcgagcacaagggcgttcccaacccaatgactaggatggtgtccatagcattaaataagttaccacctagaataaaaaatgatgtggcaagtgaataaatgaggaaagagaaggaaaccatgtcttgtatgagatatggtttctacacaacatccaagatatcatgtgatataagtagcattaaattgaagtatgaaatagtggtgtttgcattggaatagtagtgtctagtactagtttcttgatgatgtggagtttatagaaaccatgtctagtgttatgggctgggactgccctaacaaccgcatgtaggagtacatgattttttttcttcttcaattcatcattttcttttctaatttttatcacgaggttggtcgcggatagtggtccatctattttctctttatttctttctcttttcttatgtttgcacacaccattgcatgcgttatgtatgtcttggcaattactcctactagctagcgcgcacacagtggcgtcgcactccgtaattaacgtggacgtagcgcatatgctttagtcaagatcccaaacgaaaatcaagtgaaaaccgtacaaacccttcacatttttctcccccaacttgtccatgtgtatggcttaatcttaaatctttgctcatgaatctttaatcttttgctcatgaatcacgggataaatctcatcccatcaaagtccgtttcaatccctttattctcgctaccccctcttgtacactgtacacgtactccacggcctcgacttatgaatcacgagggaactcaagtacgtgaacgattaatttgatagcgatcgaactgggatcgaatatatctaattaattatactaacaataatcatatccggcctaattgattggtaaattaagccgtgttaacttatctaatttaatttaatttggagcggtggtatactgcttgcttgtacggggtcatgtgttcgcacatttggcttaatttcatcgaaacggggaacagggacagcgactcgtagcccaacttgcagagaagagaagaaaaaagggagaggggagaaaataattaagttgccgcgtgaggtcggcgtcatgctgccggattaaattagtcacgtgtttagcaacgtgcgtggaattttattataataatttttaaattactccctttattctcttttatagacgatgttgctggtttttggatataccgtttgatgattcttctcatttaaaagtttagggtagatgtgcaacaaatactacaagttataagttagtagtataagtaatggttaaaatatttttaattgataaaacgagtcacaataaaataaataacattcatacgtatgtttttaataaactatataaatgatcaaacttattaaaaacattagtcgtaaataattaagcaatttgttgcattaatagggaaaatgaaaagggaaaagaggcagacagattgagcaagtttagctttctcgcaccagctagcgcacacgatgttggattgattctttcggctgtggaggcgtggtagggccgtaattgatttgttcttttttattttggtttgatccgtcgagcgcagccgtctgctacatgacttcgtagtacttttgtgttgaaaattttgcagataccagtactactagtacattggatgagcgtattattgttgtgatagaaaagtataagtaaatgggaataattggagtcaaccacgcatgttaattgcagtgatgatcgatcatcaccacgcaagggcctccatgattccaggagcgcagctacgaaccagtcagcagtaggtagtggtagagacgtggagtagatcattattgaactagtcagacaaatttttcgctcaattgtttttcttttctaagcccgtggtcgtatttgttgagctatacaggtcgctcattcagcagcacccatgtttctaatttgcagacagaaatggtgcatatccacataatgattttctttttctttttggagtcagcggaaggaaaatagagacacgtcaaattttcaaactatcgtgatccattactaagcatattgggtgcggaagaacactctgatactctggttgtagtgacccgagtaggatcctaatgttttgagttcaaatatctatataagtgaattttagatttggttatttgagggacaaagttttcaaattaaaatgactgcatatatctggttaaatatatatgccggtaaaaagtaccatactcttagtatattggatatgtatattagatgtatgaaaattatattttagtctttcccaaaattttcttctggctaaataacgacaatggctctattcggcagccatacaagctgctgcggctgctacatcagaaatttgctgcaagctgcagcaattcttaactactgcagctgcagccacagttgaaagataccagccgaacacacccaattagtactactcgtatactggcaaccaatcggttactgttggttaaaaaacattttaaaattttaaaaataggtttgaacattcgcaagataacgatatgttttacgaaaccgatattctgaacataagtcatgacaacagctggttgcagaggaggaaacaggggggaagctgatacatgactggtggaggattaaggtggctgccatttggggactctagaaagacttaattgttggagttagaaatacttgatcgttacctctttgtaaaattcctctttgaattagaaatatttgggggatgctatggtcaatcctttttcattgatgaacttgacactatttaaagaggtatttgtaaaattcctctttgagttggaaatatttggggatgctatagtcaatccttttttcatcatgaatttgatactgcctaaagagtataaaaaatgatgcaaggagaaagaagcgttgctccaaacaatttttaaagaagaaattgtaagtatgttggacattgaatacgggatcttatagttgaaaccacataccccttgccactatactatcaagtgcatttaaaaaactatttaaagaggtatcaaggtaatatatattataatgcaattttttatacctctccaccttttatactacactatacggtgcaaaattaatgatgcattttcaaaaatgcaaactatatatcggagtggtatatattccaaacgctaacgatgtaatatgctggtacatcagcgataaaggaaagattcttagtgtacattttcctctgaaactttcgaatattcagcagaatctgcaaacgcgcaatatggaatatcgtggcaagagaaggctgttttttttttttttttggagaaccagagaaggctggttgaacttggctctccattgtgatcaactcccgtttagtttactccccctcactcttgactacaagcacacgcacgctacactgacccgatgttcggtgtcgtaattaaacacgacgcatgtttcttaattagcttagtcggagctttgaaatggtaaacatgtagacgcacgccaagtctcggggaagacgacgtgtaacgactacaaataatacacattcatgcacgtctcctctttcttactcgttcctacttcctactcctcggcacatgaaactttacacgtatgaacctactttccatcaaggccccggcatttatgtgattgattaacagttatttttttatattacaccctaaattcatatcaattttcaatattataatcctatttttcccacgtattcgcatcacaattcaaataccatgcatcccaatatcacattatctcatctggaatatatatcatgctgcttatatctttttttttccgaacagttagaccgttgccaacgttttatataaagaaaaggatgtctcattttaaaaggaaaacgagaccaaatcttaaattacacggttaattaaaaaaaaagacgaaaaccacaactacatctacactctagctacctaagctataaatgcggagccaaatgcagccgtcgagattgatcatattgaaaacatggcatgagaacatgaaccatcagaagaggataataccatttgttgaccattttatttggatttacaagccataggtccgacaggcatcaatccgtgtgcatggatccttacatataagatcagcatgcatgaaagaattcttcaaataatcaaagaattctcaaacaaacagataagctgacagattaatttaaccaatcatagctgctacctagctactaattcccccggaagaaaccaacaactgttgcaaaatagtaagaaatggggaaaaacgatcaataatacacggttccacactttccacagacacgtggaaatcaaatggtaaatcaatacagtactactagtagtagtaattaatttttccttgtttgatccagctatcttcagtttcttcggctcacaggctgagagtggggttcacctggagccacgacgcgccgccatcgtctttcttggcacgcttgctcgactccgcctccttcttctccgactccggcagtggctccgccacgacgatcctgttcttcctcttctccaggaacctctgcagcgacaccttcctcgcgatgggcatgtctgcagaaacgtagacacgtcagttggttggtgaggtgatcagtgtggatcgggtcgtcagtgaactttgcccggtgcatgcatgtgtacgtgtgtgtttggagtactagtcctacctggtaggcaaggctgccccgctgcggcgccggcgtctgagacggccgccgccgccgtgctgtcgcgggagccggcgagtttcatcagctcgccggccttctcggcggggaaatcgtcgaacaccaccacgctcccgccgtagaagatggtcagctgcgccttctcggtgatctccttcctaacaaagaagaaaaaaacacttgcagctttagcatcgaaccagctactagtttcgtcgatgaactctcgcgtactaggtgccagtattccggcctgtttgctcgtacctttcttgcgtgtctttcagcgtcccagcctgctgagggaagagctccatggtcttcctcacctccggcgcctcctcctccgcatcagcgccgccggtcatgaggctcatggccgtcaccgccggcaagaagccaccgccgccgttgcttccactgtgctccttcatgtactgcctgagcaagccacacgtcaccgcgaacctgctcccgttcccggccaccgtcgtcgccgccgcgttggcgaccagctgctgctcgctactaccggccatgttgtagctctagcaaaatcagctagctcacatcaaagctcgggaaatacactttggcttcctgctgcaagaaacgaaacgaggacgaaaccttcccgtgaatctgtagcctgtctccctcttgttatatactaggtgtacatgtggaaggaaggaagacgaggcctaaacgcctagtataatctttgtttctcgggtaggaaagcggcacgtgaaacgcgagcggagggaagcgcggcgcccgcgcggaaaaaaagacgagaaattgcgggcacgcgccgcacgtctctcgctgttttcgcggtggttgttcgatcgggtcgggacgttgggttgggttgggttgtttcggcggcggcgcgcgctacctctgcctccgcagcgtggctgcgtgggggggatcacgtgcgtcgtgcggccgcgccagcgatgcggtgtaaatccaccggtggtggtggcgtgcgaatggggcaaatgacaacgctgggaaaatggtctggttggttttgggttagagcaaatataatagtaagcctgctaaatgataaggtggaggagagaagagaggagagagaggagaagcgagctgtaaacttaacagccggtttggacataagaaccaagaaactctgtgagagaggcaagtgtacccaatattaatgataaaaagctaactatattataaaggtacgctgagagaatactataaagaaccttatagccagtaagttggctgtattattaatcttgctcttatcggttaaaggccctatctagttcccacgtaaaaacttttcaccttgtcacgttaaatgtttagtcacatgtatagagtattaaataaaaaaaattacacagattacgtgtaaattacgagacaaatcttttaagcataattgctatatgatttgataatattgtactacagtaaatatttattaatgacggattaattatacttaataaatttgtctagcactttacaagcggaatatgtaatttgtttttgttattagtctacgcttttaaatatgtgtatgtatatccgatgtgactcgtgaaaatttttcacccctaaaactacacatggcctaatttttggtttactctggccggctacggctagcggggcatgtacagtacgtacgcacgcacgcacgcacatggtggttaggtttgggcaccgtttgggccctcatgtatgctccatcgtgtgtaaagaaacgtgtcaagcaagtgcgcccgtgtgcacgttgagtctgaggctggaggctgtgcacgatccaaaattaggtgggggtgaaaaagattttcttttgactatccgtttttctacaggaaaccctccttttctttcgtctaaacaatattgactgtgactaaaacgtgaagattggttgaagatggcattttaatcgattgtagtatattttttcttggcatcaaaccaacttatatataacatgtgttactgtgcatgtggcacctaggtgcattgatggaatgtttacaatgaacgattcttttctttattttttttctggttatgacctcctatgattgtaatcttataattttttctactctatcaatataaactttgcactgtttgatgtgagccgttaaaaaaaacagcctacgcaaccaagcaaatccatggttcagagacactaaaaaatgaaaaaaaaaatccaattccgtcatacatgcataatatagagttgtctcgttgccttaggaaaaacagttaagctatgcgtcatgtttttagaataaaaagaaattatttgatagttgtactccattttttccaaggtttgacgagaactggcaaactgttataatttctcagagagtctatgcatgcgaaggattatttttcgacgagaactggcccgacgtaaagcttctaggaaatgcatgagtgcacgaccagccgtctcgatgaatattttgtacttgcaaggttgcaaagtgcacgttctcttaataaaatacttcaactaattaacaacagaaaattctcagaatgatgtatattagggtaaatcaaagaaataaagtctctgaaaaagcaagtgacgatcgattagaaatcgaaaaggaaaacagcatgaaggccaatgccatgcacgagacgtgcagaggtggtggcgccactcggccactgcacccgaggcttaattagccagcactcaactgtgtactttgaagaagaaaactcgacactaccgaagacgacacgctccaaagggcacacatgtcacaaaatccggtcgttcaattttcagagtcgtcgcggttacagacagcagcgtacgaaatgtggggcccacatggcgatcgtcccgggcgccgcagtcgcttacatgtggggccatggcgcaccagtgcgcaccatagttctctagcatagtattatcgatcaacgaccacatgacggcaacaatcgaaccgggcaagaaagttccttgctagctaggacgagacgacgtttcgtcgcgttggcgtgcagcccccagctctcgctttcggctgctagaaagaaacacagagaagaaaaactaattaaacgagcttaagctagtgagtgcgtacacgtcgcgcatgcaccggcctgtagcatcttgcaacaacaaacaactcgctgcaagctgatcacacgctaagcatagtttacgagcgatcggtttgtccccattagtatgttaagctatcggccagcggcgcaggggaggatcagtttgattaagcgagtcctagataaaaaaaaaacgtcattagattaagcgagggacgtcgtatcgtaggcatcgagtggttgggtttctaccgcttttgccgcgtgaacgacccatccgttctcgtacgtacgtaacagagaatttagccggttaggccctcacgacccggcgttgcgtgtcgccatcgcgcagctgtgttctgctttgccgggtaggcgttttttccccaactcgtccgtccattcatcctccccggccgatcgacagaacgaacggcaaggcgcggcgtacgaaccaaacgggaacaacgtgcattgctgcttccggcaaagttttttttttcttttataggctcggatgaatggacgggccgcgagcggcaggtaacgtagctactagtagctagtagtagcctcatctagttaggccgtgtgctgggttgtgcaggttaggccgtgttcggcttggttttaggcctcctgggttcctcgaatagaatggcaccgtgcgagttgcgcaaaaattcttttgcgcatgtggagtatatagaagtggctcatttcgattttcaacagattattaattaattgattgattgattgattaatccgttgtgaatctaaaaagaaatattcgttgtcatctgaatcatgcagatcgatcgagttaacagatatggtccgaacctgtcgggcgagttgacagatatctaacggtgggctggccgtcgatcttatcgatcgatgtaacaaccaaaagcaagagagtgtacgtacgtagtacgtgtttctccccggaacgaggaggcggttacccgtacgtcgacgcgaaacggaggaaagaccatttcaaaccgaatcaggagggggttgggtttgcatggcggttggcctcgcgcgcgcgtcttcgtcgcgtcatgcgcgcccggccacgttttcctcacgctcgcgcgcgcgcgcaacctccactaatcaatcgaccacacgtttcgccccgcatgccctctatatagagcggttgagccaacctcgcaaccaaccatatgtgatcagcgacgtacagtacagatcgttcgcaataaagttagacttctcgtctctctttgtgcttgtgcttagttgtccgtgctagaagacggcaatggcgtcgacggatcccatgacccgccgcttcgccgtcgcgtgcggcgtgctcagccagtacgtcaaggccaactcctcgcagccgtcgacggcggcgccggtggctcaaggtgtgagtggcctcatggccgccgccgccgccgccgccgcggcgcctgtggtccaggaacccggatgcgaggtggacggcggggggcagcagttcacgatcttctacgccgggaaggtggtggtgatcgaccgctgcacgccggccatggcggccgagctgatgcggttcgcgtcggcggcgcagggcggcggcggcgcgccagaggcgccgcccgcgctggtggacatgccgatcgcgaggaaggcgtcgctgaagcggttcctggcgaagcgcaaggccacccccgcctccgcgcggtcgtcgtacgtcgtccgtgctgcggcggcggaggaggagcagccgccggcgaagaaagcgaaggcggccgtggagaggcgcgaggattggctcgcgctgggaagccttggacacatgcactcgcgctgatgatcatcgccacgacgtcacgtctgcgatttgagaattgagagctcgatcgattgatcgccatgtggtcacccggtagccgatgctgcaaggccggtcgagttggaagatggttctcgtcgcattaacggccttgagttgatttcgccgagcctgaccttgagttgattaccatggaagtatgaagatttcgtgattagcagttaccctagttatcgcggcgtataattaagcacggtcactgaagcgcaatggccttgagtcggtagatcaggactagagaggggtgtatggatctgacaagtactgtagtatattgtatcccgtttgaattttttttcgattcctatggggactgaattgattaatgatataaaattccttcgactgttctgaaattcttgcatttacacatggtgattttgttctgtgattttagccgtgtttagttcacctccaactatcccaaacttccaactttccatcgcatcacatcacatccaaaactttcctacacacataatcttctaactttttttttcaaacttccaactttccccaaactttcaacttttttcaggaactaaacacaacctttacatagcactcctgagaaattctgctttacacatggtaatttgatccacgatttatagagcactcgtgtgaaatagatctgcgttacgcttggtgatttgttctatgatttatagagcactataattcttctgctgctaggtatgaatgtatgatcggtttctcatatagtcatatgaatgccccgcaaagaaaatacgaatgagctttgtggattttcctttaaaacaacatagtagtaataagtaaataaacatagtttaaaggttagagatactatatgtttctgaaaaaggtgagtttaaactaacttttttcttttagtgtacgcgaaaagaaaaaggtgaatttaccgttcttgatagataccgacttttatagtatagtataaattttgcttgaaggaccgtaaagcgcacaaacgcacatctcaagagattgagccagcactagagacctccaagacattgataggtaaaacgtacagtacttgatagctactgaattttatagcaaatattaaatgtgagcctcattccaaatctataacttaagcccaattgaatggggaatggattctaataactcgagtggatgttctgttgcataaattttgctttcaaattcaatataaatagttgtattttttttttgaaaaaataatgataatatagagcatagtgatatttaccgctccactaaaaatcaagttaaaattcgacctacacattgaggcaaaaaagacaaattcggacgtgaatattattcgtgcgctgaatttgtccttattatatattgatgtgtgagttgagttttgagttaaaattttgtggagtgatatatatatgttgtataagtgttgtcatatttttcaagaaatttttataacggtttgaatggtttttagacaaatgagagggcatccctcgagggattgaaatagtttcctatagttggatacgttttacccaaaaaaacctaatcagttgagcaaaactacttcatagttgttctgctatattgatattattgctagtgaccattgccggcaacagatgctaataccaaacaatcatacatactcctgcattgttaacacttaattgtagcagttagccttactcctggaagtgccccatgcgctagacagtgtgtattgctcgctaattttctctgcccaacttgacgtacgggaccaatcaataatccatcaacaagggggaagttaattaataacttaatcaactggcgaaatcatgggcaacatgttacatgtgcgcgcggccggccggccggcacctctctcgagttcccatcggtgctagattttgtttcccatgcgacaaagcagatatgcaccagctgggcgtaccactcaacactcatcaataatcatcgcgcagctagcatatctgcatatggcatcctcccgtgccagccctgcctttccgtcacgcgagcgcctaattgttgggcatctctcgccccgcgacccgcgtccggccgcgacgtcgacgcggccaagccaccgtgcagctgcctaacaacccggcaccgcaccgcacacgggaggagacgacgacgcgcgcgcgcgcgcgcgcgatcgcatccacacacacatggcccgcgtgcgcgacgcgagtacgcgacccggccgtcgatctcgctcatcgatcacgcggcagatcgaggggttttagctcgcgcggcgcgtttcccgtgagagaccgacccacgcgtagggatgcaaacgggacgggcaaacgaattttttttagcctgtttatctcatttttaatttattattttttcttctaaattttatattaccatatgggaaataaaactagtaagcggatttttaacggtgtgccgagaccgatagaggcggcctccagctccacgcggttgcgcgggtgggagcgaatttggggtggtggacggggacgcggacgcggccggaataaaggtgagaggaggggctagttcgttttaccatgcatggatgcgtttgcctcctgcaggatcggggggagaaagcgtgtcccctctaatgccggagtttgttgcaacgcaaggttcgtgtgaccgcgcgagcgagcgagcgagctgatgggtagtagtaggagggggcgaagaaaaatgtgttgctcgatatgctgccggtgggcggtggtgcgttgagtacgtgttcattgtcactgtcagctagttgaatccgcatcgcaattcgcaaatgagtacggttctcatttccctcttcgcgagggaaagtatgagacactgactgggttctaccgcaagttgcataattttttctccattttttttccttatgaacggtagcacctccgaagaacagtacggagtacattagtacgaggcaaacatcctgtgatccgtattgtacggccgtgcggctggtacgtacataaataggagccgtgctgcgtgtgacgacgctacgtacgtagtacgtgtgtacctagctgtgtgtctcgcggaacgtttgtcccgtcttaccaaaaacctgagagcccaacgaacgtgacgcgacttgtgaggcccaaacaggaggcgtcgacgttcatgtgctcccgtttttctggacagctctgctacctactattccatactcggttgtggatgatcgagtctggactcgtgactcgagagctataagctagccccccatggttcccgtggacttggagagacccagctgtggtcgcgaacacgcgttccggcatccaattgatcgcgggcacgagatgcgtctcgtcgtcgtatttcctgccatcttccggctgccatcggtccccgagggaggttcaggccaccgtcttcggcttgaagcgttgggtagccggccagacaactggctgccgcatctactgctagcggttgcggaaacaatacaataagcgtgataaaaactctggcgatcacagcccgtcacatagccacgattacatgagattctgcacagttatctgctgtgcaacccgttgccccaaggtcagactgctgccagcgttcgcctgttcccaaatcccaagtacttcccatggatggaaggtgtgttcgtcagggagttacagtgcaaagaatgcgacaaagttctgatgatatcgccaggacgccagaccatccatgttgactaaaaaagtaaaaatacagcaaaggccatttctgaatgggcctcaatcccagcccgtccacgtgcatatataggacgggatttcctttagttaaaatcccagcccacttacaatgaatgggccggaattctggcctgccaaacaaggacgagagtcgcggtggttggactcctcggggaggagcaagaagacgagccgtcgcccgtcggaggcagccggaggaatcgtcccgtcgtccggcgtccccccctgtatccccctcccctcgcacggcgatcggatccagcgcacgggtggggaagcaggcggcgccgctctcccccacgcacccgaagtgcggcggcggagcaggtatgcccacccaccccaaccctagaaactcgcccctcttccgctcgattttgcccattccagatcaatgtcagaacaacctgacttgactttaggacaatgaaattcatgtatgttcctaagcgattgctgatgattaggactagtcccctttgctacttgtagaactgtggaatacacagtaccgatactatccgagtgttggttgccaatcattcgtacaaactaatgaatctccagttgcgttcaacaatatgcgaaacaacgaattaatttacatgagtataaactcactagcatatattgcatccctacattcttgttccgtcaacagaacattgttgtattgatgtaaaatagtacagacgtattctctaattgagcataaatgcggtgaacagaaaaataaccaagagaaccgttgtccattttttatctactcctcccttcctggatgtttggagctaatacctagctaaattaaatgccttttcaggaacctcacttcttggtggcggttgaatctgaaatttccaaactcggaaggctagtaggcaatggccgtggcactagaggcagggaggaggaagcgagcggcggtggtagttctgggagacattgggcgcagcccgcgcatgcagtaccactccctctccctcgccaaccaggtattgatccccttcccaaacccatcatctcatattagttctgttttgttttgattgggaaagcttagtccctccagctagctgtaggtgtatttcgatgtgctgtgatagttaatattccttcatgaattttgcacttaattcatcacttctctagtgtagcatatggtcctcggttagatagcagggtaataactagtaaagaaaggagatgtggtgtgtgtcagttgtgcgattgcacagatgaagtaactaatgcagtggtggtcatttgcaccccctgaaagcgtgagcggacatagcttcgggttgattaatgcccttgatttttggttctcccttaaaaatgtgtcttttttttctccctgaaagtgtgattacacgtgcaaatattagtcctgttagataagacaggttttgaaatgaagagaagaaaattgccttgcatttactaagcatatatattttcttcaagtggcaaaaaaattgtgatattgggacatgctatgtgttgggaagaaccaactctatgtgcatatgtctctatgttttagttaattagtcattctttatttttcttgacaggctggtatggaagtggacattgttgcaaatggaggtattattctttttgcagtttcattgtacttttggattttattcatttataccttccacttagtgcacatcatacaggctgagtttccaacaactttcgaccttctgttgcgtcttttgttgaaatttgacctatgttctgctttgggtaaatgagcaggaagtgacccgcatctattattgagagaaaatccatcaattcacatccatgaaatggtactgattgtttgaaagcattacgctgttctctaattttgtgtactattaacttttgaattgtaccttctagaaatcagtgcagttaacaggaatattaaagatatccggtgccctgacactgctacttaaagctgccatccagtttatcatattgatttggtacctttgtttcaagattcctcgccctgatgtcttcattgttcaggtcagttttcacaaaattgcattgagcttctttagtcgcatgcatggttcagaattacatggacaatttatagttttctgcaattactatcagtcaatagtgtggaattcttctatagttcatcatctatcaatcacgctagtaaatccatggtcttaccaaagtattgcacagcttaattagcaagtcatgctgtagacttatacttatgcagtacctattcattacaccattttcaattcaaaatttcagctatgataagtgcagcctttacttaggcgaagttttgtcattttgtatagtatcttttggccttactaactgacatagacttttattacctagaaatccttctatttgatacttacaatttatttgttaattcgaaaatctcacacactagcatggaactgattcttttattcgatcatcttctgtccaacagaatccaccctctgttccaacattggctgctgtaaaactggctagctggctaagaggtgctaagtttattgtggactggcataactttggatatacactgcttgggttgtctcatggcagaagccatatcattgttaaaatctacttctggtaattcctgtcctgtttgtttatctgctagatgtagcatactgattgtgtgtgttaatatagtggtgtgttctttgcattctaggttcgagaagcattttggacggatggctgatggtgccttctgtgttacaaaagcaatgaaacacgagcttgatcaaaaatggggaatcaagtaagatcaaactttcaggcacttttcatgtttaaggctgttgtgttagcacacaactacttttatttttgaagtcgctagctacagtttatattaacttaactggttggatttcagcgcaacagttctttacgatcaatctcctgaatttttccatcctgcttcattgacagagaaacatgaggtgagcatctgttttcatttatttcctcatctttgctgtactgcctatctgaccattagatgaaatagttgtttagcaggttggggaattccatttgtagtgctatgggcaatgacgattgcatttctgttggtatgttctccagccactctaaatatttgattgctgtaagaaaatttcactttgatatagtttctactgtttgctcttacaacacagagaaagaagtggaagacaggaacactactgtatttacaagctgggtcgatggtgaaattttcttgaagcctaatagaccagctcttgttgtcagcagcacaagctggtctgttctcttgatctgggtgatcctagttgtatcattatttatactcagcacatgtggttaaaatgaaagtaaaattaagaatcttttcctttgccacatatttcaggacaccagatgaagatttcagcatacttctggaagcagcacttatgtacgatagacgtgttgctgcaactttaggagaagatgattcaatggacgagggaaagctttggattgatatcaagaacgggaagcaatttgtctacccaagactgctattcattatcactggtttgtgcattctgctaattagctccagtaaccagtttttgagtattgttatgatatccatgaatatcaattttgaaggcaaaggacctgataggatgaagtatgaggagcaaataaagaggttgaaactgaggcgtgttgccttccggactatgtggcttgcatcagaggactaccctcttttgcttggtaaactagttgattgccaaaagaattccatgttgtagcataaatgctgattctttgaataattacaggatcggctgatctaggtgtatcattgcatacttcctcttcagggctagacctacctatgaaggtataactcataagcatccgctctgttgaaaaaataggcattttttatctgttgcgtgtaacttgacgattttgcttttaggtggttgatatgttcggttgtggattaccagtttgtgctgcttcattctcctggtaatccatgtttcccgtatgtttgatttgttacatttgggctttgaccttcatgtcgtttgaattaaaagtatgtcctaatttttttttcgtatgtgcagcattgatgagcttgtaaaaataaataataatggacttcttttttcaacatcttctgagcttgccgatgaacttatggtgatgatcacttttaattatttatttccatattttatgttcatatcttttttttaaatacttgttgaaagtgctgtgtctagattttaattgttgcaatcgcaaatccatgcagatgctctttaaggggtttccggaagaatgcgatgacttgaaatccctcaaggttggtgccttgaatactgggtcatcttccaaatggtcgacagaatgggaacgttatgcactccccttggtgaaccaggtcggatcttgaacctaaatgactaaatatggtcattacagtcacctgagtatgccttaccaatttctttcgtaaggaaatttgcagttgcaggtcataggttgaaatgcatgacagcattccatagattataagccttaccttccctttctcaaattgcaggtcataggttgaaatgcatgataacattcgacaggtaggcaaatcatgtatttgttacagcttgcttgaacatctgttcattccagagattataggcgcactgtgcacttgagtgagcatatggcatatgtacatttgaaggttggggagagaccatatcatatttttgtttgcttacaccaaggcaggatgtatgacaactagaactgaccctttagtttgatataggacctgactcgaatctcctttgatattttatttggtaagcaaaagggaaacccttttttgtaatagaagttgacaacacgttttgtaaacagacatgtacatgtactgaagtacggtcgtacaaaaaagaaacgctagtctcctctctcaagaaaagaaaaaaaaatccaggaaattgttcttgttgcctctttactgccaccgggggtgtctatatctccagatccaacacaatgtctggggaatgaattcaaggatgtaaaacatcagattctatatatgttagcctgcaagaaccgctacaatatactattctcattttctgtcagacgaacatgaacttacactctgaatctgttctgatccatttggtgccctcttgtttatccttctgtggcgtcggaaccgttggatcacctttcatcacagtatgtggcaacgccggtttttcaggatgcgtgttcttgtgcaacaatgaccatataatctgcgaaacatatcagcatgaaatcacaagaaccaatacgaatttccttctgatttctgaaaatcgaatgaacaaatatgctctttatattggagtagtcctactcctactacctcactgacagtcgcttcaggcatcgtctccctgcagctcggccggtgcaggaggccaccgagagcagcggccatgatcttcctgatcgatctctgcttcagcttggccaccacctctctgccattcgtggagctcgacgtgcggctcagtgacctgcgttgcctgccgccgccgccgccgccgtcgtcgtcctcgcctccggtcaccaccgcctgagctcgaaccagcagcctgagctcctcctgcagcctgtcgagctcgtcggcgcccgccgccgccgtcgtccacggcgtgccagaaccatgacggcccttcggtccccctaacgtgcctatggacagcatcgccgccgcccagccgtcgtcgagctcgtcgccgttccggtggagatcaccggaggtatgagcgcctgcaagagatcaaagattcagcaacaattacgtgactgaaactctgaaacgctgggaattctgaaaggagaaaaaaaaaaccatcgtcacttacgtcgagatgacactgcagtgtgatcttgtttcctcgtcccgtggagccttgtctgcacccagttcagagcctgaaaccgaagtagaaccagcagcagcaacgattgctgaattagcatttgtcattcgatgtaaaaaagttcagaagaaccagagaatcgagtgtgtaccctcatgagcagttctcgtgacctcttgtgtgcgagttcagaagaaaaatgtggatgaatggactcaatgggaagaagaagatggatgatgatccaagactccaagttcactatatataggggtaaactctgatcttgttgcaactttacagaagcatgcgtatgcaggattggagaatgaagaatttctctctgactactacagtgtcaaggtgattactgtcacatctcacaggaattatggcagaaatgcagagctcaaagatgaatggcagcttggtactccttaacattccaaatagggatctggcctagttgaggagagatgaacagatattccatgtgaccaaattactcaggagatttggttgatatcttatcttaggataggctcatggccactgccatgtccagcaaactaggatgcaattttatatatcttgagctgtacacattcccagttgagcttgattggaagcaggacccagtaccgatgaacaaaattcttgattgcagctgagatgaaaagggaaagtcagtactagagggggaaattgcaccgagagccgagaaaagaaacattaagatagatcgcagtatggtgcttccaagaagcattgccgtgtgacaaacttagccacataaattttcaagtgtttgttgccatatcatgtgtttgctgtgttctgaaattgacggtttcatactcaaatcaggaagcaagtaagcaggatagtgggagttcttgtgtacttttttcggcgatcagtgtggaaaatctaatatgttgtattctgatgttttctgatatattggatcgaccctctcatggggtatatataggagtacataggggatagagacttggagtctaggattctatctctaggactctatcttatctctaggatatatcttatctctatatttgtatttgactcttatctctaactaacatattatacttctaacattccccctcagtcgtaacgggagcaaagctaacgattgcgactggatttgaaatcttctatttcttcatctctttgagtcatcatcatcgattgcatctctgatggtcgttcctccacctggtgcctgcgtccccttctgtgtcgtcccttgactctcctctattccctcccgcagtcatagcgggagtgtcatggatgatagcgatgacacggacgcttttgactggagtttccatcaatgatttttgttgtagatgttcgtcgatgtagccgatcatgaagtagccgtggtcgtggtagttgatgtagccgcaaatagccgaaggcgaaaaaaaatatttacgccatggtgtgaagacaaaaactgcaattgttagcatcttgcatcttgtagatgtcagatgatgccgttggggacgtcttgcatatatcagaggatgtcgttggcgatgaggccaccactttggttggtccttctgcgccgtgtagcggtcatcacaatggtgatgctggattgatgcagtcgttgtcgtcgtagatgacgtgatcgatgccgtcgtcggtgtcgcggtcgttgccgtcgtagaggacgcggtcgatatcgttgatgaagcgtcttgcagattaatctgtcagagcatgcttcggcgagattgattttccatcgtacggcatgattgcttggaccgatctccttttcctccttttgttctttcttgatctgctagatgggattgattcatgcattgcttcctttttctcctgttcatactggcgtggcttccgctccttctcttctcccgaggattgtagatgtggcgccccagggaggatatggcgattatctcatctccccggggcggcgcgagcggaaggtagaaacggatcaagcaacgttggtctttggctctgataccatgtggaaaaatctaaactgttgtattttgttgttttctaatctattacatcgactctctcatggggtatatataggagtacataggggatagagactttggagtacaatacaagtaagagtagatttatctctaggattctatctctagtactctatcttatctctaggactctatctctaggatatatcttatctctatatttgtatttgactcttatctctaactaacatattatacttttaacattcccctaatctaatgataattaatggaaaacacatctaatgatctttggctaatctaatctgtagatgatacaggagaggctagctagcttgtgttgccccagggagagcttacagattcatctcgtctccctggggcagcgccgaaggatggatggattgtatcaaaggatcggttgacgctagtatatggctctgataccatgtagaaaatctaatatgttgtattctgatgttttctgatatattggatcgaccctctcatgggatatatataggagtacatagaggatagagacttggagtacaatacaagtaagagtagatttatctctaggattctatctctaggactctatcttatctctagaattttatctctaggatatatcttatctctatatttgtatttgactcttatatctaactaacatattatacttctaacaatcaggacttcaggagagtgagagatcgtacacgagtcatttcaactcggacaatttgcttggatcactctgccttgtgactcttgccatttctactataagtgtttgttttgatggtagtaaaaatgttcttcaaaaaaaaaagaagacaactatgacatagagaactgcagaatttgtttgagtatcactaaacagtacagcttagggtctccttttggaagaattttgcaggatttccgcggaaactagttcaatttttgagaaatcctccagcattgttccattccaaaggatgactagggctcttttggaacacaggattgtggaaacgcagtaagaggaaaagcatagcaataaagtgccatgcctattcaattcctacaggaattaaaaaccttgggaaattttaaaaattgccgtttggataacacaggaaaaaaatactagaactttatgtcacgggaagaaaaaaaacatgggacagaaatgcatgctactcttcctccagcacttctatggacttttggatttcaaaagagctcgaaatggcccgttccataagaattttaaaggaattgagaagaaccattcctttgttccaaagaaccatataggattttttttttgccatacaaatttaatcctcccaaatcatatcatatcaaatctttagttttcgtgacccactagcaacagtgttgcgattcatctcaggccagagaaatgctgctacagtactacagtccctcgccatgcatgcgccgtcagatgtccaactggtgattccatccagccgtccacatggtcatcgctcatccctccatcccctcagtccactcaatcaccacaccagccaccgcctagacatcctcgccgcctccttgccaaaaatccccaaatcctcgtcttctcggcgccgccgccgcgctgtcttcctcccaccatgccgcagcgctgtcttcctcctgcgatgctcggctggcgccgtcttcctcccgcggcgcccggctgtcaccgccgcgccatcttcctcccgcgacgcccgaccgtcaccgccgtcgccgccttttgcggattgattccttcggcccgtcgccgccggacctcggcgactgtggtggctacgaagcatggcgccaccaccgctatcctgatctacctctctgtccccttacccaggttctcaagttaattcgtgaatcatcctccctgattccttttctcatccccaaatcctcccctggttcgccgccctagccggcgccgctgcgttcttgcggagcgagggaaatcacggcgctggcttcgccgccctcgctggtgccgccaggttcttgtcgagcgagcgaaggaccagcgccgtgacagatctagccggcgctggctgctttctcacggagccatcgggcaagcgccacaaccgg

SEQ ID NO: 37947 - DNA, 17678 bp, Oryza sativa
  unsure (1)..(17678): unsure at all n locations
tccaattttcctgatttgattgataggtcttcatgcaggtcccatgatctcgtcagctgctcctgatgaattctcttaggtgcttccccttctttcttgctatcagtttcaatcttttatttgcttaggaggatttggatctcatgttcacaatttcatctagggacatccaagttgattcttctatagttatattgacaatattgcgcagtgaaccactgcaggatattaaaaacatcgttcattgactatgggctgccatccatacatttccaaccaccacacttttaggacagatggttgacaacttctcaaataaagaacagatagttaagcatggatgcctatcatgacctttcgtgcacaggttatttttttccttctacaaaatattttcaggagctactattcagttcttgtgtgggccatgaaaataggaaatcaccaaattgttattattattaaatttacatgcaatcttctctgtacattattttttatttagttgttcctcttctgcagaagtgcaatatcatccaagactgcctgttgcagaggatctgaattcgttgcaatggggttcctatatttctttcttactttcgtgctcaatgcccaatagttggtatgtcttttgcaagttactattgggtagtaacaggctgcatattactaaaccttggagtaaattttgcgagagtaaacttggccagtgatgaaatactaatgggacatgcaaaatataaagttatgccaccacaaggtttgctctaaattttgcctatgactttgtctttttgaatacttgctgtaattggacctacatgaaaaactcttaaccatagaattgttctacaaattctcatgtatagtgatatccttcttttctatgttgtcattctgcaaatttttcagctttcagcatgtttttggcatgagttgaccatcctgtggctttcagggcttgcagtaccactatggcaagcaaataacaacttggatgttgagcataggttgtaactgttgtagttgtaccgtatactttttatacctaaatacttagttgatttatttggatcttcgtgaaccaaaaatggcctctttttttttttgcacagttgttcaatggaattaatagcaatggctgatagatggggcttaagtaacctgttcttcattgatttggtcatcattcctaacttaattcattagtcctgaatccggcatcgccaacagtacctcccagcattgggtttgctatcttcaaccaaattctaccataaagcgtggcatgagccaggaccatctcagtgccggtgagcacccacatggtgatttctcagagtttgcaatgtactactatttgatttcttgatgtatggctgcagcaagttagtaaaacaagctataatttataatcaggtatttcaatccatgtacaagatggttatctccacttatttaatatttcttatattatgtgctaagttacattgagatatctggaaattactcggttatgttatttttttaaaaaaactacctacaaatctcaatattgaatatcgaatggttaataaaatgtcatgtcatgagatgtactgatttagcatgaagaaggaaacttatttgactcaaaagagctaggttgttggaggtaccaggctaccagctaatgctatatatgttaggattctataatgcatacatttttattgtcctcagcattcttatgcatggtaagcaggtccatgtgtttggatgggtcaaacaaatggtaccatgggtgtgggattcctatttcagttttttttttcaggttaatatgtcaactgggcaacaacattgaattaaaaagatacgtgcatcttcctcctttatgcagttgaaatgatgcattcttatagctaggttttgttaagaacacaaccatatgtgcagttcaaccaacttgcttccccatctctctatatcggagtgtacaactgtacatatctgtgtatagggattaattgtcactgttggtgtaatacagtttaaaaactaaaggtttgatctacaaaccttgtgcatcttaaattatttattttacttttgagcaaactgccttggtctctgcagctctatgaaagatgaagcataggaatttggcaagaatagcatatatcatgttcatgatctcttctagcacatacttataattatttctgaactatcgatatcttcatatttggaacctcaaattaactgtttgtcacatcatgccctcattgtagccaactgcatgtactgttccttttgcgccgaaacaagatgatagaagcacaatttgttagtaaactactaataccatccatcttatattctctttaaagctcaaaatgcatcggataactgttagtccagtgaaacatatctccattatctaacttattgttctatttctactggaccatatattccagcaacatttgacaaaattaatggcatatgtctttgttatgtggtgcttcagattcatatagcttgatatatagccttctggtaatttacataggcgctaatctttagttgtaaactagagcatatcatagtgttgacaccgttaacacttaacacatagataccaatctaagtgtaaaatattaatcttagaacatacgtagtagatactaaactttaggtgtaaattagcacttggcaaactggttttcccaaaggagcaatcaaagcggtgtgacatataaactgattagtaaccggtggtgtgacaagcaaagatgtttcagcaataataacatagctaaagcatgtataccttgcagtactttttgggcaaaagaagccagttctattactgaagtacactcttcgatttaactgttctattactgaggtactcttcgattttgtggttgactgtaacggtaatgctaatacttgacataattaggtagagctctgaggagctacatgagatgtcaatactttgctcttatgcccaccatttcacccgcggcaacgcgcgggtcccggctagtttctctagttttcctttgccttaaaggagccctagatcttgtttgggatggttcaaattactgccaattcccgaggatgtgcaaaatcctgaccgaactggcgttatgtagatttattggtgattttttgaggattaatcatctcaacttctcgagtcagcgaaggcctcccacatgattttagattttcaatgacaataactatatcttgattgaattttaaacataattagtaccatcaagtactgactccccttagtaaataaatatttagatttctaactccaccgttgttcttatgtgtggctttgactgtttgagctacagataatgagcccaaaaaaaaaactaataaaggagcaactctaaaaaaagtctttatattctgtgacagagtaataaacgaagcaaccaaatataattcatgaataaaacttttgtatttatattaccagcggctttaaagttaatataaaaaactcaaaaagtatcaactgtatttttttaaacaacccatacaagatagtatgatatttttatttatatagcagaaaaaaaatacaagacctgggaaactatatttatggaaaaaaatactacaccccacatatacgtctgatcctgctactgaaaacaaaataacatcccataggaaatgtaacaacataacaattatgcctgacaagcttgagacgctaattaacctacaccccccccctcctcaaacaaaaaccgaagcaaaggccagattatccactccaacgaagaaaaatatgtcaaatattaggccttgcttagttcctaaattttttttctcaaaaatatcatatcgaatatttggacaaatgcatggagtattaaatctttacctattataaaagtttaagatgtttttgtccagaaaatttcgtacgtcactcgcctgatttttctccctcgcgcgttccgtccaatttttttttcacacgtggtttttttctccggtttttttccgcccgatcttttttggtcgtgacttttagatccgttttttccatcgcctgttgcacacgttttttttcttttttttttcaatccgaatatcttagatccgtttttttcctttttttccatcgttgctttttttttgtcaatttggatatcttttctgccacggtttttctattgcgcatgtgtaaggcttccgagcttttatccacctggtttatttttttttgtcatctggcagaaccctagcatagtcccacatcaatctgccccaccacgtcaatatgcctttttccccttctgccttatcatttttgccatgattttcagttccaagtaggctttaattcgtcagatttagtctccatttaacaattactgatgatggctggccaacgagttttccaagctgttttaaaaccctcaatcaattctgatggctccagaatgtggagtacaggccatcttacgaaggttaaagatcacatttgattgtgtgagccaagtttgggaggtcgacaaagactcggctgtatttgatgggtaggatgccttcggcatctataggcatgataccgtctttcggaggttgaagattgcatttgattgtgcgagctgggtttacagctacacttataagctaggccaaagagaggctggccgagcggaaagagacaacaaccagagctaaaactgaaaaggaagaaagggatggattttcggcccagaaccaacgaagaagtataatgcacagtgataaaaacgtctttaattacccgttgcaacgcacgggcattttttttctagtatagataaaatgaaaaactaattgcacggttaagggggaaatcgcgagacgaatcttttgagcctaattagtccatgattagccataagtgctaccgtaacccacctgtgctaatgatggattaattaggctcaaaagattcgtctcgtggtttccaggcaagttatgaaattagttttttttattcgtgttcgaaaataccttccaacatccggtcaaacatccgacgttttcgcaaactacacaggctattaggagattgacttcgcatgatctgacggctatgaagcgaccagcactgcgatgcggccacaaccccccgtcccactcccatagcccgagtcggaccctcgagtccggctcgaccgaaactgcagcgagactccgacccggaccccctccactcttcttcttgcgcaataagaagaagccgccgtcgcgtgcgtctattttctatttttggtttattttgcctccccaaccaagcacaaacacaagcctcgccgtattctctcggagcaaagcgaacgcgaaaccccacccgcggcggcgagaaatccggcgacgatgagccgcggcacgggcgccggctacgaccgccacatcaccatcttctccccggagggccgcctctaccaagtcggtgcgtggtctccccccttactaaaaccctagcctcgcccgccctcgtttttccccgctcgaggttagatctgctttttttgtgatgttgggaggctgatctgatctggtttgatctggtgttttggtgttgtgcagagtacgcgttcaaggcggtgaagtcggcgggggtgacgtcgatcggcgtccgcggcaaggactccgtctgcgtcgtcacacagaagaaagtgccggtgagttctcttcgcttcgatctaaaaagatcgcggctttatgctgtttatacggcgattagagaccaggagaggagactgatttgtcttgctccttgtgatgtgattctgattttgcaggacaagttgctggaccatacgagcgtcacgcacttgttcccgatcaccaagtacatcggtctgctcgccactggcctcacaggtttgtttgctctgcagctttgcttcactgtatataactagtgttatgtttttgtgcgtgttgatgatgaagaaaaagttgttttttttttgtgtgtgtcttaggtttaagattaagttattccagatatcaattttgagatagatgctgtggaaatagaccacccacagtgattttgccggttaattttgcgatgatgctagagctttatatagggcatggttctcctggttgttttgggttgtacatgaggcactggatggtatatcagtatgtttagctctgtttgttttaactcttagggcaatggtagaaagcactgccctttttcttttggggactgcgaaaacaccacaaaatttggatcaaatgcaagcataccatattaattaagctctttcatatttgccatcagtttccttatgaaggctcttgctttctagtagtatatatgttgtagcattaggttccacataatttgttctgctagtgataatttggcattgagaccatattttcttattttgtttttcctgaataccttcattcttcattgatcataaactttgttttcctttttctgtttttcagctgatgcaaggtccttagtctaccaagcaaggaatgaggcagctgaattccgtttcaaatggggctacgagatgcccgtagacgtattagcaaaatggtatcatgtctcatccttaagttctctatttgtgaaaatagggttgtggttgaatatatgatctttgcatttcttataacaaagtgatagctaacttttctggtttatgtttcaggatagcagacaaagcacaagtctacacgcagcatgcctacatgaggccccttggagtaggttcgtatcatcaagtgacctattgttccattggcttctgttctatagttaatgttaaaccaatcagcttggatcttatttgccctccatattcattttcttttggtatattccacagttgctatggtcttgggctatgacgaagagaaaaacgctcaactattcaaatgtgacccggcaggtcacttctttggacataaggtatacacagtttctgtatgcttcattagagtgttaaactatatttcctttttcattctgtagttcacttatcagctgaacgaatgttgagccttctgtcttttgttggacgattagaaatttgtttcctttaacacctggtattctattctcaggcaactagcgccggtcttaaggagcaggaagcaataaattttctggagaagaaaatgaaggatgacccacagttctcctacgaggaaactgtccaggtaaacattgcgaggtctttttccagtcatttacttttgttcttactggattattatttgctaattttgtcctatgatcccagattgcaatttctgcattgcaatcagttcttcaggaagatttcaaggccaccgagattgaggtatgctgttgtttatacgcaagtcttttctgaaagtttttttagttctgcttcgctgtgcttatcagataaactatcgtttggcaggtcggtgttgtgaggaaagatgatcgtgttttcagagcactcacgacagaggagatcgatcagcacctaacagccataagtgagcgcgactgagctacaatgaagttggacatgttactgcttcacactgcactctagtctttcagcagtgtcattttatttcatgttcagccaagaaacattcagtgaaccatttcatgtaactccaaaaaacagtcatcagctttacttgttggatcatcctctatcgttgtggttgaatttactacgatttacttgtatgctgcttgcatttgttgcgaccttgagctattcgccattttgccctttctcatctttgctaaagttgctagcaacaaaaaagaaatgcacgaaccggttgaacagtgctatacgcactaaaaagaaaaatcttgcaaagaaagttgtcaaccattttgattttaaacgaagattcaatcatggtgtgtcgcgtcatgtattactttcgcaaatctgcacgcaaatcagctgattccagtccaaatagcatcctgcatcgcatgcgtgttagattggaacgagcagctagggacgccacattgaaagaacatatcgcctaattccgcaaattttacaacgttttttgctgacaaaaaaaaaagccttgctatacgaatattacaacagctatttcaaatttctattctgctagtactactcatctctgccatatacagtagtacaggggtcaattcttttttgttcctcctcttttttttcttcttctttcaaaggtgtacacaaacatgatgagcctaccatcctgttacttcactgtaacaggacacggaaaaggcccggctgtgcctgcgtatactgaatgccgtgctccaggaggtactgctcgacggcggcggtcagcctcgccggagtacgtgtgcttgatattatgatcacctggagacgacggcctgtggatcgagcaatcttccgccggttgttgagctcatagttcagggcgtgtatcgcctcgcttacgtgaagaccacacaggtcaattggggtattttgctcctgaaccaggccttgaaattctggcatttgaaatctggtaaagccatggaatggattagaactttcatcatatggtaagaaacagaaagatagaatcttaaacagatagagcatgttgtaggaactactacaccgtattcagacaaggagtgcacgcttgcaaactcaagcaacttgctcggtatgcaaacctaccttagtagttcaaaaggaaataatatattacactagtagtgcaaaggcctggctagttattgttgaatcagaattaaaaacctcttagtagtaacctgaattcatgctacctgtacgacctgttatgacattatctaggtaattttcatgtcctagtgttattcgaaagtccaaatagtaatacaagttctcaacaaggcaaaaaatgcaagtgtatgcattgttttaaattctctcattgaaaaggattgacaaatgcaatcagaatcattttcatgagcaggtgtgttgatgtctcatgatacacattatatcaacatatactccctccatcccacaaaaaacaaacctaggactggatgtgacatatcctagtacaatgaatctgaactaagatatgtcatatccagtcctaggtttgtggaatggagggagtaagaatttatataaacgataattctattaataggtgatgatgtcaatgagattagcgtctaacctttggcgatatacatctctagccttttcctgagctagtctgctttgcaaattgtaaagctccttgatgtttagttcctttgctaaaggattggcaccagttaaaagaacctgcctatcctgtcaaaagtttgaatgcatagcagcggactgtgagcgaatacattaaaagaaccaagaaaaagtaagttgtttacataattcaaggtatcttcctgaggcataatatttgagtactataaacaacaattccaaaaccatatctaatattcatgtattgtcaataaaatccaatgaataatcttgtgccaccatcaccccccccccaaaaaaaaaaaaaagtcataccaaattggatttgaaaactagtcatataacatataagcctaccacatcaccaaaagaactcattctgtgaaatatttgatacagagcacttttttgtcacattgacaagatatgaagtagttttcttgctagtatttttatgttaccaaccatgtaactcaattacaactttttagggcttgatgattactaatattgtcgatacttacaaccttagtcccattaaaatagaataataatactgtcaatatttatttaacaacatgctcacatgcacaataatttggttttaaaatatgtaacaataatttagtatcgaaaagtagagcatatgcacctgttccagaagcgcatgccgtaggcttgcaaaatcatgagcttcatcctttgattccaaaaacatgtttgctgtcatcacagacaagttcaaccataaggtaaataggcatgtatgctgtgataggtccatgaaaaaacatgcattataattcaacactacctgcagtatcagcttcaagccaagcaggtcctgtttgaactccagctatattttgcagggtgttgtttgagactatgtcatgattgccattgaatgagcttgccatgaactgagagcctctgcttgaaccaagaccagaaacaggcaaattagttgtattgtacctccccctaggagcatccagagaaatatgttcccgaccagctgaaggggaaagtatatcatctgcgagtacagctgagtgggatctatatgtattgtttgccagaccaaaagcttctttgttatagtttgcaagaccattttgaccatatgatgctggtgatggaggacttgaatgtccaaacgacagtgacctcagattctgattgaatcgtccatcaactttattctgctaatgaacatatgataatattaaataaatgcttgaagcagacatcatgcatgtaatcatatcttagtcattcccatcaagcatggccaaatggaagaaaatcgtcaacagacatggccgcgacatggtatttccaagcaaatatttcttgaacttatagtaaaaaagtaggggagtttcgctaagagactaatctgatccagaatgaatgagactgattaagtctcggacactatgttgatgattcaaccacttctatgtggtatctaaaacagagaaccaacagtggcattgttgttatatcagtttctataatgaatgggctcaagaaataatcctcgctcatcatagtcatctacatatagaatcccacctagtttctagactatagtcgtattcaaagttgaatgcaagtgataattttgagaacataatgccatttcagggctgttcacttcaatctcaaaatcaaccttaccaaattggttgagatgtgtaaaagttgtatttggtttgctacctttgccaagtttttgtgaggaagattctagaattaccaactttggtagttgaggcaatttatgtcaatgttgaattgttaccttgctttgccaaaatttggtagggttaattttggcaagaaagtaaacagccccagtagaatcataattagcatggacagtttaagctgtccaacaacaatataatgttctaaatcagttgcctgagtgacttttatgagaagaaataattaataggttgtagattaggagaatcagtgggttcaaatagttttcagtcactagaagtccaccaagcttttccttatattaacatcagattgactcaaacaaatatacttcaaagtcacaaatttcaaatatctatttcattcattaagtctcggacaaacacatgaggtcattacagagtgccaccagtttaaaaatcaaactgaacatatgttcctgattataaagagtaaaaaaacaataatacagcccagatgccaaaaatgacatggaatattcagtattgaacgtgcaaacttcagttgattgaagaaaaacatatcggtggatcattaaatggggtctcattatttatagatcagtatcatactacaatgttaataatctggaactaaaaagtgttataatgctgtatacttgtatgaattgggtgacaggaagcaagatccactcaatagtctagcattcattcaatcaaggactattgccaaatgttcaaagtattgttttgtcagacatctttgctcaggttacaacttgtctggagttgatgtaaaaccatatagtgaaagtagtttgatggtttttttttaaaaaaaaaacaaaagaactatgaagcattttgcttgttatgaaattttctgtaatatatgatgagcatgccagttatgattcatatgtagttcaactgtccaagccccaaggcacagttggagagagaaaaaattggtagatttaaaattgagatgaatatcagaagaaaaacagacctccagctgactcatgatatccatagttgagctaaagctgcgcctgcttccgaagtatgcatcagtaaggttttgcactggagctcctgaaaattctaaaggttagggttcatactactaccttcagtgaataaaattacacccatgaaatcaacactataccaatgctagaatctccattgtaatggctggcatcccttctgtttgcattgtattgcacaccatttcttactgtttttacccacggagccgcagttggactcatagcgcttgcagttggactcataatagtagctcttgactgttcttctacataagttgggctaggaaactcgatctttgatcgtgtgctcagagtgtccctaataaaaggagaagcacggtgttgcaaattcgatgtctggtttggagaaaatagtgaagcaccaatgctatcatttattgacaagccagtgagtgaaatattatcaggtccaggcatctcatcttgtcccagaactttgaaatcaggggtaatatcatctggaagctgttcttgccagtaccgatgtgcttcttcatcagggttacttggtataacaggatcttgttgatctgcaatagtgtctttggaggatcctgatacagaaatcctggatgtgtctgatctatttgaaacatcattgatagatctgagggatgaaggtacaaattcttgtgcatttggatttaacgcagtggtcttgtttatcaaacttaatgttctctcttcgatggacatactgatgataagcagatgaaagtcttgctggagatattcttcctattcctatcatatagaattgtgcaaggcagtcttagattcctagaaacagctgatggttttgctagaaacaaagattcaaagaaacctaacaactacatttatgtggaactcaacttatccccaatgatattgaagaaaaaacaggaccataacatttttaagtctggtttggcatagaacctgttgaattatccaactagatgaatggtggattgcattcggtgcaaaatatatgctctaaagttcttattacatagttcaagttgataaatggtgaatacatcagacaaattggaaatcccatatggtatggaagaatcaagatattgaacatttatatatggccatgaagactgcacgtgattatcagaatcatactatcagtctattgcaagttaaagaaaatatccatcctataagctgcaagtcaaacataccaaaagagaatgcaagaaagagaattggacatgtaaaagtaagccccaagtcacacagaaataaactctttcccatttttctgccagctaaaaatggagacggaaacctgcaaattaatcttagaagttcacatcagaacacaaataagttgacacaccaggattgcacttgagaagacgcaaaaacaaatcagttgcctacagacagaaactacagtcgccaagctggccatctctgatcatcccttgtcggtcaagatgcattcaagacgaaataaactgaatgtctgtccatttgatacttttgaatgcaaaaagtaccagagcaaaaagcattgtcttatgggagatccaactatgggcaaaagctactaattgtagcattgtttcttttagatgataagccagatggccctgcttttctgaaagcaggttttaaagagtcacactggggtttccagcttacatttcagcccaaaaacatagatcacgacaactaattgtagcattgttacatggggtatccgataaatggaaaaatactggtgactttaagcatggcatagctaaaagtatgtactttcctttatcatggaacaatctttgagaaagaaaaagagtgcccattataagttcatcatcgttgcaagagaaccacattactgtcatcactgtcaacagacgatgactcaagcaaaatagctaaaaactgttgtaatcaacagaactgacagaagaatagccaaaaaaaaaacagtaaccttaattgctatccaacgcggagatgaccccatcaaactattatccaccaacgcatgcatccagagacatctactactaagctaaaaaagacacaaggcattagttttcacactcaagccacatccgaacgatattgatcgagcttgtacagtccttccatgaagaagtcaatcgaacgtaacagtaacactaagcagtaagaacataaattactgaattggggagacctcgttagtccaaaaatggtgaccactcacacgccccgaatctaaccaccaaaataccagtttgatccaacgaaaaaccacctagagcgatgcgtaagcagcatttggcaacttggagcccaacgaaatcaaccgcaaaaactagctaaattcagcaactcttatcaaaatcaatccacaaaaacccccatgcgcgcagaccaagcgcaccaaagcccaattcaatgcatcgacaaatcatctacagcgatctagaaccatcggcgccctcacctcccgcgagatcgacgaaccgataaatccagaggactcccaacccactcgcacacgtacgacacgcccttctagaagctcccactccccccgaccgccacctaccactccggcggcgcaccaccacgcatcagccccctcaagtgtataattctacctggaccgcgcgattccagaagcttctagaaggatcggagatctcacctgcgccttcttcctcctcctcctcctcctctcctctcgcccaaagttttttttctcttctctccttttctgcggcgattttttttagctcgctctctctatcacttcttgttcgctgtgttgactcgtagccttatattattcgtggacgcgataggatcccacgggcgcctcccggccgtccgatcggcccctgcgcgcgcatccggccgtcggtcgccccggctaaagcgtactacctctggagccaaaccgaaccccgcggcggctgacatgtggggcccgcacgtgaaatggcgactcctgtggcgtgtttgtttgtcccgtgagggaagccgtgggccccacctgtctatgcgctggggcccgcgcgggggcgctgtaccggcctgtacgtgagccgtgcgactgatccgtggggccccacgtgtagtgggacccacatgtcatggtaggtgttgtacttttgtgattttttttttttgtgttcgggttagcatcgtgcgcgctgttcgagggtgcgaggtggaggagcgaatactttgtggcgaatgattctttggttgcatgggattttgtggtcctcggtgcgtctctctaggtgaggacaaacaaacagccaaactgtttttttttttaattatttccttctcctttcagatgcgatttcttatcagaaaagtacagaacaacctatacgctctttggttacacttgcatttgcagatttgctgcagcatcatggtcaatcagcacgcaaatttacgacaagtatgtgtagaatttacagaacaatttggcgacagaacaacctagtattgttttgttgaggtccatctgaactccgaaggtttaccatttctgaggctctgatgaactctgaattctgaaccaggggtttggcaacaatcagaggctgagaaccacctgtatgagcttgccaacatctgtgtggcaactggcaactcagatttctattggctggccttctgttcatgcctgtcttaataaagggtaggcataagagcacccgcaatggtaaagtaaggtgctctctataaaacatgtatatctcagcaataaactagattaatagtaaaccatctcaatagtatgtctacatgggtatctatagctctctaattcattgcctcgtttttctctatagactatctccaggttagtagatagttttgttctctctcttcatttaatctcttccaaataagaaaatatactgacatagatctcttgtagagagcttatagataatcattgtggatgcactaagatattgctggcgcatctattcttcattggatcacattattttgttctagaaccattcaattcaggaggggatgcgaaaactcggtaaaaatcgagattgtggatcaagttgtttttgttgatgtaaatgtcctgaagccaggaaaaaagagacagagctttcctgaacagaaagtgtccccgtccgaaaagagatggttcagacttcagaaacttcagagaattaccagtaaattgtttctgaccggtagagtcaccggaaattgttagcaaccaattctggacaaacacaatcgaattggcaaattggaaatttgccgctagtacagaagcagttaaactgactttgcagctcttagtacttcggacacctcacacacgcacaaaaagcgaccatagcgcggttcacattacctggcgaatttcgattggacgcgccgtaatctgcagttttttagcgtggcaaaggcatccaaaagctagtagagtactccacttcagaaagcatcacgagcacgatacggtgttcagatcatgccgtaaagctttggtatgtcatattattattatatagagcgtcgttttgatgtgtatggagtgtttggacaataattaaaaaactaattacagaatccgtcagtaaacagcgggatgaattattaaacctaattaatccgttattagaaaatgtttactgtggcatcacattgtcaaatcatagagcaattaagcttaaaagattcgtctagcaaattagtcgtaatctgtgtaattaattattttttaatctatatttaatatttcacgaagttattcaaacgttcgatgtggcagggtaaaaaattttgggttgggaccgcataatgagagcagtaagcgagctgtccaaaagagcaagtttaagcaaaagctgtccaagctgtgcatgactctgtactggagtaccctgttcgcattgctggcatcagttgccagcttgtatgattgtatcccctgacatggcaccacacgcagtaaaatccagaacgcataatttcgatatcatatgacgaatgataatgctgcaaattggtgatagtacaacagttataaacagttcgaaacaacatagtactccagtactcttacaacagtaatactgctgttcgtaacatccttgcagctgcagcccacaattttgagcccttttccagctagcaagtagtacgagtagtagctcacttaaacccgtggaattagcggttgttttaaaaccacaaaccgatctgcttagctaaacacaatcacaaagctcgcaagatcaagatcgtgccatcactacaacgtcgacgtcactggcagctcactgggcgagtcactgagtcactgccagctcagcaaaagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37948 - DNA, 673 bp, Oryza sativa
tggtgctgtatgcggcgataagctcgtccagaccttagaccttgtggtggacccagacgcccgtgtacgatcccatgactcctgatacacatatcctgggctacggaatgttcttttcgcatgaaaacagcgaccacacagaacacttattagagcgcatacaaaaattaataccacctatatcaaataactaattcactggagtaactactcgctccatttcatattatatcgcaatggaggtttatcttagagtcaaactttctcaagtctgaccaagctgaacaagaaaaagtggcaacatccacaaaatctctgtcaataaaagcatgaactccgtactacagtatgatctcttatgagtctctaaaaattatccaaacatactctcttaccgagcactacagttcacgaaccacacttgcacgttggccggctgaacagcttcttcaaaacccttgcggaagtcttatatgacaccataaacaaaaatattcccttcttacagcacacagggaactatgtgtaaataaagctgtcaaatagccgatgacacatagtagcgatgtacttatctgaatattgaatccatcaccaactggaaggctaaaaaactgagttcagacataccgattactgttaaaacacatcttgcttgacctttcataacttc

SEQ ID NO: 37949 - DNA, 668 bp, Oryza sativa
ctattgactgagagcgattgcccaaaactgtaggcgggccatgtgattttgaacgatgcgtgcgactgactaagctcaatgcaagatggtgaaaactgacctgatcactgaatacatcttgtcgaggaatcttgtaacaaaagtgccaaatcagtatgataaacgggagggcaggtttaacttgcagtgtcagggcaccggatatgtttaatatggctgtcaactgcactgatgactagagggtacaattcataagttgatcgtccacacaattagagaacagcgtggtgctatcaagcagtgagtaccatttcatggatgtgaatcgatggattctctctcaataatatatgcgggtcagtttctgctcatttacccaaagcagaacataggtcaaatttcaacataagacgcaacagagggtcgaaaggtggtggaaactcagcctgtatgatgtgcactaagtggaaggatagatgaataaaatccaaaagtacaatgaaactgctaaaagaataatacctccatttgcaacaatgtccacttccataccagcctgtcaagaaaaataaagaatgactaattaactaatacatagagacatatgcacatagagttggttcttcccaacacatagcatgtcccaatatcacaatttttttgccact

SEQ ID NO: 37950 - DNA, 700 bp, Oryza sativa
tgcttccccacccgtgtgatggatccgatcgccgtcccaggggagggggatacagagtgggacgccgtacgacgggacgattcctccggctgcgtccgacgggcgacggttcgtcttcttgctcctcgccgaggagtccaaccaccgcgactctcgtccttgtttggcaggccagaattccggcccattcattgtaagtggctgggattttaactaaaggaaatcccgtcctatatatgcacgtgcacgagctgggatttaggcccattcagaaatggcctgtgctgtatttttactgttttagtccacatggatggtctggcgtcctgggtatatcatcagagctttgtcgcattctttgcactgtcactccttgacgtacacaccttccttccatggcaagtacttgggatttgggtactggtgagcgtgggcagcagtgtgactttcggtcaacgggttgcacagcagatagctatgcagaatctcatgtcatcgtggttatgtgacgccatgtgatccccagagtttttatccgcttattgactgtgtcggcaacctctagcagtacatgcggcagccacttctctggccagttactctccgcctcaagccgaggacggtggcctcagcctccctcggggaccgatgcgcatccgagcgatggcaggtcatcgtacgacaaacgggctgcaggaat

SEQ ID NO: 37951 - DNA, 616 bp, Oryza sativa
ttttctgtttgctaagtagaggagatgtcttctgattctgccatcagtatgaagtatgaattcaaattaactagagcatgatgaagcagcatttgaagtacagcattttatttaatgcaaaattaaatactccctccattccaaaattccaaaatataaggcataaccacccttaacccaaagaccaagaaacaattacgatcacctcctagtttggatcaccgtaacaaatgcaatgcatgcacccaatagaattagagatcttgagtgtggaggatttaaatataataattgaatagagaggaggtgctatttaattgcatgcatgcatgcacacctcatattatgaaatatctgaaaaaagtagttgtgccttatattatgaaatggagggagtataaccaactgatttggtttaatttttcaaagacctctgggttcaggtaaaggagtttctataacacactttgatgaattgcaggtatggtttagcaatgtacctcacacgcggttggttgatgacaaaggagggcagaattggattagtaaagctaaggataaatttagatttcctggaggaggaactcagtttatccatggagcacatcaatacctg

SEQ ID NO: 37952 - DNA, 654 bp, Oryza sativa
tggatatagattgggagacatctgcatttcatattttagcttaagggctcatatcagcactcttgcaccagttatatgttaacaacttaacactttgttttttcttccccttaatgaaatgatacgctgttcttctatgtttttgagaaaaaaaaacttaacactcattagataactgacagattttatgctcatatgtgtatttctgtagtcaattcctatgtttgtccactccactagaaatagtgatactcccactagaactgctttttcaaatgattcatgtttgatatgcagttttgcagttacattcaatgagaaagtcacaaggacagtcagacaattttcaccacatttagcagcaaagatgaggccacccttaaggtggggatcctctccccctatttcttctataacattcttctttttttaaagagtctcagaagaacgggctaacaacattgctgatatttgcagacctgtcattcgtggccgaccaagctcaaaaagatcaattcatatttgtggccggcctcgatgggtttttgttgtattattttctgtcgggtagtataaagcactgacctccatacatactattctagaccatagttttttttttataaaaaaaacaactaaataaataatgaactc

SEQ ID NO: 37953 - DNA, 1121 bp, Oryza sativa
cctctcatcgcgctatctctctctctcggtaaacccctggcctcggttagtatctgaagtggatttctcgcttggtctactggcggggttcgctcgatactcctcctcgagttagggtttggcgaatacgaccaaccccgcggatcgcggttggatggcgactagagcggccgcgctgctctgagaatgcaatgtacctttcaagggttcggtattttagttccttgcttgataattgctactactgcgacaatctcgcggttcgtttgcgaagaaatataaagagggtgccttgctgtggctgtgcacttctctctccttctttgttttcacccgaaagttgtgattttggtgtggggttttgatgtagagaaattgatgagtaccacgggtattgccagccaaatattaattgcggaatgtggggaatggggaaagggtgttgccttcgacgtggattcgcctgctgcgacacataagcatgcatatattcgtagagtggagcggaattctgctagcattctgtagttacccagttacgttaactactgtagtgctaatgttagagttaaatgatttatatgatgaagtgatgaagtatacttttggcctgccgacttcgtctggggtttaatttacacaaaacttcaataccttgtaaactacacacccaaatatcatgcatgcaaatcacatcctaggggtggtattgcgggtgttttggttgatgtggcatgcaggtgaacgtgggggcatgatgatttagggaaagaaaattatgtgggcctttttctctttcctagatggggtgtggtatgggtgggagtactgccatgtgttaaagaaattgatgatgtggtagccacatgacccaatggccaacacctctagtaacctctttgggtgtattctgcgctggaaactggtggagggatgaaaatatattaaattgcagggtgtacattaaactagagcaaagttaagaaacaattgtagggtgtacgtaggtcgttgcactgttggtttggacttatggagcaaatattttacaatttacattagaaaaccaggacaaccattattcttgtaactgtaatgggtttgaatgcggttatatctgg

SEQ ID NO: 37954 - DNA, 672 bp, Oryza sativa
ctctataaagtcccacccaattctcgattcccaatccagcgcagcacaaagccctcctccttccaccgcagctgcgctacctacctccaagagggctggtccgctggtcgtggagaaggaagagagatcttccaggctgatccctcctattggtacggaagccctaaactcatcggagctttgccgcggccgcgagcgatcaaatcgaaatctttctttctttgttctttgatgctccaacctagtgtcggatttgattttgactgttgcaatggcagctttctccttcccgagcccgcttgaggatccccgccggagtagggattagggaggggagaacaggaggcggcgattcaccatgaaggcgctcattcttgttggaggcttcggcactcgccttcggcctttgacgctcagtttcccaaagcctcttgttgatttcgcgaacaagcccatgattctgcatcaggtaataagtggtttcgctagtactctgatggagtaataagagtacttatttgcagtgccaatggatgaattgggcacaagttaattatagtacagtattctttaccaacagtccaacaatggcactggcctctccatgaaaggagggagagggtgctaaactggtcagagaacattaatactatttgatttgtttattactcc

SEQ ID NO: 37955 - DNA, 634 bp, Oryza sativa
tgcaagcaccaagaagtgagccccacacttgaggactcggcctaatgtgcattccctgtatgagctcaacggcttcgtccaaatgcccggcacgaccaaggagatctaccatgcaggcatagtgctctgcacgaggggtgacattataatccaccatcgactcaaacagcctcttcccctcatccacgagtccagcatggctacaagccccaaggacactgataaatgtgatgatattgggtgaaacgcccatttgggtcatgtcttcaaacacctgaaccgcttcatggccaaatccatgcatcccatatccagatatgagtgtattccatgacacaacatccttccggtgtcctattaaatcaaagatatgccgcccagcttcaagacatccacatttcatgtacatcgccatcaatgcgttcagaactgaaacaagtgagtcaaaacccctccggaggatatacgcatgcaacaatttgccctgcccgagagcgttaactccagcaaaagcatgcaagatgcatactattgtgactgaattgggtacaaggtcttcatcagaagccaccatctcctggaatagcaaaatggcatcacctcgtctctcgttcttggcatagcacccaatcat

SEQ ID NO: 37956 - DNA, 553 bp, Oryza sativa
taatcatatgttaatgaggtttctcgttttaggtgtattaaaaatatgccttcaaaattgacgatcgatcgcagcgagtcgtgcttctatgcttctaaagaaaagaacgcacgaaaattgaagtgcataaatggctcggattaaaagttactccagtttacatgacaaacatcattagagaggggcattttcgtccatggaaaattttttcgcgaacacaaatgagaccaatctagaaaggactagattgattttgaattaagaagggggtgaggctcaaacccggaccggctagctcgcagcttgtgttgctagtcgggaagaccccggacctttctccatgggaaaattcagtccatctccagccatgcccgtcctggcgccgggagctcgcgctgctcgaggcgacgcgagcggcggtgggagctcgaggcgaggcgaggcggcagtggcggcgaaggaggaggcgagcgcggcgggcgacgccatgcgcgacaaccagccccagcccgcggccgcgcccgcgatgaagcggaggaacagatgggaccaa

SEQ ID NO: 37957 - DNA, 1367 bp, Oryza sativa
ttgctagattctgtactttccatcgtcaaagtcttgctttggaaccattggcatcaatctatacaactatctctacatgctgcagaataagcctcctgacagtcgatgcacattgataaactgttacattatccagcaaaatttctgcgagcttttatggattagccctgagacatccaatcataatcatcatgtgctagactgtagtccattgcacgagaacttccttttatcattcattgggtctgtaggaagatattcctttagtcctgccacgcaaccacaataaataaattaatatagaattatgttgttcatatcagttcaccttctttccttgaattatggtggatttttttttcatcctaaggtttcttctgggatcattacatatacctatatggttaatgactttgataaccttgacaatattattcagacaaatttgcaatagtaacataatatattgaacttgaataagtcttttctccacataaatgggaggatacctatggttaacctttgacttaataggtcccttgttaaaatagtttcaccatgttgtcacactaataataaaaaattctgatcaccattacgtttatgcagattcattggccattcagagtcaagaagggctcaggcattagtaacactgaagactacataccacctgacatcccatctacctggggagcaatggagaagctatatgattctggtaaatctcgtgccattggtgtaagtaacttctcatcaaaaaaactgggtgacctgcttgctgtagcctgtgtacctccagctgttgatcaggtagaatgccatcctggttggcagcaaacgaagctacataacttctgccagtcaactggcgttcatctttctgtaagtctgtggtacttatataattactctgagtcaatgctcttgttaatgagtcccgtggtttttaattttctgaatactgctaatccttttcttcctcttctttttaggcatactcgcctctaggttcacctggttcaacatggatgaacagtaacgtccttaaggaatccgtcatcatctcaattgcagagaagctcggcaaaactcctgcacaagtggcactgcactggaacattcagatgggtcacagtgtactcccaaaaagtgtgaccgaagaaaggataaagcagaacatagatgtttatgactggtctattccagaggacttgcttgttaagttctctgagattaagcaggttagttcaacatcctttgatcacctatatttaattgtcaatgttttcaaacatctctacagactttttcttaacaaccagtgtctgcatatgatttggacaaacttacagggctgcaggaat

SEQ ID NO: 37958 - DNA, 669 bp, Oryza sativa
ttgggagcttgtgaagaaagagggatatattgctatgtggaggaaaccattaaataactcatgctacatgaaccgtgaccctggggtcaaacctgcactttgtgatcctgatgataatccagatgatgtctggtatgtttcgacctcattttgtcctgtttttattgatgaaacctcaatgtaccattctaaatctatgtctttctggctgcaatcgtattggataaaattttaacagtcacatgtgctattggaccataaaaatacatcaccattcactacagtttgtctatataatattttaatatcattgatttatgatgggctagatggcaataatgttttctttttgcatcatcattggttagatctgttaaaccattcaccattaaaacctcataaatgcaaagcatattatcaacaaaatctgtgataatggctattcatttttctggttatgtagattatactacatcattcagaggccttagctactgtttgattggactgttgtactgctgttatgttttatttggcatgaatcttttttgtgctattctttatgttctatttctctttcaggtatgtcaatctgaaagcatgtatcagccggcttcctgaaaacggtgatgggctgactccctttccatggcctgcacgtttaatgga

SEQ ID NO: 37959 - DNA, 675 bp, Oryza sativa
cttaaggtacccatcccctgcgcgcccatacgcaggtgagtttcggatccgggtgccaaatcaaaattcttgagacgacgagagaagaaggtaaaactagatcagctcaccgatggctcgagacatggcgaggacgccgagcacccgggcgccgtcccagtaaatgacgcggccgcccgccgcctcgattcgttccagctcgtcgggccgatcgggctgaaccgttccgaggtagcaagtagcaaccatgtcaggcacacgctcatggacaagaaactaacgattttttgcagatggacgggaaaggctcagccggccctgtgatgcgagcatatacgtactttgtggtcaacggatagtgcgacggggacgccggcacgggagatgacggcgcgggagtcgccggcgttggcgacgacgacctgtgttgggctaacgacggcgacgacggcggtggaacccgcgtggtcgcgacgcgaaggcgtctgctgctcgcacgggcaggcgggctcgtcgtcgctgcgggtggacgcccggttaccgacctccccatccatccgcgcgaagctcttctccatcacatccctccaaggcgccacttcgccggaggcccccttgttgtgctcctcggcgacaatctcgtgcatcctgtcctggcacgtcgtcgcaacctaa

SEQ ID NO: 37960 - DNA, 887 bp, Oryza sativa
cagaataaaaaataaaataatattcaaaattagaaaaactaaaagagagttcaagtaggaatacaattttgaaacaactgaaattgaaaataaaaaataaaatactaaaataacacaatacgatattaattaaaatttgaaaaaaaataaattctgaaattagaaaaagaaaaataagatttcaattaggaatacaatttataaataactaaaatttgtgataaaaataaagactatttaaagaaagaccatctaaaacacatgacgagataaattaagtaagaggcctataaaggagtagagtggtggcggttgatacgacatataaaaactgttaataaaacaccaaatagaatcctaataacgattaaaaggagggacgataggcaggccgtgaagcaaacgagcaatgtgattgccgggactactagaaagtaaaaaaaaaaccccattgataatcatattcaatttttaaaatctcaatgacaataaaaagaagcagtgggcggggtgtatagtagtatagttttagagccggtgatgtttgacgtgacttctagaaaataaaaaatgaattgcaacgatagttgtgcttaatttttagaatcacaatgataataaagaaagagtaggcggcggacgggccataaaggagcatagtggcattgtttgacgagacttctaaaaattataaaaaataaaacccaacaagacaataaactctaaaaactacaaggttcaatttttaaaggttccgaacttcgaaaaggtaaaaaaaaacaatgataatcatgttcgattttaaaatctcaatgacaataaagaagggactcagcgggcgagccgtagagaagtacaatggaaaagccgctgatggtttggcggga

SEQ ID NO: 37961 - DNA, 680 bp, Oryza sativa
gccgatccctcctctccccatctcctcctcctcttcctccgcgagcttggggtgggattggattggattggatttgcagggagggagaaggaatgcggcaacaagtggcgtggaacttagaccagaaacgcgagagatacggggaggggcggaggcttacacaccgccagggtgcgacggctttaaaagggggagaggaagggaggtggtggtggtggtggggatgggtggtggtagcccgtagccgcgtcccgtcccgtcgcgcgggcgtcggattacgtgtgtggcgagatcccgcccgccgccgcgatcgtctgcggcgagcggaccccgtgatggcccgtaaccatcgccgaaccgccaacgggcgctttccacatgggctcccggatctgtggaatcagcggtttgctcccaaaaatatcgccatcttctgtgttgcggtctctccctctctctagtcagcccagctcacgcaggcccagccacagtaaccacttattttaattgtggataaactgtgaactgaaatactgaccaaattcctaaaaactagtacatcactgtttcgaaataagattatttttattcgctcctgtttattctaaaataagtttatttttaaacaatcgttgtattagagtttataaaagcatggggcaaagcatgggctgcaggaa

SEQ ID NO: 37962 - DNA, 274 bp, Oryza sativa
tgtacccatgtaacatcttgtttttcctttttggtccattatatttcgttgttgaactgcaggatttcagtatgactgaacatataaattatgatgtggtggagcagtgtgttaaaaacatcctctctctaatcaaaccagtggaggatgacagacgcaaacgactatctgcaattcaggagttatcaaattccattcctaaagttgcagccttaagaggtgagttatctcatatttgataatttttaagtttgtaacaatgtaatttttgata

SEQ ID NO: 37963 - DNA, 515 bp, Oryza sativa
aaacataattaaacaaatgagctaatccctcctttttgtggggctacttaattactttgctccattaaactatattttatccccattaaaataatgctactgtcactgaaagcatatttaagatttagatgccatgcacatttttcattcgttactttttgtaactcatgagatacgagctttaccagtaatcttacattgattgcagttttcctctatcggcaccctttcgggtgatgtgatatccacttacacgggccagttcaaacgaatagaggagaacccaagttggatggccagatcatacagcttatttgtaaggatttccttttatggttgcattcagcagtcttattgaaatttggactatttactaacacaatctcgttcgttcattatctccttttcaggtcaaagatccaattgagagacctgataatgccgctacagcggttgatttgaaaggccttgagcggattgctggggccttcaccgctgctaatcgtaagtttgcg

SEQ ID NO: 37964 - DNA, 1265 bp, Oryza sativa
  unsure (1)..(1265): unsure at all n locations
aaaagttttacaagttttacacatgcgttgcatgatagattgatcgatatgcgtgggggcgactgggcgacgagtacatagcatgtcaccttgcatcggcagttcggcacggcatgcaatgcccaacatctgctcttatgttctgtactcgtgtgggcataccttgcagagcaggtgtgtaatgagatagatcaatcgtccatgatcagcgttgttgtgtctctaatgttttctctgatcactgcgaacatttggcacagctctattgcaaatttggaaagtggaaaatgcaagttccgtaagttgcaagtcatataattcagtgcaatgagaaagaacggtttgtaagttgcaagtcatataagtcatatataagttgcaagtcatatagttccggtttctatctgatctgtttgtgctcaacattcagagcgcacggtttcgtcgacgtgttacatgcatgttccgatgttctgtgatggtcaaatttgcagctaaagttgagcgcattgttgatgttcctgcttgattcatttcttgtttccgtctgcggccatggaggcatgcatgcatagacgcgaagcacaactggtacatacatgaccatgcattctatcaagagagctccagaaatacacattccattgcaatctttctcatggngagaatagatggagaagggaagatggncctaaagttatatattgaacatcagaagtgatagagctgcatgttcagcaatacatcttctagatctcaaaatgcacataagccccaggctcgctcaaccatacgagctggctggcaataacttgcgctaaatttcatgagctcatacatattgtttgtcgagacctaagggaatcgaaatgtgatgcatattgacatattgtcaggcaagagctaaagataatctgttgctatcctaggaccatcagttatgatcaactgatgctgatggtgaggccggtctgagagcgttactgccattctccattgtagaatcatccacaaactggctcgtgccatgtagttgctgctcgccaatttgaatgacgatatgatgtgttctccttgctacgctgggtattctggtactgacctcctgtttgcctccctgcagcatacacctgttgattgttctggttctggtgatgaactgttgtttgccgctgcgtgttatatgcctggggatgattattgttctggtaatgcactgcaatttgccggttggtagtatacccatgtggactctgacctgacct

SEQ ID NO: 37965 - DNA, 693 bp, Oryza sativa
gatcatccaaagtattgatccagtagaagattttcgatttaattcgaccagggtaattgctaatggatatatcacaggaaataccatattggttgctcacatactgaaggactggaactcttgcattaggaatgaactccatatgtctagcaatacctaaataaggaatgaaaacagataagaatatcctgtaaattcaacaaaaagggttgcattgaatgaagtacggaacaaaaagaagatcgtgaatagcttgatcaaaacttattcattacagtgacttcacctctcacaagatatattgctttcctttttttttttagataatggataacctggccgctgcatcaaagacgcgcaaagcccacttattgctttccttggtgcatgtatatgcatatagtgactatttgtttgatcacaaagaacacacaaccaaaacttctatcatttcggttaaagctgttttcattaatcgaaaagaaagtttacctcgcttttgcaaagctctccttacttctctcagggtatcttgcttctttctcttacttatagggagattcaaggcattgaacagctcaactgacacatccaaatcacctgattttgcataaagttgtgatacgaaggatccaaaaggttttacagaagcacctataaaggaaagttaagaactcagaaaaagaaacacta

SEQ ID NO: 37966 - DNA, 181 bp, Oryza sativa
tctggtccttctgaaagtagaggtactgatgatagcacgaagagacgaaggttgtcttcaaccaaacatgcacccgaaagttcaacgtccagtgatgaaaacctttcagcacccccttgtgtagtgacatttaatacaggagttaaaataatggcagtagctgctggtggtcgtcatacat

SEQ ID NO: 37967 - DNA, 1130 bp, Oryza sativa
gagtttaggaacctagatgacatacccctacaagtttaaggaccgcccgtacactttactcaattctattcttttcgatgttaatggaggttaattacataaagtaagtttagggaaaataactacagttaacataatgattgcctcccaaaatggagttagctgtatgtgaggtgcatgtttactcagtaagtgataaccataagtatattgcttttttttttatgcagactgtaccaaaactggtagatgcctcaagcttggagaataagaatgcacgagctgtttcttgtggagctcgtcatagtgcaataataactggtacctttgactgtactagtatttttcccctagaaggaatttgctatcctatctgtctaatataactgcatattaataaaatgctcttctcatgctcatttaaatcaaggaaatatttctggcaagggtttgttgaataaacccaattatccaaacaagacctttagggtttgttgaagaggtagagattatactcgatcccttagaaagccatgagtattttagtttaatctgtctgccaaccgaacgtactgagcctaatccccatataagcaagccctattgaatcttcctagatattctgatgtgtaatcatattatgagtcactgtagttattagcgtattatcagtaacttgtgcttggaaagttggaattctacaataagctgttccatgtgtgattgaagtacttaaattcttgttaatctttggcctccctgacaatttgtttaaacatgcccgtagaaagtgctgttcctggtctaacatctactgacaaaatgtggtgacatttatgcagatgaaggcgaggtcttctgctggggatggaacaagtacggacaggtgcgtatttcagctctgcacttggagaagaaaaacattcaccgttgcagttctttttataacttttgagttgcgcgtgcagctcggtctcggcgattccatggacagaaacgtgccttgcagtgttcctgtcgacgcataccacccactgaatgtgtcgtgcggttggtggcacaccttggtgctcgcggagtcccctacttaaaacctgacggcgaacaaacttccctagttgacaattttg

SEQ ID NO: 37968 - DNA, 1558 bp, Oryza sativa
ttctaactccacctagccgtgttgtgcagcttgaactaccagagaaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaggcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaaataatccattacagcgcacctttcctggatcataatcaccccctcaaaaaccagaggcatggactctccagcgacccccgtggacttctcgccacttctcagtctggcgcactataatgaatcacgctatacaaaagataaagccgttgcccacgctggcttgtggttggcacggtaaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccactcggtgacattcgaaaataaatgcacagttgaaataaatagagaatttaaata

SEQ ID NO: 37969 - DNA, 666 bp, Oryza sativa
ttttgatcacactgataatcctggggatgtccctgatcctgttattgtgcaagagcttatctcgatgcttgatcagttcaatcctcttgtgcagcagttccgtcttgctcgaaacaagctgctttcttcaagtgctcctgagattgctatcaagctcattgggtcaggccattctcagagtgaccgttacagccttcccaccacctctgagttggcagcactgattatacctagtgcatcttgtgaggtatcaaagtttgatgtcattgtgcagaagcattcaggtgagttatgtcagttgtcacctattcatccagcccttatgtcattgcagtacccgcttctattcccatatggtgatgtgggttttcatactggtatcaagcttagagaggtagatgatcagccacccggtagtcacgacgaagcatcgatgcttgaattttatcggtacgagtcccactatcgaaaggatgagcccaatccattcacctgttgtggtaggctttctgatcagctcgctgtgaatgctttctcatgtatagagacatctcgactcatataccatgccctcaaccagaaaaaacttcgctctgagacacatcaaggtatatctgatgctgttgctaggggagacagtgatggaaaggatgttggcaccaagta

SEQ ID NO: 37970 - DNA, 680 bp, Oryza sativa
tttatatggatctgcctgatccttattattatccactttgcatcatttgctacaaattgtgcaatacatcatgggtctgttccatatagcagtatatatttgtttcaaaaagaacaaagtacaaggctgatcctcttcttttataggaaaaagagtttcttctggtcctcttggtgcagggttgagaactttactggatggtccaaatgaaggtacaatcaaatatggcacactgaattctcattgagaagcagttttcagaatgtgagtaacacacatgctaggtcaacatcttggaaggatcacaggtataaactaaagatactgcattaaaagaacttgagtataccataacataaaaggagggttagttcacatgacaatctcaggcttcaggatgcttgacttgatctctttgtgcgggagaacaacaccgccgttggtatagacctcatcacctacatgtacgtcctctcccaggatagtcatattttctatccgtgcccattgtccaacagttgagtgccatccaataatgctgtttgatatgcaagcatgcttcttaatgtgcacgccacgcatcaccgtgcaacgggaaagcctcacaccatcctccacgacgcatccaggaccgatagcaacatcaggaccaatcagacagccttcgccaatcttggcac

SEQ ID NO: 37971 - DNA, 678 bp, Oryza sativa
tgctcaaaggagatgaataataacttgccttgctccaacgcaaataaatccgagataggcaacctgattatccgattctcgaaataccaaaggttgccatccaaaataaaatagactctactaagaaagacgaagaaccaatttcaataaaatccatagaatagcaagaaagagataaacagttaggagggctagggtttagggtatagtctatctcttttatagggtatatggattactgtgctaatatcttatgcggaggttctagagagttggaggctagaggggattaagcaactactatcgcttatatttcatatgtgggtttgattagtaggaggatgggaagtaactagtttggataatggtattggttaaaagggtatgtggttggtattcattggcggtagctaggtttaggtcgtatggaaactaaggtctagttgtcctcgagtcgatactgaaataggatagcatatcagctcggctctataattttatgtgtaggttctggtaggtggagagtaggtggtggagagtatggtggataggcgatactggtgggtgtggaatttggatgacaactggaatttgactgggaaggtattagttagggtttggttatatgctagtcaatgctagagcataacgactagatttggtaccttctctagccgg

SEQ ID NO: 37972 - DNA, 543 bp, Oryza sativa
cggcgtgagcaatttctcctccaagaagcttggcgatctgctctgcgtcgcccgcgtccctccggccgttgatcaggtcgagtgccacccgggctggcagcaggcgaagctcagagcgttctgccacaccagtggcgttcatctctctgtaagtcctgcatgtttctgagctcatcgatcacttgatatgtagtagtagcattgtgctgtggttcactgctcacatgattcttgcaggcgtatgctccattgggcaggatgaagggcatcgccgttgattcggtgttgccatcggtagccgagatgctaggaagaactccggctcaggttgctctgcgctggggtcttcagcagggtcagagtgtgcttcccaagagcgtcagtgaggcgaggttgaaggagaacatggatctgtttggttggtctattcctgagcaactgtgtgccaagctctctgaaatcgaacaggcaagtgcatccaacctttcagctgtctcaagtgcagaaaacagattcacttctgtcttcatatcttatgcaatt

SEQ ID NO: 37973 - DNA, 413 bp, Oryza sativa
ctggcgggggaagagcgcggtggtggctcccagccgaccgactctcgagctcctgattcacgggctcagcgacgccgccgccgcagagctcatctacgccggcagccactcttccccaatgccgcgctgtcgccgcacagccttcgagcttcctccactctctctctctctctccactgtcaccgccgccagcattcttgggagccacccgccgccgaccgcactcgaatctccagtgccaccgcatcttgggccacctccgtcgccgtcgaggtcgcccatagccattggagtcgtgcgccctcctctggccttcctccctgtgcgcaggaaagagaggaagaagagagaaagagggatctaacatgcgggtcctaccttttattattttattatttccccagaaactgcca

SEQ ID NO: 37974 - DNA, 566 bp, Oryza sativa
ggcccctcctcttctcctcactcccgccgcacgccaagctcctcaccctcccctccccccttccaaccgccacacccctccggcgcggcctctgccacttcgtcgacctcgactccttctcgggagcgttgctcgtcgcgtcgtccccgcccttcttggcgccctccaacctgcttgctgtcctctgcaccccgtctccgccgtcctccgcaccgccctctgacctcgacggcgtcctcaccaagggcagcggctcgccgcgctatcccctcgccatgggcagaggaaatgggacccactacccgcgcccagctgctcccccactacttgtgcccgccggcccccactcacacgcagctgctcccttccctccctccccccaaccggccgtggagagaagaggagagaggaagagaggtggagaggagaggggaagaagaggctaacatgcggggcccacgctgggtgagctgccacatcggacaaaacctgagtcaaaaccacagagggatctagtttgcactgggtttcgtaagttaggggacacgttgtatctggttttacgg

SEQ ID NO: 37975 - DNA, 89 bp, Oryza sativa
aagaggcaactgcaagaacaatttcacctcttgatctcaggtttgccataatagcattccacaagaatgtcttccccgttccaccatgt

SEQ ID NO: 37976 - DNA, 700 bp, Oryza sativa
ctgcaccccttaagaggagtgattcgtactagttttgcctatgttaagaaattattattattggggaaaataattcagttgaaggtaactagtaactatcaccatctgattgtattactagcataattggtttttcttgttgctgcagccaaggcagaagggtatggtgcaaggtgcacaatttaatactgccaatgcagctcaagcattacaaggtatgcagtccatgggagtcatgggtggtatgagaggaaatggaactattccatataatcagcaacgttttgcccatgcacaagcacaattgaggccgcagcagacatcacagcaaggcacactgtctccacaggtacttgacttccgtaagcaaaagaattatctttggttatcaagcacccacctccttagtccttaccttaccatatgtatctttcatggccttattgttattatatgtgaatgcatgccgcagcaaatagccaaggtcctttttaaagaacatatattaacaggtactgatcaaagaagctaatattaatctcttggcagctttctgatgtatctttacacacagttactaaaattatgcttttacccactaaaactgcatgagagttaagcatttgtgtgtccttttccctttttcttttaagattaatcagaactatgcttattaactttgcaccatggatattctatt

SEQ ID NO: 37977 - DNA, 933 bp, Oryza sativa
gattctcgccatgtttgtagagcatacggacatccatatcatggctcaaaagataaggaaatagcacaatcatactatgcctgtggcacgcctttggtgctatggaaaaaaatagtattcctgaacaaagctagaattgacctgtttctcacagagaaaaaatgttgcaagaaatctttcgtgaataaggtgcaaatcaaagcaaaaggcatggctgaatacctactaccaacaataattcagggtgactatcaaatgtctgttagcctgctaagtaatttgactaatttcagtgaggaacatgagtatcaaactaacgcctcggtacaagaaaaaatgatgatgccaaaggacaaatagacaaacaagtagcatgggataaatgatgccagaggcgaagcatacaaatgacatgatccagtattattcagaggagcgctaatacgaattctaagggaacatgatgctgctgatcaagcaggttcattacattgaataggagctcaagagactcaaacaccatacattagataagcgtaaattcgtgaaaaaataatgttcagtgagagtgactggcactaacgtaagctgactgcatctaaatttcgccgtcccagagctcctcatgggtcttataaacgctgtggggataaacaatgacgtcgcccctgagaagcctaacctgaacatcatagaacacgagcatgagaaattactggtgcactgctatgagttagtagaaggggttcaagataatgagatacttgattgatgccttgatggcaaataaaatagctcatggcataagatgtacaaaattgtcctgtaaggccagtggttgcgacataaaaaccaaacaagatcacgtgacaatagatgaatataattatagcacatgtaatgagaaatgagacaggcaacataataaccaga

SEQ ID NO: 37978 - DNA, 698 bp, Oryza sativa
ttcctgcagcccgtaccggaagctcgtcaatagcaggttgcagagagttaattggctctgaacagtaaacagtgttctgctgtagcattcatttctgatctctctcttgcttgcagtttcgctgatctgcagaacccacagatggacatggacgggaaggcctgcgctgccgtcggtcagagtgtgctgatggcgatctatgacacgttatttagccaggttggcgtgccattcctgatggatttttgtgtaaaaaatatgatttttttgcatatattttgacacgttaaacttccttcgctgcagcttgacgtaacatcatctcagcttcttgttacggatcgtgattttatggatccaagttttgggaaccagctccgcgagactgttaattctctgttagatctcaaggttataccagtatttaatgagaatgacgccatcagtaccaggaggcaaccatacgaggtgtgtttcctaatgtgatttgtgtgcactgggagcttcactgatatatacgtattccaaattccattaacaacaaacactaaccttttacactttactgattgtaatgatcaaccgtgtgtaggattcatctggcatattctgggataacgatagtttggccagactgttagcgcaagaacttaaagctgatctccttatcatgctcagtgatgtggaggggctctata

SEQ ID NO: 37979 - DNA, 710 bp, Oryza sativa
ttcctgcagcccttttttccactttactaagtcattgtacttagtatcttgctaaatacttatattttaaggattaggcggcatcggaggcttaggcgtcgggcagtaggagaaagcaacagccggtgctgtgatttcgatcgggcctaacaggtgcgagctgcgcggacagggccaacgccataatgaggaggatgacgacgtcaatgcagctgttcttggcagcggtgcccatggcgccgatgagtgaggagctatcgccacctcccttaccagcggtgaagggagataggaaaataaggacatgttcagattgtagccaaaataaatcttaccaaattttggcattgtcaattttagcaggatttcttatggacaaagtatttgttaaatttagcagcaaactaaatgtagacattttttaagtaactttgacaaaaaaaaatggtatggttgaaaatgacatcaatctaaacagaccccaagaaaagaggggagaaagaagattaatctaacgggtgggtcccacttataggaaagaaaaaaaagatgaaaaatgtgacggtagtggcacggttctaattttataaaatttcaatgacatgactacgatttgaataaacgaattgtaatgacatttatctgaaataacatatttgtaagggaaaagtctgaattacccttgaactattgtgtgcgtatgaattact

SEQ ID NO: 37980 - DNA, 494 bp, Oryza sativa
tatcgacaggtgtgaaccatttgatacatatccaaggacatatgatctgctccatgcgtttagcctattctcgaaggaacagaaaaggtagcagttcttttgataattaaattcgagttatgttcctgtttatttttctcccaaacacctgtgtgcctaaagaaatatccacacttatgtgccccaacaatgtgactataaaaatagctgaacaggtgatctcatgctttatcgatacattgcaagatacaaaaatagtattcatgctcattcctttctacgttcttgactatgctgctaaagataccactgagttctggataaacagtgcgtctaactgtagtatctctgttgttaccagatgtaacatctcaagtatcttgctggagatggatcgaatactcagaccaggcggtagggcttacattcgtgacctaaaacaagttgtacaggatgtcaaagagataacaaccgccatgggatggcgatccatc

SEQ ID NO: 37981 - DNA, 478 bp, Oryza sativa
  unsure (1)..(478): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgaccccgtatggtggcttcgttttcgcgctgggtttactggtagctatagctgcttgtgtggctcccgttcagtccgcttttgaggtttgatcaacgtagacccgagctgggactgtgaacgccgtaaaacttattgtttctgtttctgaaccgtagactgatggcagaggccagtgtagactctcgacctgtacgccgacggcagaggactaattctcaggtaagtaacagttgggccaacgtatcgaaaaatgatactaggttttagtaaaaatgaattctttcgatgatttggaagcagtttcgctaagcagaatcgaatcgtatgcgataccacttgatagcaatgt

SEQ ID NO: 37982 - DNA, 9967 bp, Oryza sativa
  unsure (1)..(9967): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaaaaagttgcagtttattaattaatttgagtgcaacatggatcgaattgaagatagaaacaataatttattaggaccagttttgaaattaatggaacggaagaaaatatatatgcaggaaattcacgtaccaccagcgtcgacctaactaacctacctagaggattcatgttgcaaaatttctacgaaggtacatcgatcttcctcctttacgtacattattttctcagaactaccttaaataaacaacatttagcttaactataacttctactaccttatacggctacgtcgtacgcatgtacgtatttcatcatttcttccaaatgtaggatggcattcatgcatcttaatttcgacgcagtttctatcctatttctagggctcattccctagctagctaaatatatattttacaaatacaggatagtagtacatacttcttttttttagatggtatcgttggtttttagcatagggtttcaacacttatcttattaaaataaatttatataggtcttatttattttgttggcactaattactttattattatagaaactttaagcatgatttataaaaaaagtttttatatttgcactaaacttttaaataatatgaatagtcaaatattaatctaaaaattaacgaagccatctatttagaaaacaaaggtgttgcagtttaattcatcactggaactataaatgtcaattgcatgcattgctgatgaaacggtacaactagcctacaaaatatagtttttctataactcacgttttatttccatttcagaaattaaacaaaaagctcaagatttatcgtacaattagatgaattaaaacggtttttcagatctctagcataacacctgttgctaggataagatagataggaaatattttgacattcataagttggagtacttacttgttttttttttggataatgggaatggcttctacaccaacgggggtgtatatatatacaaccattggagtacttagttgttgggctctcatatgtttagccattatcggctaaccgatttactaattatcttggtatccacatcacttgcaacgagtttcacgaaatatttgcttgaatttgacttagcaacggtggtaggctccaatgatatggctcctgttcaaagtttctcctcttagttgtatccacaatatattgttgacgtacaaagttaaaggtaactatttacacgtacgcaacattaattaatcatggaaaaaaaagaggaaatatgcattgtattggaattaagtagatgttctgagtgtctaaatacacatataatgcccataattatatttttttatctattgaaccttttaaatttttattttttaaaataaactatataccaaaacttccaaaactaatcttttggccacaacagctaggctagaataacaaaacaacatgcctaattttgtttcatcatgccgacttgactgacgtgacaagggttttgtgacttttgtcataattaaggcgtggcaaaacaccgggggcgtaccatattgttgtttcaccgcttgacaatcaaaagcaaaagcaaatagcttgattctgaaagcagattcgtagaaacgaggcatggtttctaataaaaaccaaaagttagcaatgaagctgcttttgtggggtgatgatgttgatctaaaactatcactagaagtattatataaattgcacatttcgcatgtttcaaaatctgaattcacaatcagattttaagaatccaactcctgaaaaatcacaatccagagacaagattgtgacaataaaaaacaaaaataaacggaataatgtaagtaatgggtttgcaagatgatgtgttcggttatgtgcgtaaattaattatggaacggtcgttcagtgcatgcatctcccacagccaaaaattaaattttaaaacatggtattagagttcattttaaagttttttcatcttagttcattttcagtattgacttttaaattactaagaaacacatatgtaaaaggtgtactcataaattatttttagttacttttcttttacggtttatctccatacagtaaacgatgagaagcttagctgcttgccttttcagaggccaaaacgactaattaaactgcctaaaaatttaccatctgatagctacatatgcagattattggtggtcaaaatcatgaccgattgacgccacaacatgaacgggcaacttgaaaaaaaaaagaaaagaaaaacatggtgtatatatacattcatgaaacctgcctagaatagatgatatatatatatatatatatatatatatatataacttccttaacatctgactatggtgcaacaacccgaaagggagagaactataaaatatttacagaaggaaaaaaaaacatataactaccaagtaccgactaattgaagctagcattattgtggtcaactcttagttaagtgctactctagtagtttgtatacatagtatcgactgtttgaccattttgacttggttggtttgtattttaggtatcatatatgcatcttagaagctattgacttgacccgtggaaaagttcaaaatgccatgaattgttttcttggctgttggttgccatttgcatttgattaaaaaccaatcatactcccagatcattcataaatattgaacaaactaataaatttatccttgaatttaaccaatgtaagaaatataaaacagaacagtatatggctgatccatgaaattcacacgtacagaagcgatcgaaacaggcggatacgatttcagacaataaatgaattttattgaatttcatcatcagacaaaaaagaatgattacaaattaagaggtttggaaaaaccacctttgatcatgcacacatcgatcgtacagatcgtacatacggacctaacttacatggtcccgttcttggatatgatttgattcctctcccggtcgcggccgagaccagatcgtagttcgagtcctcaccaaatcaattccccagttcacatgacacatgaacacgacctaagctagtcctccattattattaactaacaattaattaatcagcccttaataatcaattaacttaattacttttataaacaaataacgaatcttattatatcattttatacgactgaattaacggtatcttgattcggtgtacgggaaggatggacggccaggattggctactcttccttgtagtcctggttgttgtagggggcgaagagctcggcgaggaagttggacttgcggtggacgcgggagccgaggtcggcgcacatggcgtcgctgtcgtggatgctgtaggtggagatgcagtggcggcggtagaaccgcgtcgtccgccgcatcgcctccgtctcgccgtcgacgtgcctcaccatctcctccaccgccggcagcgcgaacctcccccccagcagccccgccagccacctgcacctcagctccgacgtgtgcaggttcgacacgctctccacgtaccccacgaacgccatgttcggtatcagcggatgtatcgtccccctacacacacaaaaaaaaaacactcatccattagctaattgtgcgtgtgcgtctgcggtgtaattggttggttaacatgtgggtaccggtagaggggcatcatggaggatttgttgacgacgaggccgcggaagggctcggggaggacggagcggagcttgtccttgccctcgaagccggtggcgaggaagacgaggtcggcgtcgacgtgggtgccgtcgtcgaggacgacgccgttctcggagaagcaccagccgccggcggagcgccggaaacggatcaggtcgcggtcggccatgtcgaagaagccgtccggcaggatggccatctggcagctcgcgtagtcctccacgaacgggtgatccggcctcaacccgtacctgctcagtggaagcttccatgacaggtacgactcgatgaacttggacaccccagccttctgctctcccaaaaaaaaacatggtaaattatgatgctgacaagctagctagctactacaaacaaaataatattgtcaaagtcttgagcatgcacattctgaacttaatttctgataagatgttcacgtgaaatgagtagatcgagtgagtatgtacataccaatggggtcatgaggcggcagaggagtgatctgaagatgccctggttgggcctctcgtagaagagctgggagaagcgagtggagtagaagaggaagaagggcaagccccagattgagtaggatggcaccacccaatgcagggtcctcaccagcatcgtgcacggctgccctccctcacctgcaaccaaaccaatcaatcagaactgaacaagcttgaaattaaaggattaataattcttcagaattaatgacagatagtttttgttgctgcatgatcaacttggaattaattactaacttgatggccaaacaaaaggaattaatatactaagctagcactttgatatggtcaagtacacagtcaaaatgttggagtgatcatctctgcgcagtttcagagtagaaaaaagagattgacaagtggaacgcgtagctagcatataaaacacttcagcttgaaaagtcagagcatatatgcgtatgtgttgtgtttagcgtactttgaacctgtatagagcaagaggaggcttggctacatgtggcataaaaagaaataaaattctagatggagtgtacgacggatcaagacaagagtgaccttttctgaaacagggtgtcagagctaactaagattgggtctcctgaatttcgttaggacaggttgctgtcacggcgttacatgcatgtcaccaaattgggtatgcaaattaatactactactataccatgcaagtgtacaatattaattccgtcccaagttcatcaaatgattggacgtttccacgatataaatatgtaattcctttggagttagttatgtgtgaacttggcatgcatgaatcttctttttctatgatttacttgttaatctccgcgttcatgcatgcatgatagctcatctgactgcgcctagctagttatacatgcatgttaatttcctagatactcaatacatacatagtcatttattaagaacaaaaatggttttgtctttgtgagaatttgcacctaatctacaacggtaaatacatagaacatccatgcatattgatcgagctttttactgagacgaatattcaacgatcgatggtgagtaaattatttttttaaatttttttttaccttggttggcctcggcgcattcaagggctagatcaatagcactcttcttgtagccaacgacgacgaccttcttgcctctcatgagctcgacggtctcctgctcgttgagcttgcagtagtccagcgaatgcatcaccttccccttgaacacctccggtcccttccccggcgggaacaccggcatcctcgccacgtcgccgtacttccccgtgcacatcaccacgaactcgaacttgtacaactgcatcatatcgacccaatccatcgatcaccatgaccggaaatcaagctctaggtgtgtgagaattaacatggtatgtttacctagacgttttttcgcgaacgtgcaaaagaattattgcacgtcaatatattagagtaatagagttacgtttttgttacacaatacaatcggccagaccggcctatggtaggggaggagtatgttaatttacctggacgtcgtcggagtcggggtcgtcggtggaggagacggcgagctcccacatgggcttgccctggaggggctcgccggagccgctccagagctcggtgaatccggcggaggggccgccgaggaacttgacgccgacgaccttggagcggagcgcgatgtagcgccagaggccgaacctgtcggcgtagtcctcgaggtagtcgacgatctcgacgtgggtggggaacgaggggtcgtcgcggttgggccacgccatgtcggagaactcgtagtccggccgcggcgtctgcagccgcgtcgaccggtacgcgcagtgcttccacaccccgccgatgtgcggcgtcgcctcgaacaccaccgggtcgtgcgccgccagctgcttcgccgccgccagcccgctgatcccgccgccgatgatcgccaccctccccaccgccggcacctcctccctcgtgcgcctcgcgcccccctccttctgctgctgctgctgcgccgccgccatggcaagtgtttctacgtgctctgagctagagctagctagcaatggcgatcgatcgtagcagctgagagctagaggatgagtagttgagttttagggtgggggatgaagaatgatgtgtgggtgggagggagaagaaggttagggtgtgtatttatagggagaagaggcgagggtttaagcatgtgagctgaggctggctaagcagcttcccctacgtgacacagaaaatgttgggaaatattacgagggaaaaaataaaccatataaattagaggtcatgcatatgccactgacaactggggcccatgcatgcgtttgactttttgcagcatataccattggctgattggctcgtccttgctgcatggccagagctctctcttcaaaccatgtcttttcatgcaagtaaaatcttttttttacgccactagaaatagttactgtgaattcatcttttttttttaaaaaaaaatcatatttattacatcctttgagcacatgtccataagtagctatcaagaaaatcggtcaaatattcccaataacatgaaaagagaaactacctagatccaggtagcttatgataaagagattaggcatgaggctttgttagttatttgagaaaagaaaatatcatgggagttgttttgttgtccttatggtatgaataccaggaaaatactattcccttttttaatgtatagtaccaataacttttgaacatacatttatttaatcattcgtctttaatttttacaaatataaagaatataattcatgtttaaagtccttttaaaaataaaaaaaagacacaacaaaataaatgatactctatctgtttctaaatatttgacgctgttgacttttttaaatatatttgaccatttgtcttattaaaaaaatcaagtaattattaattcttttcatatcatttgattcattgttaaatatactttcatgtatacatatagttttacatatttcacaatttttttaataagacgaacggtcaaacatgtgctaaaaagtcaacagtatcaaatatttagaaacggagggaatacttaggtaattgttaaacatgtataaaaatcgatgccatcatatattaaaaacaaaggaaatatgaattaatatcggaaggtaatatatgtttgctctttgattaaaaacatgaaaaaaaaataaaataatcatgttactccttccattcaaaattatatagcttacaaattaaataggaaaaggcaaaagtccataatttccctcattaataggaagctacttctaattcattagttgttggttagtttcagactaattaatccatgcttgggagagtgcatcagctataaaagtccttattatatgataaattttaaagcctcagactccttgtactccctccaggtttgataaattatcatcgttttgaataaaggtgcggtcttaaaaataacttttaccactactttttattataatataaataaaaatatcaacaaacatatgatttttggtgaagtactttttaatatatacatatggtctgtacatttttaagataaaattttagaaattacttttactaaccaaatttaaaaaaaattaaagtttgatctcaccattatccaaaatgacatgtattactaactctatattataacgaagaaaaagtgttagtgaggaacaatcgatctgtaatcttgttgacacatatttagctaggattaatctggcaagcgtgaaaaaggcccgcgattgctggatctttcaacaaattccgacaagtaaaatatagctgatcgatcaagagaacagttacgatacgcatacgatcgacacagtaaaaattactcgtatcgctttcgttatttcattcggtcggtcggtcgatctggatcgcccggggcttggtcgtcaaagatttttactggttttcctctcggcatgtacagattcgagacacgggaacgacgaccttgtctcgttcaaggggagaactctccattattcgatctgttgatcatctcgatcaggagaattattgaacgtctcgtcgtctcgtctccaagccaagagagagagagagagcaagagatcgatcggtagctttggaccggaataaaccgaaagggacccatgcatatatgcaatgtgcttgggcaaatttggttgcatgcctatggctatatcttccctgtcaccctcctgcaagtgaaacggacagctttctatgtcttttgtccttttggctgccatggacaagttgtctactagcacgtcctattttaagtgtgtggtggatttatgaaaaaaattaaaataaattagtcacatataaattactatttatgttttatcatcttatataacaataaaattactaattatttttttaaataagatggacggttaaacgttgagtcagttgcgatcttaatttgggaggcagtattaccagcagtagcagctatggaagcctaacgctgactattctttccctgtcaccgcagtatggaagcaacaaactgaacagagcagcggcaagcctgcagcttttcttgcaaggttttgatttgatcacaagtgctttcaatctgttctgcattttatttttccattggatgcctacatttttttacaagggaaagtcgttagaacaaattttatactccctccgtttaacaatgtaagactttttagcattatccatattcattttgatgttaatgaatctagacacatatacatatgtatagattcaataacatctatatgaatatgggtaatgttaaacggaggaagtagttaatatgtttgtcaacttggcgtggcacatatttgctaactaggacacaaaacccatgaaacaaaaagtagtgagaaaaatactaaatgtcaaacatgcaaaaaaaaatatgcctactttactacagcctcaagagttagaagcttttgaccctaagtgcattctcatatttttaaataatttctctctctaattaagctaaaagtatcatctagcaaattaccacttttaaagataacttttagctatgacacgtttttcaatgtctatcagcaaattaaataaattttgagtgtccagcagcaaaatttgctagatagataatgtatagtgctagtatatatatttgttaattatcttcttcctacacaataaaaagattgctagataccctatatatatttagtttaaaaaaactctcattctctctatatatatcaatgttgtttagaacattttggacttctctctcagcaaaaaaatgtatttccagcaattcacacttttccagaccatgaaagctacgtcttctgcatgcaacaccaatgcatatagagttccattgtttaccgaacaaaaaagattctgatgattaactatatataggatataaattactccctccgttttaaaatatttgacgccattgacttt

SEQ ID NO: 37983 - DNA, 6287 bp, Oryza sativa
catttcgaaacggatggagtataaaacagtaccagctcaatttttctttttgcgaatacttaattaatttgttaataattaattagaccactgtatcgaactggagtagtacacaatgtgtatgtgtgtgcactatgaactcaagaaaccaagactaggtagctgcttggaagaaggctgaccttgaacatgcactcgccgtaccaaaaaccaagaataattaggttgatcatcagcatcaacaaacatagcaagtgtatttttcatctgaacttcctctgaagacccagattataatggatattagctttgacctctgtgtggacccatttttttttgttcgaaaaaaaactaagtagctagatctcttaactagaaaaaaaatactaagcacatctcttaattagatcgatgcattataacaaagtatatatgatcgattattctgcgccacatggcgcagattaaccaacatcctccacatggatctgattccattggtctagttgttcaataatatttagcaatatattaattaattgagtgtatttggtactgatgattgtacaggtaccacaaatttagctagctatccatcctgcatacgcaagctagctagctcttgattattccttacatttaccacgaagtttgatctaattttcttggcactttctcatatggagatgaattgcatattaaataatatacatataaaatgtggataaacatatttatatgtacgtacgtgtgctagtgaaaatggtaaaatttgatcagtttaatttcgacatgtgctaggagtcctaaacgggaaaagtaagaaactgcaaagtaattaggctgagtatatggatgcatggcacattatatcgatcagcacgtagagttgcaaatgtaagattgaaaataattgatgcactcagaaatgtcggagaaaatggtcagctgcttttactactctactgtactagtaatgcttttgacttttgcgacatgatatattagcatgtgaacgtagtttagttactggtccatttttggaatgtgaaaataaactaaagaaacatgcatgcacacgtatggttttattgactatatgtctatatatatagctaactttcttttattcccaaagacacaaattaacaaacgttgcaatagaacttgatagaaaataataaattaactatatattacctgcatttattcaaaggagttctagacaaattagcaatgacgacctgattgaaactcattttgaccttgagttttcaacaacaaataaagtaattaagtgctatgatagaaatataaaatcaagcgcatatatatatatatatacacactgatacccatgcgcggccggatgatcgatctagaggtagctagctagacgattcactaccgttatactacctccatatttcaatgtatgacgtcgttgactttttgtacaacgtttgaccattcatcttattcaaaaaatttatgtaattatcattcattttattgtgccttgattcatcatcaaatgttctttaagcatgatataaatattttcatatttgcacaaaatttttgaataaaacgaatggttaaatgttggctaaaaagtcaatggcgtcatacattaaaatacggagggagtatttggctgtgataatactcgcgctatgtaaacataacaaaataattaagtggagtatttgagcaaggatgcacgcactagttaatgctatagaaattgccactaagtttgtggcaaatttcgcttacatttcttgtacgtatgagacataacaaatcaaagaaaaaataatgctcagtgtgtgcatatatactcttcagtcatcactcgtcaagattcaagggagaatgggagatagctagccagctcatgatttttcaacttgggacatttgaatattaatacgaattaacgaatgtggtagaaaactttgaattgttggagaccaactacttgaccgtataactgaagggaacgcgaagacagataattaagtaaaagtactttcagctgactaatatgcttgttcatattttcccgtcctttcctagtatttcttcttcatttgtctgaagaccatatgcatgtatactatatataccatatatacgtactctaatattgcaattaattaatttctctccaatgatttaacgtattaattaactatacacaagcagatcaagcatactgctccaatattcaattagattctgcagaaagagatcgaactagacagtaatatgtagaagtttgcaagtagcagctaatagctagcttaaaagaccttccatggcagtgataaaataattaattaggtgttccctttctgtcaagagactaatactgaaaacagctagctagattgctcttgcaagcgcacaaggttttgagcctttgaggtggtcaagctgtatcagcgttaggatggcttgaccaagacgatgacaatattatttaatttgggtgctaattaagtccagtgtccgttcattgccttgtggggcttgtggctagagatcatagctaggtcttccgaaactaattaattataaattaatgattgcttttggtggttaatatatactaattaacatacacttgcatagtttgggatgaaatattatactccatgattgttgcatactacatgatggaagtggtatgtatgcacggttagccatgtgcttgacttgtggaccggccggtatgaaatgtaggatcgacttaatctgggactttactaaagcaacagaccagtagacgtaaccagaccagaccatgtcaataactacatgatcaaacgactcagacgagtatggagcatatatgcacgatacatacgtatcaatgcatgtgtagtcaatttagtcatacacggtgagaggtcgatgatcatactacatgctcaacactaaaaaaaataaccctctccatttcaggttataagaagttttaactttagtcaaagtcaatttgtttaaagtttgactaagtttatagacaaatattaatacagtaattttacaccaaattagttttattaaattaataattaaatatatttttataataaatttatcttaatcgaaaatattattttttctataaacttggtcaaatttaaagctgtttgaatttgaccaaagtcaaaacatattataacgtaaaacggaaaacggaaggagtactgattatgaatggtatataagcgatatatataggaccaggattaatatcttaatacgagagtgtctgtctagatttcaggtgcctaaaattttcagtcactacttttcgtattcttcggatgataaactattctcatcacttccatattacttaattagtattaattaccagtgcccaataatcgtacaatattattttttaaaaaacatatatatatatatatatatatatatatatatataataaaatgaagtaaacctataacacataaagatttacaaaattaaatgagaaagactccaacatagaaaaaaaataaagaaaaaccatacataacatcaaactgcagtaaaaaagaaaattgtttgttgcacatcactgcaaatttaggcagagtgtgcaatatctttagaggaataattaactatttgccactcttacaagtgacaattaaagatttatcactaagcccacatgccatagacatacgagggcccacgtgttatagattacgggtggcaaattattaattaccacatcttaaaaatgacaaaaagttaaatacccccttcttttaaatgactaaaaatttcttttgaggtgactgaaatctagcaattctctctgacagctaccagtacatgcatgtacgtattcaaagtatatactttctccgtcctaaaatataagcatttttagcatagtgtcaagttaaacattttaaactttgactgttaatagaaaaaataaaaaagatcaatcatgtaaaattgatgttattggatttattattaaacaaactatcataatatgcaactctttttatttaaaacgacatcttacttttatagatattgttggtccaagtagcatctcaaggaccgtgtcgagataaaaaaaatgcttaaattttgagacagatggagtatagattaatatatattacccgtatgtacacatagtatatgtacgtatatatatattagtgtagtaactgaacagtaacatatacgcccctcaccgggaaattgacacccctaatcatatgcatgataaatacagctagtacgtggcctggccaaattaaggtagtatagaaaatggaaaacttgacgtttggcgcgcggcagaatgcatccagcagctgacccgggcgcgcgggccctgacgtacgcatgccatgcatctctctgtggcggatcagaaacaaaaagttgggggactcaacatactgagtacaccgatataaacatataatctcagtgttaaactatgctaaaatgtgatgaaaaaattgaagggggggcttagggggtatcacgttggatccgcccctgtctgtgcttgtatactgccgtcgaccactagctctgatctggcgagcgtacgtacgtacggcgcatgcatatgcagcaccgcaccgacaagtgaagtccggaatcgcgctagctgtgcctgcatgaaaacgcgcatgcaccgtatcggcggcgcatgcgcgcgcgcggctgtctaatatctctcgtacagtaatccgccgatcgatcgatcgagctagctagctgtccatcttcctggccggtgcgtgcatgggtcttcgcgagcgcgccgcccgcagatcgatcgatcggtgaattgaacaagtcgtcaacatggtacggtacaccgtcgagtctgtccaagtttaattggccccatccttcctatctcttactatcgaaatccgtgcaagttatcgagcgattagcgatgccacgtggcacagcgtggttcgtgcgtgcgctccaaaacgcgaaaaggactaaaatataaaagacaatcttacgttggagtataatgaaaaagtgcaaagccacctgatttctccggaagggccacgactcttcgtcttccttgattgactcttcttcttctctgtatatatattcattctccatcattcctctttcctctcgtcattgtctcacattccttcttgccgttccaccatccacattcaccggcaccaaacaccaccatcaacatccaccggcaatacatctgatccaccgagggataaagaagcaacgacctccagccggtacctctgcggcaagcacatcctgcgccgtgcgcgacaacacaacgacgaggaggagcctccgaggcggtggcctccggccggtagctctgcggcgagcaggtccggcgacaccaggacgaggtcagtgaactgaatcacatgtattagtgaacacgaggacgaggtcaggtacacgatcgcctgcattaccttgcacgatcacgaaagcccccaaattagcccagatccagtagtattttgcattttgattgattgatttataccgaatcaaagaacatcaacaccagcctactgcaacttgccctgatcctaatgatgtgcacgatggacaacaagatatactatatctgttacttctctgacactatataggagtattagactatttgttataatataagtcactgggaacggaagcaatcggaaagaaatcttacgtccagccacgtcttattctgtcacctaaatctccaatgacaacttagtagagaggacatatggatgtgttccttttgatttctgtttgatctttgctaacaagtcaagctttcgtgtactcctaataaattaactcatagtatattacgatgaccaccattccaaactaactgttttcaattaaactttttaaaagttattcaaaatacattgatttatatagtggtactatacaatgtagctgtagcctccacttctgatccaaacaaacccttaattgacaaacctaggtacttacatgtaattatactaacttcaatcccgtaaatcaattagtcacaaagtctaatcttttcctctaaataatttgcagcaagttacagcaaattttactttctatttagaaaagctatagcacaaccaatcagctgtgaataacatttcgtgtagtatggatatttaccagaaaaaaaaacattgtctattctttttagtatttttcatcattgtacattgatcatctgcaatgatattagtaaatgttta

SEQ ID NO: 37984 - DNA, 4414 bp, Oryza sativa
ttgtatgtatgatcaataattgtagctcatattaatctttgtcgtcataaatattgaagtgtttgtattagctaacactttttttactattcatgtgtaattttcagattatatatagctgttgaaatgaatgattaagttttgtattgattcaaccaatatctttaattattcatatttaattttatgcttatattcatttctgactttggctattttttgtgcttatataatcagaagtgttaatatgccatcaaagagaaagcaagatccaataaaaatagcagaatatgataaatcagattgcaagaaaagaagatatatcagactacaaattctaagagagaaaaagcgaaaaagagaagaagaaaaaaatatggtgcataataacaataaaaaatgtaataaagatgaagaagaaacatcaaaaaatagtaatataagagatataatatatacagaaaagcaaaaaaatattaaaaataaaagaaaaatacaatataatttagattatctagaaaaaattgcaaaaaagaaatgtttagagatagaccatatatcttcatatttatcaacttcacatggcatggtgtcctttaccccagaatacattaaatatctaaaagaatcatatgaaaacaaatcatttataggtatgccagagtataaatgtaaacattgcaatgctatattttggtttgaagaaagaaataaaagagagacaaagaaaagaaaaggtgaaattatatatcaaattgctgtaaaaataacaaaataaaaataccaccattccagaacccaccagaaacacttgctaggttacttaataataaagaagataatctatcaaaacattttatgcagaagattagacaatataatagtttattttcttttacttcaatgggtggcacaatagataaaaatataaataatggcgatggaccatatgtgtttcgtgtaaatggacaaatacatcatcgtattggatgtctcctacctaagcctaatgaaattccaaagtttgcagaactatatatttttgatactaaaaatgaaatagaaaatagaatacatgctttaaataaagaagaaatgggaagtacagatatcaatccgtatatagttgaacaattaaaaaaaatgtttgatgaatataatccattggtaaaaacatttcgctatgctcgcgatctatttgaagaaaataaaggtgttgattttagtattcgaataataggggctgataaaggtgatccaatacaatatgaaatgccacatacagaagatttagcaattttaatagttggagaattaaatctagaaaattataaaagagatattattgttcaaaataaaaataatggattacaacgcatatctatattccatccagcctatatggctttacaataccctttattatttccttatggagaaagaggatttcaacttggcataccatattataatagtaatacaaataaaaagagtaaaaaaacaagatcaacaattacagtacatgaatactacaaatatcatatgcattatcgaccaaatcaaccaaatccttatttatgttatggtagattatcaaaacaagcaatagttgatgcccgtgcaatagaagatgaagatagactaatgtttattgctaaaaatcaaaacaaattacgagctgaatgtttacaaggaatatttgatgcagtacaaaaaggtttaacggaaggaaaccaaataggaaaaaaaataatattaccatcaagccatgttggttctaaacgatatacaatgcaaaactattacgatggcatagcaatatgtcgtgtatatggacctccacatttatttataacatttacatgtaatcctaggtggcctgaaattactatgacaatcttagaaaacgaacaacccaatgatagacctgatattatagttcgagtatttcatataaagctagaacaattaatagaagatatacaatccggcacaatatttggacctacaacagctattttatactcggtagaattccaaaaaagaggtttaccacatgtacatatcttagtttggttagataaaaagccaagtgaaataacgattgaaatgatagaaaaatggatatcaactgaaataccagatcctagagaagatcctctaggatacatccttatagctgaacatatgatgcatggaccatgtggagccaagaatgaaaattgtccatgcatgaaaaaaggcaaatgttcaaaattttaccctaaagaattcaatgatcaaactaattttactgaaaatggatttgcacaatataaacgtagaaatactaatatatacatacgtaaagataaccataacttggacaatagatgggttgttccacacaatttattcctattaaaaagatatcaagcccatttaaatgttgagtttgttaatcaaagcagaatgttaaaatatttatgtaaatatgtaaacaaaggaggggataaagctaaaataattttccaacgtatcaaacaaggaatagatcattctgaaaatgagcaaacagaaaaaatagatgaaataaagaatatttagaatgtagatatatttgtgatcaagatggtatgtggagattacttggatatgaaatacattatcattggccaccagtggaaagaatgcctgttcatcttcccttaatgaattggtcaaattaactaaggatacaaaactaaaaaatattatagaaaatccagataatcaaagaacgatgcttacagaatggtttatggcaaatcagttacatgaagaagcaagaaacttgacatactgtgaattcccacaaaaatggaaatgggataaaaaagaaaggaaatgggtcaaacgacaacatggttttaaaatagcccgtttatattatgtcaaaccaactgaaggagaacgtttctatctacgtatgctattaatgatagttaaaggagcaaaaaactatgaagatattagaacatacaatggtattatttataaaacttttaaagaaacatgtgcagcacgtggattattaatggatgataatgaatggtataaaacatttgacgaagctgcaagttgggcaacatctccacaactacgatctttatttataatcctactattgtattgcaatttagaagatgaaaggaaattttttgagacaaattgggcaaaaatggtagatgatataaaatttcaattaatatcaaaatatcacccaattaagtacaacccgactgatatagaattaaaagatattctaattgaacaaatagaatatttattatccaaaagtggtataagtatagataaatttaatcttcctcagatgacagtaagatacaaattagattcaactaatacactaattcaagatgaattaaattataatgcaaatgatttagaagagcaagctaacaaattgtacttacagctaaacgatgaccaaaagaaagcatttcatcttatagtaaatagtgtaataaataaagaaagtaattttttctttgtatctggccatggaggaactggcaaaacattatatggaatactattgtatcatttttgagagctaaaaaagaaattgtctaacagtcgcatcgtctggagtagcatcattattactaccaaatggtcgaacagcccattcaagatttcgaataccagttgatatagatgaactatcattatgtgatattaaacgtggaacaaaattagctgaattactaatagaaacttctcttataatatgggacgaagcattaatgacaaatcgccaatgctttgaggctcttgatagaacattaagagatatattatcagaaaaatatattaatgctatcgataaaccatttggaggtaaagttgttgttctaggaggagaccctaaacaaatcttaccagttatagaaaatgcatcaaaactggaaattattaatgcatcaatcgtaaagtcatatctttgggggtatgttaaaaaaatatttctatttgaaaatatgcgattacaaaaaaccaaatctaatactttagaatataaagaaatcaatgactttaataattggattctggatataggcaatggtaaaataaataccaaacaaagtactgctcaaaatgaagacacagatacaaccattatacaagtgccggaaaatttattaataaacacaggagaaaacaaattagaagagttggtaaagtttacatacccagatttcaaaaatagtttctttaatccaaattatttgaaaaatagagcaattctagctacaactaatgagattgttgatgaagtgaacaactatatacttagcttagtacctaatcaagagaaggaatattatagtgctgacacactatctcaatgtatggatacaactaatgatgc

SEQ ID NO: 37985 - DNA, 15921 bp, Oryza sativa
aaacacagtactaacattttccattgcttataatttgcagatgaatatcactccaattgcagagctgcgcccagggcgatatgactacatgatatgcgtccgaatatccaggatatgggaatttagaggaactaatgaagatgataacatcaaacatttagatctggttttacttgatcaaaaggtaatactatatcctttatttatattttctcctaacatatatttatcattaaatatatattattttattaaaattgcatggccattgcagggagatgctatctatgctgagatcccacctgatgctatacctttattgaaccaatatttacaggaaggaaatatcgtctacatcagcaagataacagttaacaatgctaagcccagttatagagcagttggtaatccatatatgatcaaactaaacaaaagaacttgtatcattgaagccaaagatcaacctatggattttccaaagtatacatttgatttggtgtcatttgataaacttcatgatttcacaagcaagactgatcgttttctaggtactaaattaacttttatttcattacacgtaaccataatattctatatgcaatgttataatcaaatactttattctatctttgcagatgttattggaaaaatcattgctgtttctaatgcagcaatgatttctacaagttcatcagattataggatgagaagaatagtcaaactacaagatttaaggtaatttatgccaatatcagctatatttccccatctgaacactaacactaatctgaaactacttgatactgactttattgtttcttcaaagtggaaaaaccatcgacctctcattatcaggaaaaagagctgttgagtttgatggagagacaatactggaagttggtcaaaataaccatataatagcaatatttgttggtacatcaatgaaaatccttaagggaacatatgaatttctaagtggaacaacagcttgtcgttggtatatcaacgaaaatgacatccctgaaatcaagatgtttcagaaatggtaagtacaatttaatcccctgcatatcttcttttactttatggaatttcctatttctaacatcttatatatgcagccttccaccacatgctgatcctatacaaaagctatacttgcaaagtgatgaagatatgcaacggagcattgaacacaaaacacttgcagaattgaaggaaattgatccttttgttgacaaggttagacttatgtacctaaattaatatactattaaattctttcattgaactacaacttaaacctttcatttatacatttacataggatgaaaaataccagtgcactgctactatcattggaattcaggaaagaaaaacttggtgttatcaagcctgtaaattgtgcaattgcaagatgatatgggatggttctatattaaaatgcaagaaagagaactgcccatgtaggcagtatgagtacaagtgagtatttctttttccaatcatactattaagtgtgaatatatataactataattttcaaataactctgcacttgaacaggtacaaaataccattcattgcaaatgatggcacagctagccttgaacttgtgctatttgaaaagaaaggtacagaacttattggtaggactgctgaaactatgaaaaggcaatatgatatcaatcaaacacctccagaaataaaagcatggataggacataaattcacattcatagtgaaggttttgctgaacataactatcaacgctgatgaaccttcatttgaggtgctgacaattaaagaaagatttggaaggcaacattccagccaaggctttaaggcaactaagaatcttcccatcagttcaagttcatctcaacaactacataatttacctccactggtgcctatactatccaagaaaatacaacatgaggtaaaagagtagtactctttcttttattcatttttgtcggtgctacataatctcttactatttcctttcttttctttcttatttactgctcatcatcccagatagaaccaccccaagatattcaaagcatggaagttgaaccatataatttagaaacaagcactttgtcaggaaaaagagcttatgaagatccaaacagtacagatcaggtaaacaactgatcatatttaaattcatttgtttttcattcttcaatcatacaattaacctactaactgtactgtgcacaagcttggcaccatttcaatcaagtgtatttttttagataatggaatgaaatattcaagcaagtgtataccctgtggtcaacaactattctctatttacatgtactattcacatatatggctgacactaggggtctcatacttgccaaacctactgcctgcattgtgctaagtattgcatgagaaagaattgctggttccttagtaatatactttgataaggattctgtttttcttttttaggaaaatgatgaagaagaaagcactgactatggcttcattcagacaaagggcaaaaagaagcgttctacctgataacttctccaatcaagacagcctacttttgctatctatagtccaagatggacacttttgttatcctctcatctactagccaaattacttttggtgtatctagctctgactaagaacctagactgatctactagccagttactctaatacaaagttgacatggagctttattaaaatctttcattatttaagctctagatcaacatctagaggatgatgacgatgacgatgggttgcttggttccggcaaacgattacgaggacgtcggccgggttctcgagaatcctgtcgtcgtctcccgttgttgaagataatatgtcaatactcttcaaatgtctgtcacaaatagccactgtgttttgttcagattatacagtctatatcacactatatgtcacaaaaatcttctaaattttgtagtctactacagcaatcatgattgtgcactgtagtatcatgctataacttgcgtttttttttttgagataatacttgcattgttgttaaactgattattctgtctcattagggtcaaatagcatggcccatccagtattgcacgcggcaaagccgcgtgtttttttctagtgtgtcacgatattgttgcatataggagattcaggcacgcggttggccatgtgaccgtatcctcctttttttttttccgcttttgttactgcacgtgcacgcacaccggccagctgggccaggcccttgtctctccgagccccgcctttcgggctgaattctaagccaaaatggaccaggccgtacctggcctccatgctgatgggccggcctctccagctcggaggcccatatttgttctgccgtcgccgcgtcgtgcggcccgggtctcgatcgctttcgtgcgtgcattcctcggcgagatacacgcgcagcggccactggcttagctttcacagctcgaaagcagcttcccccccggagctttccagctgcacacacatcaggatgtcactgctgcatccatccgatccgagcccaccatctctgtgctttgcaagctcacgcggtggtccgtccagccgaaagcttcatcgacaaaaaaggtctggatgtcacgcaggaccaaagaacagcctccacctaattacctctgttaagtttctgcactcttgctaaactgtcgttatgttatactgttattgaccatgagcacggatactcctctcaaatatgtcacccgttctgacaaacttgcatacaacataatacggatcaagtgacgctgacagcaaaagggaggctgatatgttctgcaaacccagcatgacttgataccaacacacacagtttatccattttgatgcaaggtgaaaattgcaaagctttcagatttgtacttcgtattgagcaaacatgaagagtatcggagatttgccaacacgcaacagcaacatgaccactgcccaaaatgaataaattaatgcataacttaaaatggacacacacacacacacagcggctatttacacctcaatcactccctacgtcatcttgtacaagtggaataaataacttagatgatcgattccttcactctccttggcatcaggatcgatcatattgtgtgttgcagttctgttacagcagagtactcccttcagctggttccaagccaaaaaataaacacaaccagccctgagctcctgtgacagcatctacctggcttcaagtgctgatgccgcagtctcgacagtcccaagtaagcaggtgtacaccttctgcttcagctgctcaatggtttcaaccaaagcatcttgagatttatcaacctcactatgcaactggtcgagccagttactcgtctccttcagttgcgacaaccgaaccgcgatttgcccgtctccgcccttggagtgccctcttactcgttctctggtgttcttgttttggccctcgaacttgaatccagcttcaagagcatcttccaagaaactgagaaaccatgactgtgattctttctttagaataatccatgatctggagatctccttgaaaccatcctctctggcccagtcaatcttttcacttgtgtaagcatcgtcagagttctttgccgtactacctgcaacagctttgttctgagatgcagaggctttccttgatggcttttccttctctggccgagattctttgacaggctctgatgagtaatctttccaaaaaacactttgctgaatgataagccggtttagctgaaaaaacttggtaattgcagcatgtggatcctcctcagcggactttctgatctcagcgaatattctgaaaaacagacacagacattagttcttacgttcagtagcaagagtacagtatatagtttcaagtaaaaggtgtttgacactttggaaaggatttgcacaaaaagggaacagggggacaccaactacaccagctggaatagctgtaaaagaaacacctgagctaacagaaattcagcatagaactacttacccaaggcctttaagaagtgaggccgctgcagtagcctccctttgagcctcagctgctactacaagagcaatagtcttcctccttgcaacaacctattcacacaaaagaaatgtatgcagcatggattagaacttcgtgaagcctcttttcgtatttacatggaatggttcaaataatagtttgcagttcatggcttcatgcatgcccatgtaatacagtcatgtagacggtatataatcaagtcatgatttatgctcgattttttaaacgaagatgacctaaaaaatataatgggttaatatacctttactgacttgattagacttgttggaagagagtcccaggagacagtttcagtaactcttcgtttaacagtcggcgtagaagtaactgtaccggaagtaccattaggctttgctgccaaattgagctttggtggtgaagtcattgcaggcggtggtggtgttggtgttggtgttggtggtgaagtcttataaagctttggtggtgagtttttttcagatgcagactcctttttgctgtcctttgacatttgcttcttcactacagctgagccattctgactgggtgaagaagcgctagtcttgcgtgtgtccttgttaatttcttgttttgcagaaactatcttagcaggactgcgagatggagtatttggccgttcctgcaatattagcagcaaatgaaatcagtaaccatcctagagatgcttttgtgcttcctatctttgttcattttagaataaaagaactcgaatatagcagatgtcattcaaataccattagtacaattttgctcatctcaaagacccatagtaaatggaatgattcatcactatggaaatgcacggggattgtcaaagacaatatatagtaaaggccatgttttggctgatagtagcatcttagttcaaatgtaaattaaacctacgcacttaaacgtacctgaggttttgattcttgtttgaattttgtcggagctgacttctgatttgcagaacatatgctacttcctccattacttttgtcactatctatgctggagtttagattggtaattttgctattgttgctagatatcccaagcatgtaacgtgaagctacaactgccttctgctctttgatgactaccttcctctgagagttctccttttcactttcagacagttcagctgactttgtagccttccgttgatgagccaatgcttctgaaatcccagtgggagttgacatctgcatcaaatcctttggatttccaatgcaagggttccttcctggaacaggtcgaaccccaacaagaactgggacagggatactagattggaccttttcaacatatatgaactgtccaagttgaagtttgtttgataagatgagttcattatcctccttcgataaagaaacatacgttgagtgcgacgagtctgaaacttttataaagaaaccatggtctggccaaagttctgaaccagtgattgcaggaactatgctaataacttggagaagaatggaccgatattctccacatactttcacatcagaatttatattttttagtacttttaacagtacccctggagtaagagatgccatatcttcaagccagcttattcttcttcttttttctgaaaaaaggtaccgaataataaatcacatatgttaaaaaagggaaaaaaaacatgtaatactgcttaacaacacagtttgaccactcacaaagcatcagaactacgaaaggaaaccatacagatatttattattttgaaaaaagttagcgaataataaatcacatatgttaaaagaggccgagaaacatgtaatctactgcttaacaacacagtttgaccactctaaaggaaaaaggaaaagaaacaaaatagtctttgacaaagcatcagaaccacgaaaggacaccgtacagagatatactctagaccagaattctagagtcccaagacaagaacatttgcaatctagatttcgccacatgtctgaagatgaacgcaacaagacaaacaccaaaaggacacgtagaacccaaatcacaaggaggcctgaagcaaagtttgttctttttggtgatgtactccatattcaattagaaatcccacacatgtccttccgaacagtcgcctgcaacagcagcatatccaactagagaagtccaatcacatatcttccaatgcacatcacagagagaccttaactgaacaagcgaaagcattagaagaaaagaaattgactttatgaatgtttcttagctttccagcaaagctttgtagggcccatcaactaaaaacgcaactaataattcttatgaagctcttcatggccaggtacgtggacacctaaaaggccaaaagctaccaactttcccatttcccatgcctcaattccttagggagaggctgtgagaaatgcactgcctaattcatggaagaagacaccatcctatatgggtttcttcatttcttgacttaatggctactaggaaaggagagacctaacaagccaagaaacggcaattcttgggagggatgagcattttggtcagaatacaactcctaaatctacaacgcccaacatttgtagaggggctcttaaaccaacttctgttagttatttggcacagaaacgatatttaatgtctcatacagtcacttgcacgaaaatttccatgagaaaaaaattctccagcaaaattgtccttgtcggaggtctttggtctccaaactaagtgaaggcgttgattgacatagtaccttgaggttaccaagaaggaaagcaatcctagtacgcgaaacaagaaaccgaaaaaaaagcaaaggactaagttacacctccttgttgaggaaagaatttcttaaccgaaggattatcccagaaaagaaaaattacgaaagcaagacgcaagagaacttaaaataatctatccacagccttctctaagaacttccatttacccaatccgcgtggttttccgccctttggtccgagaacaagaaccagggcgcaccaacagaaccatcaagaaacagcctaataatccctcaattgaacaagaacacttctttctcggccacaggaggagaaacccggcatcaaattcgtgcagcgaaaatcgaaacagggaggcagctgttttggctgcggcattccatcgaacaggtggtggggtggggaggggaggagggagacgattagtatacctttcggccgcgcggagtcggatgctcggagcagaggagaggtcgagaggagacgagaggaggacggagtcggcaagcggcggttgtgctctcccgaggaggaataaaaagggggcgacgaggtagtagacgacacgaggcgaccaactgcccgtataactgtctctgacacctcgggtcagatcccccggctctccgcgtggcggccgcacgttgctgctagctcgcactgacgcgcgggcccgactttgtgctggtcactcacacgtggaccccacggaccctcgggcccacatgtcagtggggacaacgtgtggggtgggagggaggtcccgatccccggggcgagctcggaaccaaacgcagaaccggtgcggcgtccgcgtcgcagccgatgggcggtcagcccgccaccgcgcgcgccacgccaatgccatccctcgccgcggccggcggcagaggcagaggcagccagttattaggccataccgccgcgcgcgtcaaggctcgcatgcgtccacggccgcttcgccttcgcgcccgcgcgtgcccacttccaccgtcttccgcgaggtcgcgtgcacgcgcgcgcgcatatccgattgcgtttgcgtgtgcccccccaagcgcgcgcggggctgcgcggtcgacaggttgacccgggctcggctcgggttgggttggttggtgggtggctgcgacgacgcgagttcatccgcgcatgttcgcggcgcgctttcttctaccgatcgtttcgctttgttttagtggaggccacggggggttttcatggcgatcgacgtgacgggaaaagatttttcagtgcaaaagctcgtgccggacagctgcttgaattttgcaacgagattaagggagtaaagtaatcactccagaacccagtagtagcagtagtagtagtagtagtagtagtagtagtagtagtaggagtagtaccgaactgccgataattgggtatacaaacatctgttctactaccgaaatagtaactaccgtctaccagttgttgggttggtacttaggccgttaggcgtagggagcatttggtagataataaatggagatggtactgtatactatatatttgtccatcatgccgtagcaggttaggataagtgtttaacggcatcactccattaacggcttcaccaagaattatgagctgtaggtgcttatattcagcctaaagctgaagaaattggaccctgcaataaggggcaattggcttcaccaagaattatgggctgtacttatattcaggctaaagctgaagaaattggaccctggcaccctgcaataaggggcaattattttcacggataaacgaggacctaaacctctgacctcacaaaattgagaggcccagaggggttgaatcagcaatcgtgctgtgacgaaatgtcagcctctagagaaaacgacactttattccctactctcatttctgcagcggacgaacaggttgcttgtttaagggttaaaccgttttgttacagcattagtcagcttggagataatatcacatatatattgtataatctacagatttatatatgctattaaagacagttggtactccatatatttctagttaaaatggattgcatcagacaattaattaatgcaataatctcctttggacctcaacaagtactactagcagcatgaaccccacttcaaatgaaatatcataatctctgttcaagacaaagacatttttatcgtgcttgtgcaagatgtttgttgaattggctaatgcaatctgcttttggttcctcataatgctaagcactaccgtgaaatttttttaaaaaaatactgtgagtgtgagcaaaccacccaattattggaacagctccaccatccagtcatccacaacccaggttgctcaacaaatccatctcaaggtgatggcatgaccaaatcaattcgcttaactaatgccatcaaaaaagcagctcgcaggtcttatcagagaggatttctcatcttacttcgctgcaatctctccccctcataatattttctccccattttgccgcatcattgtcaggtatcgagagttcatatatggtcaacatggacattccatctaattcgtatacttctgcatatttttattaatgtcgtggtcttggtaacatcaccggaaaaattatatattgacacacatatagtggaacaatcatcacttaatcagcatatcccaagcaacctaattaagaaatcattccaaaaaaatacggcataatatccgtcatttatatattgacacatatagtggaacaatcatcacttaatcagcatatcccaagtcactaattaaaaccaaaaaaatatgtcatagtatccaaattacttagcacactgcaaacattggggctttactgttttgacatttcgagtggatgataaatggacccatctgtatctatgaaatatgggtctagtatcattataacaaagattaatatttgcagtgttataattgcaaatcccccagcaacgagataaccttttttttttttttacttgaacgcttgtgcctccgtctccgccttcaccatggcagcgtagaggccgtcgccgtggccggcgaggagggcgtcatggccgccgaactcgacgaccctgccggcgctgacgacggcgatgcggtcggcgtcgcgcacggtggagaggcggtgcgccacggtgatcgccgtggcgcgccgcgaggccctcctcagggcctcctgcacgtgccgctcggactccaggtccagcgcgctgctcgcctcgtccagcagcagtatcctcgcctgcttcacgatcgcccgcgcgatcgcgatcctctgcttctgcccacctgacaactgcaccccactctccccaacctaagcaaaacaaagaaattttagttcaacaattcaactgaaattcacccaataatcatttcaaaatggtagtttagagtaaattttacaaaccacacgtattatggtccaaattacacaaaacttcatagattttggcatatggcatagaacttcacgtatcatgattaagtttcacaaaaccacactatttaattctacaatcacatatcaattttataaggattctatccatcatataaatgttacacctgcattttaaaattttgatataggattgtatcagaaatggttaacggtgtggttttatcaaatattagtaccatagtatttagggttatgtgtcacgtgtcaaaatatttacggttttatataacttggataatttatttttttacgtaacttggatgttttatggaatgtactctataatttatgaagatatttgaatgcttagatttgaaatttttagtagttaacctgggtttcgtagccttgggggagggcggagatgaacttgtggatgttggcctccttggcggcctcctcgatttcggcccacgaggcctttgggttgccgaacccgatgttgtctcggatggacccgctgaagagggccggctcctggcccaccatggcgcactcgccgcggagccacttgaggtcaagctcccgcgcgtccacgccgccgaccaccaccttcccgtcgcccgggtcgtagaaccgctgcaccagccacaccaccgtcgacttcccgctcccgctcgcgccgaccaccgccaccgtcgtgccggccttcacccgcagcgagaagccgctcagcaccgtcacctccggccgcgacgggtacgcgaacgtcaccttccggagctccacgtcgatgggcttcccgtccttgatcgtgatccttcgcttggtggagtctccggtgatcgccggacgtcgcttgaggatggttagtatgccggcgatggccgccggggcgccggaggtgtcaggggcgaggccggcgagctggccgacggagaaggagctgaggacgaggatgaggaagatcttggacacgtcgccgaaggtggacacgccattgttgatgaagtgggcgccggcgcagagcgtcgccgtgtaggcgccgtacatggcgccctgggagagcccgaggatgacgcccatgagctgcgatctccggctggccttggccgccggcccgtccagcgcgcggttgaacgtgccgacgacgctgccctgggcgcagagcgccgcgacggtgcgcacgttcgacacggcgccggcggcgatgccgctggcgcgggcgtacgcgccgtcgtcggacctggcgcccacgttgatgagcaggttgaggtagctggcgccgagcgtcagcggcgtgcacgccgtggccaccagcgtgagccgccagtccagcccgaagcaaatgccgagccccacgccggccgagccgacggccatgagcagcacggcgtagcggtcgccgaacatggagcggaacgcgacggcgtcccgcgcgagccgcgtcaccaggacgcccatcgcgttgtcctcctcgtcgaaccacgcgggctcctgccgcatgatggcgcggaagaggcggtcccggacgcgcatggtgagccgggcgcccgcccagccgcacagcccctgctgccccgtcatggtcaggatgcaggccacgccgaggccgaccaccgccatggccaggtactccacctgccgcttcatcctcgccgtgtcggcgtcgaagtacacctccaccgcctggcccagcagcagcgggaacaccgagaacaccgcgccggcgtgtatgcccatcaagaaccccaaaatcagcaatggaccttcccgccgctgcagcctccatatctcggagaccctcaccttggcgtcctgcgaatccttcttctcctcctcttctcgaatcgtctggaagccgtacctcgacttggacaccgacacgtcgtaccccgactcgtcggtgaagctggtgtacgccgctgcagcgccggcgaggtctggcctggcgccgccgctgtcggaggcgaggctgaccagcgcggagtagggcccgcggcgggccatgaggtcggcgtggcggccggactcgacgacggcgccgcggtcgagcaccgcgatggtgtcggcgttgcggacggtggcgaggcggtgcgcgatgacgacgacggtgcggccggcggcgaggcggtcgatggactgctgcaccacggcctccgactgggtgtccagcgcgctggttggctcgtccagcagcaggatgcgcgggtcgcggatgatggcgcgcgccagcgcgatccgctgcttctgtccccccgacagctgggccccacggtccccaacctaattaacacacatattatattatctatgattaattaacagataatccgtgagattaatggttgattagtttgtgtgtgtcagtgtgacctgagtgtcgtagccgtcggggagggcgaggacgaaggtgtggacgttggccatggcgcacgccgagatggcgtcgtggcgcgtggcgttctccttccccatcatgacgttctcgatgatggaggtggagaagaggacgggctcctgcccgacgagcccgatctgcgaccggagccaccggaggttcagcgacgcgaggtcatggccgtccaacgtgatcgaccctgcacaccccacggacgcaaaagcttcgtcatcgatcaccgacgatctcgccatggtcgtgctctgcgtgcgcgtcaatggccattccctctcacctcgagtcgggtcgtagaagcgctcgatgagcgcgaacatggtggacttgccgccgccgctgacgccgacgagcgccagcgtcttggcggcggggatgaccaggttgaggttgtacagcaccatggcgtccggccgcgacgggtacgcgaactccacgtccttgaactccatccgccccttcaccgccggcagcgcccgcccgccggcgccgtacgcgtcgatctccggcacccggtcgatgacctcgaacacccgccccgccgccaccgtgccctgcgcgaactgcgccatgtacgacagcgtcagcgccaagcccctgcacacacacacaaccattccgagatcagagatcaccaccacaccaaccacgaaactccggcgaccggcgccattgacgacaacaagaagcggtgcgaggaggttgatgtgcgtgccttcctccgaccatgacgccgaagaagcaggcgatggcgtcgccgcccttgatctcgccgttggcgacgagcctggagccgtaccagagcgccagcgcccactgggagtaggtcaccaggtagatcacccccatgccggcgcccttggcgaaccccatcttgacgccgatcggcgccgccttgtccagccactcggcgtactcgccggcgagccgctcctccatgacgaacgacatcaccgtcctgatcgagctgatcgcctgctgcgccacgtcgccggcacgctggtacgatgcctaccaaattccatcaaattggtttcaaactttcaattcatcaaatttggtttcagtataagagcgagagagtgagtggccggctgctaaacctcttccttggcggtgaggccgccatagatggccttgtaggccatgccgcacgccatcatggcaggcgtgacggcgaagacggcgagagcgatcctccacgatttggcgaagccgaccacgtagccgaagacgaaggtgaagacgtggtgcacgaatcctggaatctttacaaaatgtgcacaagattttagtcatgtgtcagcttttgaacatatgtgtttgggggtaaattttgtgtgtgcgctctaccttctctcccatgacttcttggatttgggcgacatcgccggagatgctgtgcatcacctcgccggtgctcacctccgtgtcgaagaatccgatctcctgcctcagcaccgccttcaggtactctcgccgcatccgcagcgccgacctctcgccgatgatcctccagcaggtgatctctgatcgcacataattagaaactcataattcgattcaagagattcccaggaattgaactttttcatgattaatttgcaaaaatgctcaccaagataggctcctacgacgacaactgcagcaaggaacgccatgtacacactaatctggcatcgaacaagaaacgaagatgagaagatcggatttgaatcgaagctgagaaatcgaagaaatgatcatggcgatgcacgcggcgagacctgcttgacgtccttcatcatctgcgtcttgtcgacgttgacgatcttgttgacgaagttaccgaacaggtaggagtaccatggcagcgagccgccgttgatcatggcgccgacgcacccgagcacgaggaggacgatgtccatggccgtcgagtacttgaaaagccccgcgacgccgacgggcttcccgaccctcacgtcgatctcgtcgtcgtcgtcgtcgtagtcgccgacggcgtcctcgtaccggctctggccgctgaaggacgcgacgctgatgtcgtagccgaagctgggcgggtcacgccgcgccgcggagacgtagagctggtcgtggttgtcgcgcgagaaggagacctcgcgggaggcggcggcggcggcgttggtgtcgctgtacctcaccatggctcgtcctcctcggccggcgtcatggccgggcgcggagtagacggcggagtcggcgacgacgacgctgtcgtcgttgctggcgaaggaggtgttcggca

SEQ ID NO: 37986 - DNA, 12678 bp, Oryza sativa
gggcccgacggcggcgccgaggccgtggggctgcgcccacgacgtgtccggctgccaggacactgagctctgccacgacatgtcgtcgacgaccacatcccggcgccgcgggccgccgcgcggggagggggggagcccggcggcgaaggaggtggagctgtccgggacagagtaggggctacctcgccggcggtggcggccgccgccttgcgggccggagtgggagaaggagaagtcgtccatgcacgcacggtggcgagcacctggtgggcgtggtgttcgataaaaaagggtgtagcttctgatgcgcgcggctttggacggcaccggcgggaggcggccctcggattcgacactgcgcgctgtttcgttggatcgtttcgcgcgagatagccagcccgaccgtgtccgggcgagctctgagcctctcgactttgtgaagatttttttatgatggattcctagtacttctttcaggttttaatatgtgacgttgctaattttttttatacatttgatcattcgtcttattttaaaaaatagattaaatttcagaaaactacaattttagttacaaaactatcgatttgctacaataataacgtaagaacttatcacaatactacaatgtttacattatatgctactacagtatatataggtgacaactgtagcaaataacgtaaaagtttcagttttgtgataatttcacacactgttgttgtagcaaactaaaaaatatcgttaatgttatagcaaaccgatagttttatcactaaagttgtagtattctgaaatttattaaaaaaatatttaattattatttattttgtggtgaattgatttatcatcaaatattatttaagcgtgacttaaatacttttatatttgcatggaaattttgaataagacaaatgaccaaatgtttgtcaagaaagttaatgacgttatatattaaatctgacaatctgctcgtgtctttgaggtataaatctgacattgctttcagaggaaaaaaaaacttgatttgattattcactcttcttttttttctgaactgataattatgtgctgtactctctttacagttcatctctgcaggagtaaatctatggcaatttttgagtcattgcatacctagtctaaactaaatatacacagagaaagaacgacaccttcgacaaatggaggtagaaacttgttaggcttcatgtatttggtttggaggtagcgtttgtgtatttttgtgatgtggattcatcagtaaacatgtagagtctggaagggatgaaatggtattttgatgtgaccaaagctgtcaacgccaacgaattaacagcttattaaggccatcttttccatcggctgcaatttgtttgattgtctcaggaacagcgatcatcaaattcgtcagaaacacccatgacagaccaggagagcaatccaagaacatccttcagagcttcaccgaagaactgaacaacacatcattttcttatcttattcctatcttttgttcccattttgacgccgtctcatttcttgatctctaccgcgtactgtagatcgtgtgtgtgtgtgtgtgtgtgtgatagtgcgtaatacgatgatttggacaggagaagtagaagtatttgctagtacctgtacttcaaatttcagttttgtttcgtcaggtggttgtggttgtgcttctctttttcatattatgtttttgcagacgtggagtaattcagacaatggtacgctcgtcaacgctgaaacctgactgcaaaatagtttgattgtcttctgtactgaacttgttccaaatggcaaggagacaacatagttcatcagcagtgggaaatcgtcttcctttgagtaatgcaggcacatggatttgattatctggttaggtaatcagtaaccacagacgtcagtcaggttgtggaaatatggctatccaaaacatgtagcattctgaaagtacctttttctttaagaaaacattttctagcagtggtactactatgagagtaatagaagatcctaataaggaaattcaaataatccaccacgccaacactgaaaattggaaacagtgagagcattagattaaaagagtgcatggttgaagtggccatttggcagcgaagcaattgaaagcttctgcaaaatcaccagaactacgaactgtatgtctgtatatactacatcacatatgctaataatacaaccttattttaggccaataatcagacttatgtcttagcgggtacttcctccaaggtccaacagcgtttaaactctgaacgtagtttcctgaaaactattgagcttgtatatttgtgatgctacgaaatatgaattagaatttacaagggagatgtaaaggtagagactagagactgtttcgatgtcttgtgtcattgtctttggaataacagagcaaaaaagtttttggaagacaagaacagggcaaaagcgccagttctgtttttcataagaaacctgtttcatggttcaggcgaaaatttccaataaactgctgctgctgaatccctgctaagggagcataaccctgtaaaacaaccaaaagtcagaaaggcaaattaaaaaaatcttccatataatcatgagtctaatttacttatattgagtgttccaattaatagatacttcctccgttccacaatgtaagtcattctagcatttcccacatacatattgatattaatgaatctagatagatatatatgtctagattcattaacatcaatatgaatgtgggaaatgctagaatgacttacattgtgaaacggagggagtactaatcttctgtatatctaaaagccagaaatgcacaaaaagatgtgagcgtattcttttgtcaccagtggtctcaaatcgtatacaaccatggaatgtggcgatcttgagaatatttttctaacaaaatttgagtgcatacaaacttaatggattgcttgcctcagaaggcggtgcatacaaaatactatgagaagagcaaaagcaccaatattgcttttagaaattaagtattgcacaagtgagttcagttctaccaaggggtcttacctgacttccctgtgcacctccatgaagggcctgctggtgggagttagaaacagaagtgtcctgtagttgatcacgcatattgaacctcaacctttactaaggataaaaaataaacttaatgaatagttatatttgatcaacttacatggttaagctcgttatttgattgcacatgttgtggatctataaatggcacgggaacattcaaataagagctgggaatttgtgaaactcctccattcagaagttcttgattgcctgtacttgcagacttgacatccttcttccatcttttcatgaaatatttttgtggtaactcctttatatttctgaaatctagaactttcaacacatggcaacactggatacccattgcttcaaattttttacaactgcatacaacagataagtcgccagagtcaaacctaacatagtgttccccaggcctatctgttactgctactctatattcgaatgcatttccatcctctccacagctataaatcacggaatcgacaaacatctcaaactccctgcgaaaaatttcaaagaccactggtgtgtacatgttagcagcctgtctcagcattttggatggaggaattctagggaagctttggcttgcatgaaaatcagcttgtaactctgcataacgaaactcatcaagcattctttcatagtgcttaaagaaagataacaggtcaaattgtggactcaaggacttcttcaaggcatttctaacactttccgactgcaaagaactttttatatctgcagtgaatacatggcgattgtatactggagaccatttatcacgatcatcaaatatttttttaatccactcattgtttcgtagatcatacttctctagcatagtattccatccaagcaagaagttctcttcatcatcgtagtcataaacgcattttccgaaatcctttgcaaatgttttggagccttgaaagatgtgattaaggtgcttgacagagttttggtacacttgccatggacaaaggcgatgaactgttccaggccatgctgctgttatcgcagaagccgtagttgctgccatagaccaatctgtcaagattgtttttggttgctttccatttgcagcaatcttgaatgtatcaaatagccacttgaaagactcttctgattcatcataaagcaaggcagcaccaaatatggagatttgcttgtggtggttcactccaaggaatagtgttaatggtctgctatgttcatttatcttgtaggttgtgtccaaacaaaccacgtcactgtagtagctgaagtcggttctagatttggaatcggcccagaaaatgtttgtcagtttgtcatcctcatcaagctggacagcataaaagaaagaagggttgcttagctgcatgctttgcaggtactttacagttactcctgcatcaccaggttgcatatttttcttgcgctttgaacaaagagagcacctgtattctgcagggagaaaattggtatgtctaattacttctgcttgcttcaccaaagagcaactagaaaaccttgatggtgtcgctgattcttctgaggagtctgcttcagttgtttgcagctcagtgagtactctctgagacctcagcatatgcatggttgatgggggtgctggctgatggttatgatctggtacgaattcagatatacgatatttaccatcagatgtaatcttaattgacattcgtgcaggacaccctattcttgtttctggccgtggtcttttaacttccttagctcctttcttgtccttacgaaaaccttctctcgagcatacaaaggttcttgaccttgtgatgttttcagctgatttgtccgatgaacttttacgaacactgaatcccacatgtccagcgtacctgttgtagaactcatatgctttatcttcgtcatcgaattccatgctaagttctggaaccatttgtgcaaacatggcattatccatgggggtatcagaatcaataacttttcgcacttttccctgcatgtagaaaaccaaaacgacttacatttggaattggagcgagtataaacaagaagtggtggagaacaattagaatacctttgcccatgctataccacaagcattgcataaagttctccgtccctctggtccacggcgcatatgaggcgtcgcatttgcactgatgccacaacgtagacatctgaaaaactataacataaaagttaggaatcgtctcactaccatgaataattgagtccttgattcaagagaaaatgatctgtatcaatttccagcatgctgctgaatgttgatagtactgagtagtatagtagtcaccaacctgctaagtagtcagtgtgcaatactaacattccaccatatgcatggaccgacagacagcctttgataattttattgctttcataacccgatctgagaaaaggcattgatgatcagctactactccctccggacggaaatatatgatgtttcaggtagtggaattgatttgcacttagtagtatttccctgtctgaaacgacaagtaatactgacttgaggaagtgttactcttctaaatttgaatccggtctcgcttaaccataactacagaagactagaattgggaaaagaaaagaactgcaaaagggtactaaatagtactaacatccagagctctcttctctcgtgatatctcgtactccctccgtctaataatatagcaacttagtactggatgagacatttcaatatttcatagtacaataaatctagacaagagcatgttagatttattgtactatgaaatgtctcgtccgttactaggtcactatattatggagggacggtttcaaaaaaaaaaaactatattatggagggtaggccctagctacagttataactagcttggcacgttagcttttcacccaaacattgcacatatgaaatctcgatgctgaactgctgaatgtaggatacggtaaaaataaaaaagaaagaaaaattcttcacctggtaagctcatccactgtgaccctgccaccatcttcaccctcaccggcaccaacatgaacatctcccccgtcctcgaactgcatcgcttacaaaccacaacgaaccaggaaataccaagctttcttcaaaactccgcgcgggattctgcgagcaaatcttctagcgctgagcaaacccgaagcaaagcaatcacgacagaaagatcaaacaccgtccgaatcccttctccccgagatgagctcaactccagccacatcgaatcccaaatccacccagcacaaaaccttactccagaaggatcagatcgttgctcagacagagattccttccataacctttgcccccaccgaaatcgacgggctccattgcagaagtcgaaatctgccaggtttttttctaaaagagcgccgcccaggagcagatcctggcacgaggtgcgcgaaatggcgggaatcggcgcggggattggttggattcgggggtttaaagctagggtttagcgtgggggatccggattgggatttggtgcgggaggttggataccggaggcggaggagatgcgagtgacgaacgctctctgcttgccacgagagccgcctcccctcgttgtggggcgaggcagcttggtgggccgcttgggctcaactcgggtagttgggccgtaaagagcaaaagctgtctatgccgtccaagagggattatgggccggaaagccgttggtgggcttatgggtctgatgagctggcggataaagtctaagtttctagtccgatctcaactgtcagtatcatgtactttcaaaatatataatcctttaaacatttgtactttttttagaaaaaaatgcttagagtttaaatatgaatatttacagtgacagatattttaaaatggagacggagtgagtggattgtgtgtgcgattttctttggaggaaaattcggattgtgtgccaaggcaaattacctgtaaaaatagccgaaaacttagtaaagttggtgatgcaacgttgtctttcttttattgcgtggtaacgtatatacacacgtcactgcatacgtaacatcgtactcatacacccatgttcaatgaagcagaaactagcgagacatcctaaaattttattaaaacttgaaagtccatcagtttcaaaaatattttggggttggaacggaaatatgctagggccatatggtattatggcaagtcgtctcgtttccattttaacatttttagcttacttttaattcttataggcatatgggacaaggagctataaacttgtaacttggacgtttatagcttgatcataacattggtgctaagaattttaactataaacattatagttttatgataattttattgttaaatatgtggttttgtaatacttaatcttaaatcaatagttttgtgacaaattcagtgttaaatctataatttaataatacaacatcttaaatgtgaagttttgtgatagtttgataaaaatatattaagttttgtaaaaattactctattaaaaaaaggaaatgtgtgctatgctccctatcttgctagtccagggaccaaataaaacacatatacttgaacaactatcagtccattgcagcaacacttaataaacagccaccaggttaattcaagtagcatatgacagtataaataatagaatcaaacgtagataagttcacatatcaccgaactcgcgtacactggttcagtacacatgtctcgcacaacttttatggtagtctatggctcataaaccgacttgctaatacaccaacacaaattaatcaagcttgaaccttaaccggcatcgcatgccgatcccgtcttttgacgttgcagtaattttccgttcattagcctctgcatacttaccactgcagcttaagcgttcatgcgagccgggtactgctcgacgcagtccagccacgggctgcgcgccgggcggcgcacgcggcggacggcgcgccacacggcgctgttgcacttgaacccggagccgaaggcgagctgccacacgcggtcgccgcggcggacgcggcccttggcctccaggtacgccagctcgtaccagatgctgctgctcgacgtgttgccgaagcggtggagcgcggcgcgcgacgcctccaggtcgccgtcgcggaggcccaggttgccctgcaggtgctccagcacgtcgcggctcgccgcgtgcatgcagaagtgctcgaacgcgcgcttgaagtccgggatgtagggagcggcggcggaggcgtcgccgtcggcggacggcggcggcggggcggaggtcttggacgggaacaggtggcggaagagcacgccggcgaagaagaggatctgctccgagaacggaagcacgagcgggcccagggtggtgatgttggtcttgagcgcgtggccgccgacctccacgaggtcgcggctgatggacaggcccttgatccgctgctcgtcctcctcctggtacaccgaccggaagctgcggtcgtcggcgcccttgtgggtgcgcacgatgtgctcgagctggtacttggcgcggtggaagtccctgcggcggttggagagcagcacggcggcgcagccggcgcggaagaaggcgttggggatgagcatggagcggcgcttcccggcgtaccaggtgaaggagacggcctccgtgctgacgacgacggcgagccccgcgccgctggcctggagcatgtcgcgggcgaggtccaccgcgatgacgccggcgctgcaccccatgccgccgaggttgtagctgaggatgttcccgcgcatcttgtagtggttgacgatcatggcggacagcgacggcgtcgggttgaagaggctgcagttgacgacgagcacgccgacgtccttggggcggacgcggcacttgtcgaacagctcgtccagcgcggcgaacatggcggcggacgcctcggcgcggccttccttcatggtggcgcagttggtgcccggctcgaacacgcagcgcggcatgtaggactcgtcgccgatgccagacttggccagcagccgcgactggaacgccaggctatcctcgtcgaacttgcccgacttcctcgccagatcgatgaactccgccttcgacacctgcaagcaattgtccatgcaaaatcacatccttgcttacaaatcaccagctagtaccataatgcatcaaactgattacaaactgtaagtaacaagtgaaatcgaagaaatttcatgcatgcgaaccgggtaaacttggttgtttgactcaaatccatcgtgcgtgcaaggatagtgcaggttgtggtttgtgtgctcacgcaaaacatttttcgaaaagaaaatgtgtgctcacgcaaaacatttacggtttaataatacggttcggctcattgaatgtgtgtgcccaatcgcccaaccgtatttgatgacacgagcaagtgagagcgatcgactgatcgagtcaccggctggcctggccataaccgaaagcatcctaccagctcgtcataacttcgaccctgccctgcccattcacttccaaggactggggcccaaccaaaggtgcctcctaacttgcattcaagactccaacaaaataatggtagccaacaaactgttttccaaaacttagtgatgtgtagcatataagggcctgtttagttcgtgaaaagaaaatttttatatgtcacatcagatattttaccggatgtcgaaagaggttttcagatacgaatgaaaaaactaatttcataacgcggtttcgtgaaaagaaattttttatatgtcatatcagatatttcaccggatgtcgaaggggttttcggatacgaatgaaaaaataatttcataactcgtttggaaaccgcgagacaaatcttttgagcctaattaatctgtcattagcacatgtggattactgtagcacatatggctaattatggactaattaggctcaaaagattcgtctcgtgatttcccccctaactgtgcaattagtttttgtaatttatatttaatgctccatgcatgtgttcaaagattcgatgttatgttttagggaaaaaaaattggagaactaaaccaggcctaagtctgcaaagatataactagagtttcttttggagtatctactaaggaggagcttcttatcaattttggatctaatatatcatgtaaatactttataatattcagttaatattttattaccattcctttagtcaacatagagtaatcagggaaaaaagcagtggtcaaagactttacttgagaatgatggcagtatttatactaaaagtaacatacagtacaagataacagaggcactcgggcacaaggaaaagcatctatctagtgtaaacttattaggtgtagaatcaatatatgataaatgaatttgattcatacaaaatagcactacctccgttcttttttttttgtgcaatttctaagatattgctttgaccattgcacattttacaacgttgtgttaggatataatccctccgtttcatgttataagatgttttgactttggtcaaagtcaaactgcttcaaatttaactaagtttatagacaaatatgaaaaatatggtaatatttaaattagcaaattagttttattaaattaataattaaatatatttttataataaatttatcttcggtcgaaaatattactatttttttatataaacttggtcaaacttgaaagtttgactttgaccaaagtcaaaatattttataacctgaaatggagggagtaataacaagcgtatactaagtatggaagtattttttttatgatggatctaatgatataatttctaaaaatttaattcaagatgatttcaaatatgccaatgtggtgaaatctcaaggaaaaaaaaaagacgaatcacaccggttctatctagggctgtcaagtaaaatggaggtggtaatcgtatgagcgtggctcgggtatttcagtcagtgccgggcagatttgtcagtgctcaaatagtgaatgtgtgctacattaaaagcatttgagctggtagtagctggcaaggattatgaccgtattaaaggaccatgcggagtagtactagctatagacaccactataccaatagttattcacaactaaaagcccaactgatgatgagtttttttttttttgttgttgtcaatgcaagttcatccagcagttaatactaaaccctcctccaacaaaggtaagtcagctagctcataaatctccacatcagcttttgtatgatgtggaagagagagaagataaggaaagagaatgcactatctcttctttaagagctaagctactaaagaaattgtgaaacctaaagcattttatacaatgtgctatgagacaatctatgggagaggtagactttttactatctcttatatgaggtggacaagcatgagctagctcaaccattaaaggaggcccaaggcttacacgttccaagagttttctcttcacacctcaccttgaatagctttcacagttttgagatttcagctactacgtccggtaaatccaaaagtatatttgcagttttaatttgcgttgtttgattcgtctcaaaaaaaaaaaaagaatggcgctgtttgaaaaacagttggctagatcactgaaggaccatgtggattccatgaatcatgaaattcgatcctatgctagctccatatgagaccttcatttagtccttgagcactttgtataacgtcaatatatatgttttatccgatctatccttttgcaccagaaatatgcttttattgtttcagaataaaaccttggccgattcaatttacgtgagatctgaaatgttagaacgaacaagtttcttgcgcagtaacaaatcatagatcctaggagcttcacacattggcataatatgctttcatttaaacataatactagtaatataatactaatctactccgatgaactaccgaatatgtgtatacgtgattaagcatggaattaagtagtattaccttgagttcgtcggctggtttgtagcaggcgaagtcgatgaggtagacgggcctaggcctggacatgatgtagacggagatggtgaaggcgaggacggcgaggaaggcgaggacggtggcgaggtcgtaggtggcctcgccccagaccttgcgccacagctcgtctcggctgaggctgccgacctcggcgccgcagacgagcacgatgaccgggatggtggccaggtacacgccgtggctgatgaggtagtggtacccgagccgcacgtacttgaggttcaccgactggaggaagtccggcagccgccgccgcacccgcaccgagaacgtcggcgacccggcgtccggccccgacggctccacgccgcggttcacgatctccgtcaacagcagcgcctgctccctcgccatggccgcctcctccttcaccttcaccttctgcagtaaatgagaaggcagtgaagtgatgagatgattcggagactttagatatagggagagcagtgcaggggttgggggaggagatggtggtgggtgggtgggtcggtagatggcagttaatgccatttagagagcaa

SEQ ID NO: 37987 - DNA, 2062 bp, Oryza sativa
ggaatcatactgctagcatagcaaattcatggccacagctttggcttaactgatcactgactttgtagcagtaataactactcctacagaacatgtgcaaacaccagcattgtctataaagaaaaaatgtgcatggatatgctgtactctctctgttcttttcagcctattcactgaattattaaaatgaattctttaactccacatttaaaaaaaaagttcactgaaaacaaatattgtattatttagaccacttattttaattcatttgttaaatctattactcaaaacatttgattatccctataatcaaatcgatgatctactcaataatagaatcaaacagagctcaaagattcaactccatatgcttattttgacattaaacccgtttattattgagatgtactacacatgtggaatcaatcctgttactgctacaaagctgtgaatcaataactgtgttgatgggaggaggatgtacatgtacagagtgctgcacctgcactgctgcttggacactgatctggcattcttgatcaactagctggcccttattgattgaccgcgcagtggtagaaggaagaggcggaggagatttcatggagggcctctttattaggtagcggcgaaaacctgttcagctttcatgctgttctctgcttaaaaaaaaaaaactctggtgacttggtgccagtcctgcaactgtaagagtcttagggtgggtttagttcatgctaaaattgaaagtttggttgaaattagaacgatgtgacgaaaaagctgaaagtttatatgtgtaggaaagttttgatgtgatggaaaaattgtaagtttgaagaaaaaatttataactaaacaagggcttaattaaccattcgatgagatcagtgctgcagcaagctgcaaaggaaaaaggatccaaaaatatccccagcacttactgttcggtttagcatgaggcccttttcggttagttctccccaagccaatggacatgcagttcatctgtacgactgtacaatccagaattcgtcatatcatccatccatcggttcaactgctaaccagtaaccaccagctgcgccgatagtagcacttgactgattgaatacacggtccgccatgtgatgttacttcctgctaacacaattcatttcttcaccgggctgctgctttgtttcttcagacttcagagttttgccttgtatagaacacagttttacacatgaatttcctcaaagctggtgagttctagaggaatctgtagtagtaaaattaccataggcaccttgaaggaacttttggttaaaacctcctgagcgtgaaagcaaccctgagagccacttccctgactaaagaagacaaccgtcaataggtcctcaagaagaaaaattccagatacacaatgatctaagcatccaacacgaatacacgatcaagaccttcagctcatatattcgaagcaacagcgacatggattaatctacaagcacatttatttatggtggtgcatatgtgcagttgggagttctaacttaaccatcacccactagagaccggattgatctgcatttcgttacaggtatgtaccacactcttcaagaaacattggtcacgatcagcaggatagcgatcatatagtggcaccaacaatagtcagccaatgggtctttttgggttggtcagatgcatatataacactagtgcgacttgcttatgataacgagaatgatacagacaaaattaatggtttgatcagcaatttctggcaatggccttcaactacttccagcctgctttaaattggcgcagcaaatgttaagccatgatggccgtgctgtcacacagtctctacggagagaagaattgacttgatgatagatcaaaaggctaaggttgcggcattaagcaaaagccaaatgctaagctaagaaaatggtttgaaaaataaatgccaaacctgatatttgttttaatgaaaaagaatactggaccttttggcctgtatgcacgaggatgcagaaactagagatataaaacacttcttcatcatcttgat

SEQ ID NO: 37988 - DNA, 15095 bp, Oryza sativa
ctccgtccaaatgagcatcccatatttttcgaccaaaaaatgagagagaatctcgtatggccggttggctgtatgggagatctctagtgcagtaagaacattcatggttgcaaccatccaggaaataaatgtgacaccatgcccccatgtggtagcattaagcccttcctctgatagccatgtgagcttgtttgtagcagaggtgatggatctcccaatagactggtcacttttggtcactgaacgctcaagtgaaatattaagattgtgtttagttcacactaaaattggaagtttggttgaaattggaacgatgtgacggaaaagttgaaaatttgtgtgtgtaggaaagttttgatgtgatggaaaagttggaagtttgaagaattattttggaactaaacacggcgtaactgtttgtgaacaggaatgaatttttcaatgttaaatctgtaaatcatcagtggaaataagcagaatgcattctacagcaatttgtcatcttgaagctagtgttaagataaataaacaatattccctctagtaaaatcttctaaaatagcatattaaaaatggagtacatgctgcaaggaatattattcgccttccttaatgttgttatcaaaagacgaccaggtagatagtatatttcttttctactgcatacagcagcagaagcaccaccaccaccaaataatacatgaaggaatgtaactgggacctagtttcatcatatacacaagttgctagattttcaagtttttggcaagaaatgagcagtacagacatacagtacgttaaaaattctgacactattttaaagtcatcagtagaattgctggccaatgtaagaatggattatgttagcaggaagacaaaacagagcattatcaggtattatcacttatgtcagcaggaagacttgtactttatccttttttacctcggtacaaaccttagaccttataaaagaacaagacaaacatagacaatccagttactcctgaaacacatctaatgggctacggaatgttcttttcttaaaaaaaacagcagccacaaagaacacttaataaagcacatacgaaaattaatagcacctagagcaaataactaatttactggagtaactactccctccatttcatattataacgcaattttggtttatcttagagtcaaactttttaaagtttgaccaagttttttaaaaaaagtggcaacatctacaaaatctctgtcaataaaattatgtactccgtactacagtatgatctcttttgagtctctagaaattatccaaacagaatttcttaccgagcactagagttcaagttccacacttccacgttggccggctgttcagcttcttcaaaacccttttggaagtcttattatgacaccataaacaaaaatattcccttcttacagcacacagttaactatgtgtaaataaagctttcaaatagccgatgacaaatagtagcgatgtacttatctgaatattgaatccatcaccaactggaaggctagaaaactgaattcagacatagcgattactgttaaaacaaatcttgcttgacgtttcataacttcaatatataatgctttggcacaattttttgcaaatatcatcttctgtgaataaaaaaggaagaaccaactgatctacataaacataaagtacgcatggtttatatttttagcaataagcaagaagtacatatccaatcagcaagagtttctatttaagccccgggttaatataaagaatccaaatatgccatgagcgagggagtaagagaatataaccattgccctaggatcacaagaatttacttttggagcttgattgttagggaacaaatatcaaaaactgctctttaaattaatggatgtcacttattcactctatgcaacaatcacttagatcccctacatccatctcagtatcatctgcaagagcgccatcatccatgatatcatctgaatcttcacttttgacatccaatatagaatcagtagcactgctactatcatcattaccaaacaaatagtcctctgaatcaaacaactcggcaaatttaccaagattcttgatcctccctctatagctggtaagttgaagaactttttccttccacctcaccagtgggcacttctctatcaattttgtcccatcataagacttcgtcaagaacacgctaaaccgcttccccctctcatacacataaaagatgccataatgcttcagaagcagcctcatcaacttctgcggcataacaaactcacgacagaaatatgtgaggtgatcaatcaccagcctcttttccaacgtgaagttcagtacctcgtgcatcacagcaactgccctcttatcaaattcaggcgagccaggagtcaatcctcttgcctctgaataaggatataggtatgttgtcttctgaaactgctcggtattcccttttttcacataatgatgaacttttccgtagaatttgtagtaacttgtaaaatttggtgggaacttcatggggaatgatagtgagagctctcctggtggactgccaatgccgttagcatttgcatcaccagtcaatgctgctgtctttttctcgagctcggtgactgcccagtttgggttccaagagacaagctccaggtaatcgccatcctccaacctgaccaccctgaactgctcggggaacatgtgaacccatcgtgtcttgaaatcatgaggaagccccatgtcgcgcctgaaatgtgcaatcttgtcgatagccagacgacggtccaccgacatcatcagcagcctggtgacgtactcagcggccgtgcgcgagtgatcctccagcaggcgcgcctcctcctcgatgagcgcctcggcctgcggcgagaggcccgcccacatgacgccgcggctgtcgcggcagacctcgaagagctgcggcgagcggctcacgaagtgggcgaccttgttgggcttggtgagcccaagctgcgggcgcaggatctcgaggcgcttgagcggggtgacgtgctcctcctccttcttgagcgcgtcgacgacggcgagcaccttggtgagcaccttccaccgctccgtggccacctcgagcgcgtgcacccgctttttcttgctccgttgcctcacgttgcggctccgcgtcatcccccgcgcgaaagataactgtgtggggcagcagaatcagctctggccctggcgctggcccccgcggcgcaacagcttggctagacaatcccgcaaacaggtggtgcgcatggtgtcccgaacggctggaacgggcatacacgggagtaacacgatggtacgaacgcgaccggagcaggaagtgacggaggacggcagctatcggcgcttctagccggcggcgagaggaggaggctgggaaggggcagtgggatggccggaaagaggaagggggaatcaagcggagcacgagcctctacaactgaaaggacagcaatggcgatgcttaaaactagcccatgtgtttggatagaaaatctagcccacagccttattgggcttgttaggtttgggctaatccaagaaatattttcaatccaaaagcctataatattgctgtttaaaatccaacccattccttgatgaattcagctttgtgggacttctcgttgtaccacaaatctagcccgatcttattttgggtctctctttcattgaagcctgtaacattttgctatccagaaacatctactaattctacatttcaccatcgagttttaccaaataccattatacaaacgattttattttagtggtgccacgtctccttgcccaccgccggcttgtcctcgattccttcaccagacacctccgttgcgtcctttctctggccgccacgacaagctcaacctcgcataagacgtcatcagtggcttatcctcaatgcgcactcccacctccacctcatcctccttgggcaatcggctcatccttacccaaggcattgccactggttcaattccccttaggccaccagctgcctatatgtcctcgcatatcgacaaaccataaggtttccgttgccctcagttaccatgaccgcgcgaatctagatgggatcaacacaatcgaatcgttggatgcacagctccaccataaagccgagtggcaaggtgagtccaagcacaaaagcaaaatgatctttccacatgggctaataaaacgctatggaagtatggatggaaagacgacaaatatgacggtagtggcattttatagacaaactttgtacttttgtagatattacactcgttaatagaaaaaaaaaaggagaagaggttgacacttgtggatgccaaaacttagattttctcaaaaataagccatgactgaatagctaactagtatcccgcacaattgtacaaaagcctacgccatatataaaaaaatagtaatagcgcctttgattcattgccatttgtaagcttgtaacgttatcaaatttcggtaatatcaaacttcttagtaaatactaaaacaaactaaacaaaacttaaacaattcgaccattctaaagttcagtaactccagaaccattcacacttaaataccactcctaaattatggttagacttattttagcacgaaactaagcatacccttgttaccactgtcacaaaaccaatgtcttcatttcgtacagggtaccttttcctgggggaaatatcccatatcacagacgcccctgtgccatggcccatggacaacaacgctttcgttcaccatgtagcagtagaagatgccgagatgacgtgatgtgcaggggaatcaactcggcaagtgttgaattcaaacatgtgcgttttaactgtgcgtcaaatggggacgccgatttgagctctcaccagatttatctctacccctttaaattatttctcgttgtgcttcggatgttactagtgctatgctactactatagtatcagctcgttgttttgattatacttataattctaaatttaaatttattttttaataaaataaatatattttaaaagtaaattttctagttgattattgtgatttttaatcatagtttatcttaaaatatttatttttaaatacctaagaacatatataaaaaaattatcgttaaattattttttattgctaacacataatcaacaataggtcttgctattgcactacgtgtctacaggtctcatcttttcgtttatgtttatgtttagtagctaaaatttaaatttttaacattaaataaacattaaatttgaagctaattttgagtttttttatcgaaatttatttttcagtctttgtttttagattgctaagaacacatatataaaaattttattcataaattatttttcgtttacaaatatatcgtttggcttattccacgaataagctaacgatgggaccgtactaggggtgaaaacagtacggaatttttccggattccggtcatgttttcggaaacggaatcggccggtcggaattttttcggaatttctcggaatcggaatcgaaaacggaaatattttctcggaaacggaatcgaatatgataaaagcagtttccgtcggaacccggaaacgatcggaaacattccggaaaaattgtcggaatttccgaagttaaaaatcccatagattcaatagtccataatttatccctagcttcccagcccaacccaaatcgcggcggcatctaccctaaccggctaaccctataggagagagaccgtcagactcagaactcagacgcgactcgcgagttggaggcggagcggcggctgcggcgtccagatcgcggcatcgcggcgccggcgtgccctcacgcccaccgcccgtggcgccggcgccccaccgcccactgctggtcgcctggccggctggcccccgccgtcctcgcccccaccatctcgcgccgcccttgctcttcgtcgtttcgccgccggccgccgccaccatctcgcacctccgccggcctgctcggtccccgccatctcaaggcgccgtcccaccgcgtctcgccgtttcaccgtcgccaccaccgccgccgccgacggaacaaccaccacaccgacgaggcgacgacgacaccaccactgcagtctcttcctcactgccaccaacgccgacggctcctcgcctcgcagcagccagcagcccagcggcagcatctgagcaaccagcagcagcaggtgtatatagtgattgactttgcacttttactaatgctctatcattttttttgaaggctaatggaacggaacaagagacagagacagtagaagcggaatgttctaatgaggatggcattgcgccaatggatgtttgaagaaaatgttggtcaatttaattttcaagttacatctaatttcaagtttccatttcaaattagtgtactcctgctgcacaagtggatgagatatgtttgaaccatgtactgatgtgttttgtgattgaactatgttttgtgatgaactatgtatttatagggtgatgtgttttgtgattgaactaagtactgaaacactgatggactgatgtgcgttgctgttctgtgatgattgatgaactattgctgttctgtgatgattgatgaactaagtgttgatggactgatgttctgttgttgttctcaaacccatttcctggagtgataggctgatagcagtatagcacctgaattgtgtataccttataggcttataccattctgttttgctgtattcttttagaatatttgttatgcaaattatttgaagttatagaagaatatattttgctgtgaggctcagtttgaggggtttatgtattccgataaattttcgttaccgtatccgcgccggttcgtttttgctccgttttcggtttcgataatattcgtttccgttttcgtttccggggtttccgatttcgattccgattccgaaaaaaaatatgaaaacgaaaacgataaaggttgtttccgtccgtttccgtaccgttttcacccctagaccgtacgtttgctggtgtgccggtatggcggtatactgtagtgaaacctatcgtccaagaaacctgcctcttccggtcatcttcaggcgtgcgagtggtgtttgtttggaccagataataaaagccataatccaatttatccaacgcgtggtgcgaacagaatagcagcgacactcctgtggttcgccgatccaccgtgcagccgtacgtgccaccaatcattttccagccgaaagggtgtgtgagtgtgtgacaaaaatggccagttgcttcgacaaaaatgcaaccgtggttcatagctatctcttggaaggacgaaaggaaaagcaaagaacacggagaatgtcgatgcacatgctgcctgtaatttgtctctctctcccacagctagcgccacctaaagttgattgaaacccgactagctatttggagggattagaaaccctccccgccggcacgaggatcaaagtgaaggattagcacatactaccataaatataaaagtttaagatgtttttgccacaagttttcgtatgtcgtccgttttcgattcgtactgatatcgtctacaaagcgttttccccatcaaacaaccccgccatgtaaatcgaatccgtttccgtctagagcaactaatcagcgaggtccgtaaaaaaaaactaatcatcgagggtgtgaggcggataattaacaagaaatattttaacgcacaaactaatgcctggctttcaaggagacctcatgcttctgtgatatcatacacagttgttcgctagagaaattaataactaacaggagattgactcgactttctgttaacgttaatattaatatttctaatcctataccccactaaataaaatatttgagaaaacgtcttttttattcttcgaccttgataactcttttgatttaatgactggtctcaggattgaagtaaccgtcctgaccatgcctggtttcgtctaacaaagagcagttggagatcacacactactaaaaaccgaagtgctttcgttaaacgttatacacgatttttgtatatcgtcctcataatgaaaaattaaactagactccagttaccctaaaaacaataattctctactcctattcgttttccgttatgagattgtcctcaattcttggttccatcttatgatttttctttcaatttttaggttgaagactgttattattattattattattattattattattattattattattattattattattattattattattattattatggtaaattatgaattgcacataagattactaggtctatttgaagaatatatttttcttaaagagctgatattataaaaacgatatctaatcatatagtaattattataattttatttttttccattgcagcgcacgagcatatttgctataacaataataagattaaaatagacttcatccattgcaacgcacgggcatcttttctagtatatataaatgtgagcaatgctagaaagtcttataatatgaaacggaggaagtattagttaagcattagctaaaaaacttaaaaagggattaatttgatttttttaaagcatctttcctatagaactttattttaaaaatatattgttcagtttaggaaacgtgcaaaaggttgtaaagaaatactagtaagtacaagttgggaaagtatatttgagaagacacttatggccaggttggtacagaatgtactcctacgtttcagctgctagatattccttcagtactagtactagattacgagtgtgctattatcggagacgaaaattcatcaaagcaagtaaatgagcagctaatcacacgtctcaaaatgtcacgtaagactaaaaaatggtgaagtggaggagagagaaagctactccttatataagggtcaacctctacataaaacttcaataaaaacataagagtattatagctattggtagtacatattacctcttaatttattatatataacgtgcatcagattaaaggtggtagaagctatctctactataaaacttgcactcaggttatcgcatatagtattaaacaaaccatacatcagttggctgaggtcgttcactatccatgcatattcgtgtaagttaacttggggtgtgtttagttccacgctaaaattggaattttgactaaaattaaaagtttgaagaaaaaagttggaagtttatatgtgtgtagaaaagttttgatgtgatagaaaaattggaagtttgaagaaaaagtgggaaactaaaccaggccttggtatttcaaataaggatgaaaacatctttgattcctcgcagaaagcacttgcagattaagtttctaggaaagcacaagtgatgtggtactgaagtcataggtgcatgattccatttaccaaacaattaatattacacacacgtagatgagttttcaacagacgtgcgaaatggcatatttgcaaacaaaaataatttgtggataaaacttttatatacgtgttcttagcgatctaaaagtaaatacttatgaaaaaaaaccccaaaatcaactccagatttaagattgaaaattcaaattttggctgataagtataagcataaacgaaaagacgaggccgagaattttagcgagattagagatatgtcgttagtttccatctattagagtgcgttatggagcacattcgtggggtgtgagtgtgatgttgtgtgtgtaatgttgagtgctcctatgtgtttaccgtataataaaaaaaagagtttctatctcttgcttaaaatttttcagttaaaagtttatatttgtgcttaaaatataacctattactggtaacaggaagagatttccgtttccctacaaatctagcccagtcttattttgggctgccatttcgatacaagaatggtctgtgacttctgaaaaggaaagaaaacatagcccaataattgataattgttcctctgtgcagttttaccaaagcaatatcagtagctagaagagccatgtctacctacatcagtagctagaagttaattctggatcatgcctttgtctgaaagagagtatcggtgtaatatttcagtattatcaaactttagtaaagaaattcctagcaaaaataattagtaaagaaacaaactaaatattgcttaaacactttggggttgatccgaagagattgctgcaactgtgcagccgcaacaacaccaccaaacccaacataatttttactgcctgcactgtaatacagcacacccgcacggccgcacccacagccagctgcaaagaaacacaaacgaacaaccattccaaaattcagtagctccaaaagcattcgcaccatgtctctcttcacactaataccaaaacatttggtaagatctattctaacacaaaaccaaatgtaccctaacccgtgttcggctacatgatggccgtcgttccgcagccaatgcagccgttgttgctgacacaagtcactgtatgggctagttgagttgcaggcatggctctgttcgtttgcctgggctgagaacccatccctccggcacggaaaacatagcagtctattagtatgtgattaattaattatttttttaaaagaaaatagatcaatatgatttttaagcaacttttgtatataattttttttacaaaaaatacaccgtttaacagtttgaaaaacgtgcgcgcgaaaaacgagaagtaggagttgagaaccttgacatacgaacagagccataggaagtacagtcaaacaaacctataatttctataatttctattaagcctagagtcccgtcggttggcctaataagtcaaaggaaaaaccatttttttaacttaaatttttgagttaattttaagatatttttagcatatttttttggcttttttaaatcgatacgaacaaatatataaaagttttacctatatattagtttttattctgaataagccgtttggacttattaggtaatatcgataaccatgagacccgtaatataaccaaattccaccattccttcaattttccttttatgggggacatatcacatacatatgacccttgtgacccatggacaacgacactattgtccaccatgtagcagaagatgccgagatgatcaagacatgttaaagggactcccctcatccgtgctaaattaaaacatgtgcgtacaactgtgacttcgaacagaaacgtttgttttgagctctcgctagctttaatatttcgctgtgctttgccacgctactctcctaccacttgtttctctgaatacgtgtataaaaattgtcttttttaagacagaagaagtacatcgcggtgtgccggcaacctatcgtccaaggaaacctgccgccgtttcccgtcatcaccgtgcgatgcttgtttttgaccggagaaagggtagtattggggtgtgtttagttcatgttaaaattaaaagtttggttgaaattgaaacaatgtgacggaaaagttagaagtttgtgtgtagaaaagttttgatgtgatagaaaaattggaagaaaaattttggaactaaacttagccttggtgcgaacagcaacgaggcaacgggcaaatgctgaggcagaggcgagcgcggcgaccggcgtaacgcgtactcgcgtctcgtctggctcggcacggccgagtcaccgtgcaaatccatccttttccagacgaaaggtagggagatggagagggagagatagtggccggccggttgcttcgatctctcggcaaaaaactgcaactgtggctgaaaattatctgtcggaagaaagggaaagcacccagacccgagccataccgatctttccctattgcacatgctgtaattgtaattggtctctgagtctctctctcgcgcgcacacatgacacagctagcgccacctaaagttgattgcaattttgcaacccaactagcagtctcaggctggtaccgaaaccaacaagaggtgtttcagctgctagatattttccctcggccctactggattacagtgtcagttttgtcacgtatttggagcagtatactactaactccgtttcatataataaattattttaatcttttcttgatctaatcaaatttatttaggtttgattaagtttataggaaaatttgataacatatatagcaccaaaattagtttcattagatgtaacattgaatatattttgataatatatttattttgtgttgaaaatgttgctatattattctataaatttagttaaacttaaaaagaataaatagaaaaaaaagttaaaatgatttacaatatgaaattgatggagcacgtaccagtactattctcagagacgaaaattcatcagggccatcgcccagattaataaacaaccgtacagcagctgtctagctgaagtcatcgttttttctaacatcagtcgttgaattctcacctgttgatctttcaaataaggaaaaaacatctttgcttccttgcaggaagcacgagcaaaataagttcgactatctcgaattaagtttttactatctcctgctgctgtgcctgtgtctcactgaccaggtccaaatggtggcacacatgcatgcatatttcttgcaggaagctgatctgaacttggaaggaagcaagctgcaagcattagcctgcacatattcttcagaagcgttttgactttgcagtcgtcgccttggccttggctagctctccatcggctgctagtagtagtattattagtctgagtagtttaattaattgtttaaggacgcatgggtttgactttggtttgtgtttcacgaagaacaaataacacttaattactcctccacatacagtgctccttgtggacgaaacatgcaccacctgtgtttttattatgtctcgatcgatctctgaagatttgcagagagattttgatcatcattaaagtgaatccgtgcaggcgaccgtgtctagttaggcatgctgcctagtttgacattttttttgggggttaattctgatttctttgccccctaaccgccgtgtttttctggcaggcaagatccaatcttgacttctaagtgtgtatcagtggcgctgtctaaccttttatgggttgttttcagtgcagaaattggacaatgccactattaacagtacctgatagtagtactactcatggcggcagagctaattcgtttgcttcgaaataaatcatgacaatgatccatcagacacaaagtactaatcatcattgcatgcctttagtaaaccataatcttcttttttttctattgtagcagcggttcgtttcaaccagaattgattcatgagaagattttatgtgtgcggcgccattatccctgttggaatgttcaaatttcttgcacgaggcaggaatcggtactctcgtttttgtaggataagattcctcgactatatttatttggcacatgtttggttgcaatccaaatacataagagttattacctttgtagttatcaatgattcggtagggcaagttttggagtcgaatcaaacaatccataaaaatatttatacgtccaagtagagttcaatggtataaagttcaaggaatactttccttatctaaaaaaaccaaacatgacccatccaacatcaattagcccctgccagaacgttcaaactaacctactcctacatgtgaaacgaaacataaaaatgttcacatccaaataacgttcaatgatgtactactgtactagtactaaattaagttcggcatgtaatcatctttccccactataaaaaaaatcccaaacatgatggcacgtaactcgtgtcggcaaagcacatcaagaaagtaaaagcaattcgtatgtataagagcaagtttaatagtatatatagctaactagttacatattacattattaatatctggtcccacatatcatgcacatagtgtgttttggagtctgtgctacagctggctataaatctgtagtccgctgtttttctctctcctcatttatcttattaaaatatatttgcagctggcttatagtatgttattgtacctgctctaagaaggccaaaattataaaaaatttgcgttcaaatcggttagatgatccgtcgatctcgaggcgaaagaaacgtggtcggaaccgaccccgcgcagcaggtcgtcgagacgactcgctatctggccacgtgaattttcagcacgcgcgattgggcgggccatacgcctaaatgtggacgaggagaagaagcgattagcttgctcccgattccaatccacacagtgtcgcgtgtattgacgcgtacgcaatcctcccgccacatgctgtgccccgtttcatcacgtgtggcttctttactttcataccaagcctaattaatttttttggtgtgtgttgcttgatctggagtaattcagtggtaattcttttggaattattttgctagttgaaaaattaaccgggagagagataattttttttgttgaggtaacaactaaaaagttggcttaatttgcacaggaaagaatatttgatacagtgggacaaaaaagaacaggcacaaggggtttcccatcaattcaatctccctatcgaattttacaaagaagtatagcaaaagcggtaaaaactctacgtcgccatgggtatgagcaaagtgaatcaatcctcttgcgcgctgagagcgcgcgcgcgtcttaagtcgtttttggtcaaagccgcgcagatcacagcgcgatggtgaggctgtcacggcgcgcggcggcggaggcggaggcggcgaggtccagccatgaggtgggcgtcttcttctcctccggctcggaggccttggtctccgccggcgacgggcgggcgtagggggtggtcgccgcgaggcggtccttgcgcttggcgaagaaccgctgcagcgacgccttcctcatgatgggcatgtccgcgagcgcggcgccctcccgctgagccggcgccgccgccatcccggaggaggccatgcgcatcacctccgccgccttgtccgcggggaagtcctcgaagacgaccatcctcccaccgtagaagatggtcag

SEQ ID NO: 37989 - DNA, 1479 bp, Oryza sativa
attcctgcagcccatgttctacaatagtctacgtacactggtgtggagaaaccatttttggtcggtcgaccaaattccataatagtcccggttccattaaaaaccgggattaaaaacgatttttagtcccggttaaaaaaaattgatccaaccgggactaaagatgatttttaagtcccggttcatcccctatcagaggcatgccagggggccgaggatctttagtcccggttgatactaccaaccgggactatagatcattttagatctttagtcctggttggtaatccctaatccttatcctctcctccacaatcacaaccacttcctcacatatcgatcctcctctcttctccccctcctcccctctcctatcttacacagatcctccccttcctccttccttcccccttcccttcctcctccctcccctggagacggatgaggccgctcctccttccttccccttcccttcctcctccctcccctggagatggatgaggccacgccgcgcggacgaggtggacggacggacgcgcggcgtgcggcgcagacgtgcgttgcagggggagcacatgcgcgcagacgtcctccctcccccaaagttacttgttgtctctttttttttttgatattttgtgattcactgatatgtaattttgtgattcattgtatggatttgagatgtataatctgtgatgtatttgatttgtgtgtaaattttttaggatttgtgatgttttagatttgtgtgtataagtaactttaagatttgtgatatggatttgggatgttactttatttgaggatttggggtttaatttgggatgtgcatgtcaaccgattcgggagaaaataaaaaagtaacaaaaaaagaaaaggggaccatccgggattgtccctatcctctctttagtccgggactaaagatagatctttactcccgggtgaaatttactctcggttatttcatccaggactaaagatagcgatctttagtcccggattcacagtccccgctttctaaccgggattacagagggttacaaaccgggagtaaagacagtttctctaccagtggtatatcgtatattgccatacggcgacgcgtgcatgttgccaattcatcaccgttggatgggcaggtgatagattcggacaccggcgtcaatgttgggcaccaaatcgcggcgcgaaacgcgtgctgatgctcagcacgtcgttgataattaattttgtttccccttccttttgataggtttcggacgacgtcgtagtcatccacatgtacagacgtacacagtcgatcaacacgcctagtgtttaataacacacgtcttacaagattatttttttcttttttgagaactaagtataagattagttattagagacgtcgacgtacgtatcatcacgtaacgtggccgaatgtttccagcctcaaagctcgaaccacgtacgtttagacgattagttaaa

SEQ ID NO: 37990 - DNA, 957 bp, Oryza sativa
aattcctgcagccctggtatcctaagggttgtgactttgagcttttgggctattccgattcggattatgcctggtgtaaggttgatagaaaaagcacaaccgggacttgccaatttcttgggcggtcccttgtttcttggtcctccaagaagcaaaattccattgcattatccaccgccaaagccgaatatgtcgccgcggttcttgttgtgcccaactcctttggatgaaacaaactctaaaagactttggctacaacttcaccaagatcccactcctatgtgacaatgagagtgccatcaaaatagccaataatcccgttcaacactctcgaaccaaacacatagatattcgccaccactttttgagagatcatgagaccaacggagacatatgccttacacatgtgagaaccgagagccaattagccgacattttcaccaagccgttagatgagaaaagattttgcgagcttaggagtgagctcaatatcttagattctcgcaacattaggtgataggtggttggctaatttatagtcaaacatatatcactaaaatgtaaattttaaaaataaaaaaataaaaaaaaattgtcttgagatcacttcttggtagaagatgatgttgataccaggaataaagctcaaacattccccctttatccaaaaaccccttttgtgaaaatttttgcaaaatcctttgtgtgccttttattgcgaaaatttggtttttatccccttcttgtggtgtatattgaccattgttatgtaatgttgattgttggctggtcatatgcatcataagtctctgcatgtccatagttctctattttccctcattgaactctctcttctccttgtttttgggcctgactgccctttatctgtcaggccggaagttccgagcctccctgtctggaacctccgggtgtcggggagtatatattctcaggggg

SEQ ID NO: 37991 - DNA, 2253 bp, Oryza sativa
caaggtagcacgtttttgattccctctctcggttcattgtgtttttatctcgatctctaaatctgtgaacctagggagaaaaccacttggatagtcttgtttctgctaccttgcagatcaccgatctataggatttgttcacatgcattggctatttttgagacctctgttcttcatttttgccggccgaaagttccggtgttcttgcacccggaacctccgggcgctgtccagccaacctaccattcttgcttctctcaaattctgcctaactactgcactccaatttgttgattcctgttgcagtaagctctatgcctcgtgagaaaagacagaaagcctctcaggatgtgtccggtgatgagagtcctcctattcggtttcctcgtggtcgtttgggtaaagagaaagtggttgagggcggcagtggcagcggcactcgtacttctcctaggtttaccaggcaatccagcaaccgttcagttcagattcgggatgttgacagtggtcaagcaagtgatgctcctaatacaagaggtcgtgggagaggtggtggtcgcagttctggggctgaaagggcctctcatgatttccctgttggatctcgtgagaatcccgttcggctctacaagactcttggatttgacaccactcctatgcaccacattggaagacccaagtccaactaccttcatcagcttgccaccaactaccttcatcagcttgccaagtgcagaagggaccgtttgattgatccagagacacagcctgaggagtcacaggatcctcgtttcaggactttcactcaattggattggtataactcagtgattatggccagagaaaatccagtggttgagatgaagtggattgattgggcttacatgaggaagaagaacaatgaagtgttcaatcaagtgatgcaagtgtgccacaacaagaatcttggagatattcttgccttggagtatgattggaatgaggaggtcattgcacagttctatgcgacagtattctttggtactactaggaaggcaactccttatgtgaagtggttgactgagggtgttaggcacaagatttccatggtacagtttgctgagatattgggcttagaggatgaggatctcaataggcctaatattcatagtgaagcacccctccccatgatcaagactaagttcatgtatacaaaggatgctcctaggacttgcatgggatctactcatggattgcatcccaactacaaggtgttgtactccatctttcgttggtctttgcttccaaaggttggagatgctactgctttgccatccaagcttgctcatcttctcagtcgcatgcgctacaatcagcctcccttcagtgtgatgaaattgatttggtatgagattgccaacaccattcttgagcctaagcggggttgcatctatgctcctttcattatgaagatgattgagacagtcactggggtgttctacatcaaagatgggcgccacaatccttttcgtcctcgtgttccaccttcctcttctccagtggtacatacatccattccttctacctcagctggtccttcttctagtgccccaccgagatcctcgagttcttctcccatcaagaaggcacttcaggcaatcttctgtatgtgtgctaaaactgctatgaaagtgaagaagattgaaaggcatcagaaggaagatagaagagaggttgggaaagaagtgtcagatgattctgaagatgaggtctatgttgatccatttgaggcttatgaggcagcccgcaacgttgccggtgaaggtccatccacctacttcaatgaagagtcttctcaatcagatgatgatgatgatgatgaggatgacaccgaggcagctgctgaggatgctcctactgatgttgatgagggcgacaccgctgcacagtccgatgagtctcatctctccggcgataccgagattgttccctcagatggagatggagatgagtgatcctcttcttctcttcgtggtttcttgctttttagtgccttgatgccaaagggggagaaattgtgaattgaagggggtcatttaaatctttttgctgccttgactgtgtctagtcatttggccggaagttccgggtctgtgatccggaggttccggccagacagatttcctctctattatctccaggcagatttcctctctattatctctctctctctatggacatgtaatcatattctattatggttggatgtaatga

SEQ ID NO: 37992 - DNA, 1690 bp, Oryza sativa
atgacaaggtggttaaaggggactaacgtgtttatcaagtttattcacaggagtttagtcccaaagcaagttgtgatggctaagaatgcaaggagaccccccaattcaaatgttcctaagtgcgaaaatcaccgaaggtgattagactaggtttttctcttttgaaattgagtttaggaaaatccgtactattaagaggggtttcaagtgtggttctagggtatacaaagtgctcttagtcatatccatgagtcaaaatattttttggaatcatttttgaaaaatgattttctccccgggacagagagggctacccggaggttctggccggaacttccgggcaccatttcattgcaaaaaatttcctaagtgctgcccggaagttcctggcacttttgcccggaacctcctggcaggtttccagttcaagcttgtgagtagcggctagatgacgtcacctagccgttatatatatggatttcgttcccaggtcactctttggctattccacttcagttctttcatgttctagggttttctagccactaccaagcttcctttgcttcctccactcaaatctagagcctatcttgtgagattgagagattagatgagagtgtaggagtgttttggagatggcttgaagattaggtttgtttgagcactttggataccttgtgggctatcacttaggcttattactcttggagatcttctcctagacggttaggtgtcacccgtgagcttccaaagatcttgtggatgtcccgggaaagtttgtgaaggttttcctcacctccgcaaggaaacgagataagtgagtaaagattattgtgctgagttttcagaggttgtcctaggtagagcaacttgcacgtgtggtcttttttgaaggaattgtgagttggatcttggtggtcactcaattctagaaaacgacctagaagtgttgagttgaaggctgtggacctcttctgggatctttgcataagtgaggcaaggggttaatcgagacccggctctttggagcacctcaacggagagtaggatccgtgtgatccgaacttcgggaaaaaattgcctttgtctcacttgtgcatgatctgtgtttgaatctgctggtatcttgtgattttcatcttgtgcatccctgtgcctgattttccctagctaggacctgtttttcttcttatatttcgtttatctgtgttgcccggaagttcctagctcaagaactccggaagttccgggctactcatcactgccaggaagttccggtgttcatcaccaggaggttccgggccctgtcattttaaccgctgcgtttgttgagaaaatttcaggaaagcctattcacccccccccctctaggcaacatctctgcacgttcatcgcaggattgagaaaacgtaagaataggataaacatagaattttgataggaatgtaagtgtaaaacagaggattgcaaaatgcaggaaaaacacaagaatgaccgtttgattgaaccgcaggaaaaacacaggaattggatgagagaaatagactcaaaggaaagttaccaagaggttgaagctcttgctaaatttcctccaaaatctctatagtattgtccattccataggaattttaaatgattggatagaattcaatcctttgtttcgaagggtttcataggaaattttcctata

SEQ ID NO: 37993 - DNA, 5753 bp, Oryza sativa
catattaacaaataataactccactagaaaataaaatcatccatataaatatatgatggcctaggctcacgagccaaatcgagcggctcgcgagccagctcaggcttggctcgtttcagaaacgagctgaaaatgaggcttgggcttggctcgtttggcattcaagccgagccgagctaagcgagctcgaaccaagcccgagctgagctcacgagcctaagcttttttttcacccctaccgccaatgcccaatgctacgtccttgaacgatagatagacgacgtcctgcatgagcgcttaggtacacatcaatcataatgccctatcacctaccgtctctgttgggggaactaattaaaattctaataactagctggttagtaaaccgcttatgagaatccagagaagctgaaaaatctagtttctgatgtagttcattttctaacatctatacctacatattctcagaatttggataagagggagctagatcttctagaagaagttgcaatagttagaagttctcctaaatagggctatagatgcgtactgagacaacttcatttcctaaatttagattcatccctctgtcttacaaaaaaaataaaggaaaaatgttgagttaattccccggactatcacgacagtacgaattacccccctgaaccacaaaaccagacattttaaacctcaaactatttatactgaacacattacacctggtccaatccggagcggttttggtcctatgtggtgtacatgtaatgccaacatggcaatgcaatcaagaaaaaaaaaacatggacccatatatggagtacctctctatctccctttttccccctccccccccggcctgtcagttgtcagcattggggggtgtggcggggagggtggtcggcggtcgggaggagaccacgggcgcaattggaagggcacggtaggcggcgggcaccgacaagttggtgttgaggggacgttgcgggcacattcaagagggcgggtggcgaacgatggccaggaaggaactgctggcgtggcaggcactagcgaggaggatgttggagacgatgggtagtggcgaggtgggctgaggtggcggctcatcgatcccaccagcaagagctcgagcttgcttagaggacgtcccccgaggcggaggtggcggcttggcgatacgctcgatggggaatgggtaggtgagctcgaggggatggcgcatgggttcgtctgacagggaataggtggatgcaacaccacggaagcccgagtctggcaaagccctaaaggtttgtggcatgctccgaaggctaccgcattgcccaaacgcccacggtctcctctaaatctgcccatcgtggtgtctcctaggcctccccattgcggcgaggagatgcctggctgagctcaccgcagcgccgaagttcccccttccagtgccggtgtgaggcgaactccaatggggaggtgaggaggaggtgggaggtggtggagagtttaccagctgatagacgccgataacaacataggaaggagttggtgtggggcaaactccggtggagagacgaggaagaggtaggttgtgatggagagaccaccggctgactggcactgatagcaccagaggaaggaggcatggagaggagggaagaagaagaggaaggactaataggtgggcccattgaatttttttcctgattagattgccacatgtacgccacataggaccaaagtcgctccgggttgagttagggggtagtgtgttcggtataaatagttcaaggtttcaaatatcccttttgtggttaagggggtaattagtattgtcacgatagttcagggggtaattcggactttttttaaaaacaaacctaggacgggatatgatatattccaaaatgacgactctagacggtaggcttgtccagagtggtgtcaaaaacatatctggcacctatctgaggttacctaccagcactaattaggtttattgtactagtatttctactatctccttccgtcacataaaaaagaaacctagtacaggataacatattctaatactatgattcactacttaaaaaacaatttttcatggcacttctcttttatttttctcaggcggactaaaaatagtgccgctaatgaaaatcacatttatttttactagcggatgacataagcatccaccagtgaaaatcacgttatctttactggtggacgacataagcatccgcaggagaaaatcaattttacaaaatatatgtatttatatctaactttttcataaaaaagttggatgaaaataaaatttataccaaactaatgagatctacaactttttagtaaaaacatttccatttgagatcatttagggttcaaaatattcgttataagattgaagatgtattttacaaaatttcagatacatgattcaaataacctccaatatacacatcatctatgtcaaagttgtagagctttgcgagatcttacaacttcgtagttcatgactttttttatttgaaatcatttagaaaggcaaataagtattttaagtttcaaataatgaaaatcaaaccaatagcattctgaatatacacaacaagtgcttcatagtgagatggtaatataatacatgtgtggagagagatcttgtgttcgaatcctacaattcacatacatgtgattttaatccaaaaaaattgcctaaattgtcaattaggattcatagttgtgttatagatgccgataaaaatcaaaatatgtttttgattttatttttgcacctaaaaaattaaaatgaaaatgtacataaaaaatcaaaataaaaatgtggaaatcgattttcattggcgactgcattatgtggcccgccagcaaaaatcgattttcaccggtggtcggatgccgctagtaaagatcgttgattttcactaacctttaatcgttggcagaacgtccggctgccaggaaaaatatgttttagccactagaaaagtgtgttttgtagtagtgtctagataggcctaccgtcacatcctagtactacgattgtggcaattgttctatgttagcattatatctctaattcctctatgttagcattatatctctaattcctatctaaggggctatttagattgatgccattttcaatcataccatttttttggcaaagttgtcaaaaaagtgcatacgtttagtttgttaccaaactttggtaaatacataagaaatcctgctaaaattttggcaatattatcaacttgccaaaattttggcattagcaaaatttggtaaggtttattttggctacaatctaaacatgccctaacaagtatccaaatagacgaatagtaatggtatttttcaaaatgaaagaagttgtaatggcatgtatccaattagcctaagaacatttcatgtaaaatgttattgaaagtaactcttttattaaaaaaattactggtatttgaagactatgtacaaactttaccataccaagagaagaactgcacaagaaaccaagggacacatccaattgaggcctccatgcatgagaggttgagaccacctcatgagaagaacccgatctaggtgttcgatgggggcatttgtgaccctctccccctttgggtctagcgataatcagtcatgtatagcgatggctggctcagtgctaacttagttgtgtgaggaggtgctagcagatggtagtggtgtgtttgtttgcttttttctgattaacctttcagagctataatcttgtaattttttttcttctacgtatcagtatgaaactttcctgtgctggtttgttgtttcgaaaaagaaattaatgtcttactataccgtcttatttatttactagaaaaaaataccagtgcgttgcaacggggtaaaaatgttttttttatcctatacattaatactctcttggttttggaccgaaagctcattcattcatttccagctccagtcctagcccactccactaccttgctctgctcggcctacctctgctcgtaccataacagagccgatcttcccatcaaatctgataatccggtcaaactcgcatagtaaatctggtaatccggtcaagctcgcatagtcccgtgaccgtacgatgacggaaccgatcatctccatcaaatccggtcgaatctttctcgatctccaaaattgttgaggaattttgatccactcgatcttctttttcctttttttctatcaaaatcccaaaaattgttgaggggaaatgataagagagtagtgggaaatcttctcgatctccaaaatttactccggtcggccccgtgtacatacgatgacagattagatgagatcggaaaaaaaaaaggtgcgggaaacaccggaaaaaaagaaactgaaaaaaaacggtgaaaagaaaaaaaaaggaaaaaacgaaacggaaacggaaaaaaaaggaaacggactgggggaaaagaaaaaaaaaggaaaaaaaagaaatggacgaaaatattggcggaagccttatgtattttttaattatatatatatatatatatgtatatatgtatatatgtatatatatatatatatatgtatatatgtatatatgtatatatatatatatatacatatatatatatagattgtgttattacgtggaattttttttatttatacttttttttattaaaatatttacaaaaataattttttgtttcgaaaatttacaaatctaattgcctgccgccctcaagaagggcgatttttaaaaatcgccctctcaaagggcggcaagggacctaaatacaaaatttttatttgtgttcaaacccttcccaccggttttaattacttaaaaactaataatgcttattcgatactccaaatgattttaaatggaaaagtgataaactacaaagttatagatctcatcaagatctacaacttttatataaagtttatctccatccaatatcgtttgaaatatagatctgagattttttaaaatgtgttttatattttgtaacgaatatttggatatctaaaacatcttaaatgaaaaagttactaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgcccttcttgagcgcggcaggcgattagatttgtaaattttcgaaacaaaaattatttttgtaaatattttaataaaaaaaagtataaataaaaaaaattcttattacgtgggcggtgggctaacatgctttaatgggcctcagggctcctctttgcgctggcgggccttgttagtcgtaccccatcggcactcgacacccatccatccgcctcctgcctgcgccgtcggccgactcctcgctacttcgcccgccacgccgcctccccctgcgccgatttccatccgtatccctcgaggttgggtgcccgtcgtcctgctgctttccgcctccggtgagcatccatatcccatcgcttgcctttgtagcagtaatctttgtttggagcgtgattcgagatcgaacttccttgttccagaaaaaaaaaagaacgaaaaatgtcaaaaagaagaaaaaagaacgaaagggtggagttgagatttaaggcacccgattatgctacgtggaaaaag

SEQ ID NO: 37994 - DNA, 967 bp, Oryza sativa
agagggcactcattgattgcatggggctgcttgttgatgcaatttcccatgctggtgaacctctttctgcatacattcaggctcattcagaggtacgcgtttttggtatgttgcagctgtggtgcctctaatgcatttataaattaaatatacatagataatatttggaatttgaataactgaaggactgtaaagtttagttaaacatacagaattgcgatgcaggtcttgattggtacttttgaagcgtctggataacctctgattacaataaccaagatgaatcaatctaaatgaattcgaatatgtatgttatgtcgtttataaaaccaagtagaaaatttaatgtgcttgtatgttgcaactgtttttgcacactattctattgcattccaattcatataatcgcaaattttctccttctgattatttgtgatctagcttatacaacatattgtcgcaggcgccacatgtggaggtcttggaacatgtttcaactatcctcaaggagtatggattttgccctactgaagaagtcatggacaccataaacctgtactactttttgttttgcttcacacaacaattttctatgtgaatacatgttaattttgctgattattttgctttgttcttccactttttccttgaagccaaccttatgactgcaaaatgtcagaaacaaaatcatgtagcaaaggtgtgttgggctcaagtgattctttttacatttaacaaaaatgagccctaatcctcctttttttttttcatggagaacagggtttacagatgcaaacacggcagttgcggaaatggctaatctgcatgctgcacacaaaaaggtaaagataatcaaatattactgtatcggagcatctctacctttgccttcttgtgagatgtagtacgtaaggtgtcattcacacaaatagtagtgtggtattgcagtgtgcaccagccaggtaag

SEQ ID NO: 37995 - DNA, 12526 bp, Oryza sativa
  unsure (1)..(12526): unsure at all n locations
tggttgggcacattggtgaaatatggatgcatgaagacatactattcaaaagatgccctttacaagaccatcaccgctcatcctaacaaggatgggcacgggctcgggttttcgggtggaagtcctgtgtctaagcgtgtgatggtaaatgggaaagaatgcttgatgttaatgagagaaggtaaagctccacaagaaagtgaggtgactagtcttgtgagccgccagggacccggaacatccggacaaaccgggcgaaacctccgggtgggagtctctgtctctcagaaattcccaccaggaagttccggccggtttgctaggaagttccgggccaatggccgtgcacaagacatgtccggaagttccgggcataatgccaggaggttccggccagatggtctttactatgattcatatgtaattttcaaaaattcagagggcaaagtggttgcttattttaatgggaattagaatgatgagtaccgcacttgtgtgtgggtgccaaaggctttggtaactaacatcaagggacccaaacttagacaagtttgggttcctaaatcccaagcttgatttcttttgtaggcatactcctccggtggttcaagttgggttgtggacagtggttgcaccaatcatatgactggagagaggagtatgtttacaagtttgatgaggagaacgaaactcgtgagaatattgtgtttggagatgatggtaaaggaaagataattggtctaggtaaaattgccatctccaataatcaatctctctctaatgttcttcttgtcaattcattaagctacaatttattatccgtttctcaattgtgtaagttgagttacaattgcttgtttaccgatgaggatgtgaccgtctttagaagggatgactcctccgttgcattcaaaggcaagttgaagggtgatctctatcttgtcgatttcgatgtggatagagtgaatccggaagcttgtttgattgctaaatcctccatgggttggctatggcatcgtagactagcccatgttggaatgcggaatttggcaactctctaaaggggggacatatcctcgggctcactaatgtcacatttgagaaagatcgtgtgtgtagtgcttgccaagccgggaaacaagttgggaatccacatcctatcaagaacatcatgactacaacacgccctcttgagcttctacatatggatttatttgggcccgttgcttacataagtattggaggtaacaagtatggttttgttattgttaatgatttttcccgcttcacttgggtgtattttctccatgacaagagtgaggctcaagatgtcttcaagcgcttcgccaagcaagcccaaaacctctatgatctcaccatcaagagggtgcgaagtgacaatggaggagaattcaagaacactcaagtggaggaattccttgatgaagagggaatcaagcacgagttctccgcccccttatgatcctcctcaaaatggcattgttgagaggaagaaccgaactcttattgaagccgcaagagtaatgcttgatgagtacaagacttcggatatcttttgggcggaggccgtgagcaccgcataccatgccatcaatcgcctctacctccataagatactaaagaaaacttcatatgagctcttgagtggtaagaaacctaatgtttcgtattttcgtgtctttgggagcaaatactttattttgagtaagaggcctcgctcatctaagttatcacctaaggtggatgagggattcttacttggctatgaatcaaatgcacatgcctaccgtgtcttcaacaaaacctctagtattgttgaagttacaagggatgtgacatttgacgaatctaatggctcccaaggagagcaagttgttgtacatgttgtagatgatgcggatcctagacaagcaattggttgtaaggctattggagacatacgaccagtcgagacgcaggatgaccaagaagatagggatcaaccttcgtcatcgacatccaatagccctacaacaagtcaagagtcagttgacccggaagtttcgggaccagatgatcggaacctctggacctctccaggccaggaagttccgggtccatctgccagaaagttccgggcagaggacagtcaaggcgtgcctacggcacaagtggatgggattgatgccgagggcactgtagagcatcctgatcaggctcaggtcccctcggtgcaccatccaagaatacatcacactgtccaaagagatcatcccgtcgacaacatacttggtgacataagaaagggggtaactactcgttctcgtgtcgctaacttttgtcaacactattcgtttgtctcttctttggaaccaactaggattgaagatgcacttggtgatccggattgggtgatggctatgcaagagaagttgaataacttcactcgcaaccaagtatggacattggtggatgtcacatcctgatttttgtcttaggatttataaattatttaataaattattaatagaatttatattaaatgttctttaatttacaagtgaagttaaatgtgggaaataaaatttcctaaatataaagcatggacggatttaatttttattaaattctccatggttaattatactctctggaattttctcggatttttcggagctcaattattaattttaatcatacaaagaacagttcagtaattatttgatcaataatgatctaattataattgttaagtgcttttcttgtttaaaatccttaaattataaattgttgtttaaaaggaattattagaaatgattttaaaagcttcaaagagaagatctaattttaatttgctaaatctcaatataaaaatgagctagataaaattttattaaatactttgcttgttcctctattttctagaattttctgggaattatttgagcaagggaagtatttttaataattgaaacaacatttcacaaattgttttatttaaaaaagttcaaaaaacccctccctaagccgttgggccgaattcggcccaatactctctctctctcccgcgcggcccaagccggcccagctcagccgccgcccctcctcctccagccgccgacatgtggggcccacatgtcggaggtttcttcaacctccggccggcctcaggccgagcccgagtcggccgaccgagcccctcttcctctccgaatccgcatccaatccggtcctttttcttccgtttgtttgaggggtttttatcctctcatcctcctctatcttttccctcaacaatcggagcaacagttggagtatnttatccgaatcgagttcgtttcgattttatccccaaaaaccgatttgagattttccgaagcggatttctgcgggnagagtccgatntcttcaatcccctcccactaatagnnnccacctcatcgctctctgtcgtttgccccctttcccgagctctctagtgcgccgtagagtcgccgccacgccgagttagtcgccgccnccgccggccgatggtttnncccccccaangnccncgcgcccgccgcgccccgcttcctgccgtcgccgccgcttgccgccgccgccaagaggtgcgccgaggagtgaggaagcccggccgcccgttccccttcgccgtcgcccaccggagctccgtcgccgccgttcaaccgagccgccgccgcctcttgcgtcgtcgccggccgtcgtcggttgtcgtgagacgttttggtgagtaccatcgggttcgtctcgacgtcctctacgcgtaggtgcccttggatagcccggccgatctctctatcgccggcgaggtcgtcgcccgtgtcatgccggtgatgatgacgtcagcatgacgtcatgattcctcttttccagttttttttctaatagattaaatcttcggaaaatcataactaaataaccgtagatccgtttcaggtggttcaagttgctaaatttttctaaaataaagatctacatattaaaattgtccataaattgaattaaatttatttaattctttttaaatgggctttaattagatttaatcttgtaaaattcataataaattcatttgaagtcggaataaggccgttcaagtctcataattcatctaaaatcatgatctacatgtttgtttactttatatgtattgtttatttggtttttattagtctttttcttcgttttgcgtgttagcttgtcgtttccgtcgttgcgaagattcgtgagtgcgtcggaagtgatcaagaagattaattgaagatcggttattgcaaggcaagtcacacagatcctaaacacaatcctttgagcatgttgatcctatatttaaattctctatttatttcaactatgcatttattttcgaatgtcactgggtggtgtgaacctattcctttgttatggccaatttgcattggatgccctattccttgataccttgggtaataaattgattagcttgaaccttatgtattggtttggttcagctaaatgttatatatataattgcttagcaatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacatttaccgtgccaaccacaagccagcgtgggcaacggctttatcttttgtatagcgtgattcattatagtgcgccagactgagaagtggcgagaagtccatgggggtcgctggggagtccatgccttgtttataagggggtgattatgatccaggaaaggtgcgctgtaatggattatgctgtgcaaggggtattgtcacaactcctttccgaggtaccgtggtggtactgagacacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgtaataactggtaataatttgcttagctcctggtttggagttagatctgttcagccgggtatggttgttcaggatggttgggcctgtacagcatgggtgtgctgttcagtgttgattaaaacttctgattaattaatctactgttttactactcttaactctttgctaaatgctgctttcgcaaatgagcctatattatgccatactttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagccggagcttcgctagattttattttccgctgcagttttcttcttgatgaggattaagtgcctcataagtaagtatttatcgttttagttaatttgatgaatctgtatattaaattgtcagtttgtgtacctcggctgattcctggacgaggattttatgcacaaataagttcggaaattattagtgaatttctgggcgtgacaagttggtatcagagccatctcaactgttggataagccaaatggtcaaattttaaggacgaatttttccgacaaaaatgatttgtgaaaatttctcctttcttccttatctagaattctttacaaattgtttcattgtctactctcttctctcgttcaacttgagtagttctgaaactaaactagtggttgaaacctgaagacgccaatgaggtctactgatggaggttaagtaaagtggatcgaggaaggaccaaagtgcccagatgtcaagatggaatgaagttggcatcctgccttagaacctatcccgccaaagtgtctttgaagaatagttagtagggtagaacgctgttgtttgctttgtgtgtaggtatggttgcattcccgtcatagatgtagtccagtgatgagcgtgcaactgtactaggttgtttgcttaaccaacttaaacaatataatggtctacacacatcagatcagtgttaacctggttaaggtcttgtctttagtgtaacctctctccttctatcttttctaatctgcaacagatggtgaacactcgcgccagtggaagtggaaacaataacaatgaagagaaccccacccttgctcaagtgctggctcaacagacccaattgattaacatgttagtgcaacaaatgcagaaccagcaagggaacaacaatgtcaatcctccgccgccgcagaacaagttagctgattttcttcgtgtgaggccgcctaccttctctagcactaccaacccagtggaagtaggtgattggttgcacgctgttgagaagaagttggaactgctccagtgtacggatcaggagaaagttgttttcgcttcacatcagttgcaaggatctgcttcagaatggtgggatcatttccggatgaacagagcagaaggacaaccaatcacttgggcggagttcactgaagcattcaagaagacacacatacctgcaggtgttgttgctttgaagaagcgtgagttccgggcacttaagcaaaaggatcgtactgtgacggaatatcttcatgagttcaatcgtctagctcgctatgctccagaagatgtgcgtactgacgaggaaaggcaggagaagttcttggaaggtctgaaggatgaactgtcagttatgttgatctctcatgactatgaggattttcaggagttggttgataaagcaattcgactggaagacaagaagaacaggatggacaatcgtaagagaggaaggattgttttccaggaggcacaggatagtagccagaggcagcgtatcaagccactccaaattggtgaatcttcttccgctggtcaagaacagtcacaacagttgaacatcggtggtgagatcaactcagagactaatgcaagcaatgaagacaatgatgggcaagctactcaatcagtgtcatttcagcaggatcagtctcaagaagataacagtagtggaagggagcagcaggtatgtttcagctgttacaagccaggccactttgcaagagagtgtccgaagtcacagcatcagcagccgcaaggtcagatcaacaacattgtcgtcacaggagccaatgcagtgccagttgcgtcttcaagagttgtgtcttcaagtgttacaactcagccaccagtttcaaagcggcagtagttttctttaaagccttagaataattatcggagttatggaataagatagactgcagtttacctatgcccttttctttctagccgttccgaatctcgggacgagattctttgtaaggggggtagatttgtcacatcctgatttttgtcttaggatttataaattatttaataaattattaatagaatttatattaaatgttctttaatttacaagtgaagttaaatgtgggaaataaaatttcctaaatataaagcatggatggatttaatttttattaaattctccatggttaattatactctctggaattttctcggatttttcggagctcaattattaattttaatcatacaaagaacagttcagtaattatttgatcaataatgatctaattataattgttgtttataatccttaaattataaattgttgtttaaaaggaattattagaaatgattttaaaagcttcaaagagaagatctaattttaatttgctaaatctcaatataaaaatgagctagataaaattttattaaatactttgcttgttcctctattttctagaattttctgggaattatttgagcaagggaagtatttttaataattgaaacaacatttcacaaattgttttatttaaaaaagttcaaaaaacccctccctaagccgttgggccgaattcggcccaatactctctctctctctcccgcgcggcccaagccggcccagctcagccgccgcccctcctcctccagccgccgacatgtggggcccacatgtcggaggtttcttcaacctccggccggcctcaggccgagcccgagtcggccgaccgagcccctcttcctctccgaatccgcatccaatccggtcctttttcttccgtttgtttgaggggtttttatcctctcatcctcctctatcttttccctcaacaatcggagcaagaggttgagtattttatccgaatcgagttcgtttcgattttatccccaaaaaccgagtttagattttcccgaagcgatttcttgcgggaggagtccgatctcttcaatccaaggctataaataggaccacctcgtcgctctctttcgtttgccccctttcccgagctctctagtgcgccgtagagtcgccgccatgccgagttagtcgccgccgccgccggccgatgtccagccgcgccgccgcgccgctcctgccgtcgccgccgcttgccgccgccgccaagaggtgcgccgaggagtgaggaagcccggccgcccgttccccttcgccgtcgcccaccagagctccgtcgccgtgtcacgcccggaatttctatccaaaattccaaacgcttacatgtgtgtgaaccctcgtccaggaatcagccgaggcacacaataacaaattgataatagagtacaattattactctaattaatacgcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttgagaaaacagttaagtaattaaacaatattaatccaacgctatacaacataccctgttgtataggcccaaccattctgaacaaccaccccggctgcacagttctatctccaaaccaggaatataccattccaaaccaggagctaaacaaattattaccagtttaagcatcttttacaacgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaataattaactaatcacgattgaccatcgtgaactatcaataagccatcatgaaatattagtaagtcattagttatcccgaatgtgtactaatgtttctaagcagggctaagcaattatatctaatatctagttgaaccaatataaataaagctcaactagtcaaattgtaataacccaaggtatcaaggaataaggtaatcaagtacaaaagggccataacaaagaataggtcaattccacccaatgacattcgaaaacagatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaagcggaaaagagcaaaatcaccaaaacagcacataaacaaacatgaacagtacatgtggatatttttaatgtgtagatctcaattttagaaaaatttagagacttgaaccaactaaatcggagctaagatgaattagttatgaatttttaaagattaaatcggattaaaacacttaaatcggttagaattgaattatgacgcaataatgaattatttttaaaaaggaaaagagggtttattgcgtcagcgggctagggtttgggtggaccgggcgcacaggcggcggttcacgcgaacggacggccgagatcgatccatccaaaacggacggccgagatcgaacggtctacgaccggctcacggcggacgaccctgatgacgtcagcaatgacgtcaccgacagcggcggcggctcggcggaggagatggctcgaacggcgcacgctcgccggcgaacggcggcgcgaggatgcaaacggagggcaccaagacgaagaggacaacgcggcgaactcaccggtgacctaaacggcggcggaagaccaacggacggcgacggcgacgaggaggaagcggcgggaaccttcgggtcaacgacggcgatgctgctccggtgatctccggcgacggcgaaggggcggacgaggacggcgacaacttggcgagcacgacggtggtcttcccgagcgacggcgacggctgaaacgacggcggcgcacggctggagcggcggcggcgacggcgaagctagggcacacggcgctagagcgattccgacgacgagaggcgaaggcaagggtggcgacgggtagaggagacaccgggggtccttttaaaggggctaggaggcggcggcaaaggcccacggcggccggcgacgaggaaggaaagatcgggaagaacgaatccgagacaaactcgaatccgacgctttccaaaacgatttagccaaagattccaaaggagaaaaggtagaggagatcccgaggatcatatcccctctatcaattcggccggagaaggaaaggagcggccggattggaaagcggcggcggcggcggtgcgctagggtttcggcccgaggaggacgacgatcccgacaggtgggaccaacctgtcagcgacagcgcgcttgcgcgggcggctgcggctgcggactgggccggctgggccgaggagagagaagagaggttttgggccgactttcggcctaaagccaaaagaagactttttaaaacctttttcaatttaaattatttcttaaatgcaattccatttattaaaaatactttcttagctcaaataaatcccagaaaaaatctaggaattatagaattaagcaaagtatttaatgaaattttatctggccccattttatattggaatttattaattaaaactagatcttctcttcaagacttttaaaattatttctaaaaattccaattaaacaacaatttatatattttgaattttcagggcgtgacacgctgtcacaccccgaagttttcctcccaagccaaaattgtaatttttataaatgaccctaagaaaatgctggtgaaatcaggagaaaaccctatgaaagtaatgcaaataataatcggatttgacatgtggaatttttcttgagttctacatgtcgaaactcattaacaggatttttagtggaattttcagagctctagaaataattttaaccaattaaaattgagcaagcaatattttaattccagggaaaatcctttttcctttttctttttcttttccctccctttttcctcctttttccgaatgggccgccggcccattccctccttcctcccctcctccttgttgggccggccgcaggccgaggcccagccaggccgccccgccgcctcctctctcggggtcgccgacaggtagggcccacctgtcgggtccttcccccacctcccgccgatctcgctcgcaccgccgcgcccgcaaccgccgccgcgccctcgcctccgcctcctccgggccacgtcgaccacgcccgcgcgtgcgccgcgtctcccgcgcccactcccctctctctcccgcccgcgcccgcgcccgagatggccgggattcgattttcgaatcccgcctctctctcctcccctactccccacgtcggccggcgattcccgcctctcccggccacgtccggttccctctccccctatttaagcatcgccgccgtcccctctcactttttccccatttcgccgcaccctctcgagcctccgatcgctcccgcgccgtgcaacgccttgccgccgcttttttccgcaactccggccgccactagccgccgttagggtcgccgccaggccggggctgcaggaat

SEQ ID NO: 37996 - DNA, 2263 bp, Oryza sativa
  unsure (1)..(2263): unsure at all n locations
tagccgctgctagcgcagccgccttcgcgtcgccttttgcgccgtcgccttcgccgccggttgccgtcgccggcaacccgttcgcgcgcgggggcccgggnccggncccngttgccgtcgccgcggccggtcggtcggccttgagccaagccgagccgggtgtcgccgccccttttcctcccgagccgctgaccagtgggcccgcgtgccggcgccccttcctccttctcccgagtcgctgaccggtgggccccgcttgtcggcgccgcgcccccctccgtgctgacgtcagccctggaatatattgcgcaataaatgatttagggtttttcttttatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgtttcctccgacgctccggtgtactttgagatagtcgccgaggttcctccagcagcagagcaaggcaagtcatgcttgtcacttgaacatgttgatcctatattgcaaatgctctattgttttctttcaaatattgcattgttttataatattactatgggatggttacctattgttacagccatgctttttggatatcatgctcctttgttagcttggggttataacatgattagagtttggactaggaattgcttagctattcttagttcaactagttcacaatggggaaaatcatattaatgtttagactgttggttctaatgataatgttggattagtaccaccgctctggtgttggttaattaaaatgaatcacatggtgggctgtgggtgcatggttttgctggtcgcacccatggcagttaaggaccggttcgcgggatgccctggaagaacttatcgtacttaccacaaaccagcgtgggcaacggctgggcttgtagcgtagctttcctctagccgacgcatccaggcaagggtgggcgtgatggagtttggatgggccctgcaacggcctatgcggcttccggattcacctaggcacgagaggggactgcccgctgccttgcgaggagtgggggtgaaacctgaggtgtggtgtgcttggttagagggggttatgcgagtggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggtggatggttgggcctgtcgcaacgtgggctagcgttggacagcggatgtttaatattaattaattattacaactgtttaaatctttcaatttctgtttataaatgctcgctgtatgcaaatgaaccactctagctcttctttgttaattccctgcatcatacccctattacggtatgacttgctgagtacagtgggtagtactcagtcttgctctacttttcctaaccccagaggacgggtatgtgtcagatgaaggtttccccgaggagtaggcttcgtccgtgccgtcgaggatgcctgtggagtggtgttcccgctgtagtttagtcaaagtttagtcaaggcttagctcctgttgtctttcttttcttccgctgcatttatgtaagactttatgatgtttgtaagacgtggatctgtatgtcaacattgtcgtttgtgtaccccggctggtcctggacggggatttttatgcacattctgcttggaattatattcgggaatttctgggcgtgacacacgccgccgttcaaccgagccgccgccgcctcttgcgtcgtcgccggccgtcgtcggttgtcgtgagacgttttggtgagtaccatcgggttcgtctcgacgtcctctacgcgtaggtgcccttggatagcccggccgatctctctatcgccggcgaggtcgtcgcccgtgtcatgccggtgatgatgacgtcagcatgacgtcatgattcctcttttccagttttttttctaatagattaaatcttcggaaaatcataactaaataaccgtagatccgtttcaggtggttcaagttgctaaatttttctaaaataaagatctacat

SEQ ID NO: 37997 - DNA, 780 bp, Oryza sativa
cctcataagtaagtatttatcgttttagttaatttgatgaatctgtatattaaattgtcagtttgtgtacctcggctgattcctggacgaggattttatgcacaaataagttcggaaattattagtgaatttctgggcgtgacagtggagagacccgaccaaaatgtcatcggcaccaagtggatcttccgcaacaagcaagatgaacatggagtggttgtaaggaacaaagcccggttagttgcgcaagggttcacccaagtcgagggtctcaattttggtgaaaccttcgcacccgttgctcgtcttgagtcaatccgaatgcttttagcctatgccgctcaccatgatttcaggttatatcaaatggatgtcaagagtgcctttctcaatggacccatctcggaattggtctatgtggagcaaccaccggggttcgaggatccaaagatgccaaaccatgtgtaaaagctccacaaagcgctctacgggctcaaacaagcccctagagcttggtatgaatgtctccgagattttcttttgaaaaatggttttgaaattgggaaggcagacactactctcttcactaaaaagtttgaaaatgatttattcatttgccaaatttatgtcgatgacataatttttggttctactaatgccactttttgtaaagaatttagtagtatcatgactaaaaggttcgagatgtctatgatgggtgagctaaccttcttcctcggactacaattcaagcaagcacaagaaggtactttcatctct

SEQ ID NO: 37998 - DNA, 590 bp, Oryza sativa
ataggattctggggaggatcagcagaagcagctgctgctgctgtttcttcttcaatcgtccatctgttggtgaattcgaccaggttatccaagagatcgacggacagtgccttgcgatccttgatgcgctggagcgtgctcttgatcttgctcaagaacctctcgctctcatcatcatcatcgtcatcggatggcgctaatttaaccgcgcaagatccgatcagctctgcctcttgttcttcagatattctctccggcacgagcagcggcgatcgttggagatccgggaagaactcgtctgcgacgtgcgactggaagcactccgcggtgaggaaaaccatcatgcattgcggatcggggcacatccagcagatccaatctccggtgtccttggccaagtccaccgcgcaggcgagggcgctcatctgagcgtccgatagtggctctcctgtgtagtgcgctttcagatcctcgacgctcaccgtcaggaagccgcggcggcgctcgtcgtcgtcggcggcggcggcggcggccatggcgaccgccttctactaggcctggaggaggaggaaccggatcccctccttggc

SEQ ID NO: 37999 - DNA, 2553 bp, Oryza sativa
ccgagatactatatgaacaatccttttgaaacgagatctttggcaaagggtgccggaacacctctgttttctgtgacagccgccaggtgttcgatgtcatccccggcttcctcggcgagcttctctccacgacagatgcgagaacacgcattccgtcgctagctcgttccatttttgcgactagttctgcaaatggagatggtggaaactgagccgccggtccgccgtcatctccttgcccttcgcgtaaacggagatctccgatttcgagtcgagttcggattgaagctaggaatgtctcgcagagcatagatgcgtataatcggattattcatcagaagtattctgcttggcatccacacgctttgcttccttcaacgatttcaattcgaactcggactcggctgccgataaatccaagcgcgccgcccctcgccgtctccgcattcaccacaattccttccacccatcctcgcagcagagctcgttcgtccatggcgcttccccgccgctcgagtccccgctcctcgcgcccgatcatccaccgcgccgtcgacgccaaggggaagaagccgtcaggaggatcgccgcctgtcaacaagatgtccttcaagaagggcgacgaggtgcgcgtccgcacgtcgttggggaggctagggaccacgacgctgcgcctcgtcatgtggctcggcgcggtcgtcgtctccgacgccgacgacgacggacacctcgaggtcatctacaatggcaacttcccgcgcgacgatcccttccggaccgtgcgcgtcgccgtcaagcacgtcaagcttccggcgccgcgcccggccccgaccccggcaaacatggcggcccagcggccgaccacggccgggaagtcgctgccgcggctgaagatgcagatgctggagaaggagcagctgcgggccaactccgaggcgttcttggcattgtgattagtgttcttcagtaggtgcagaagcttgtaggattcagacattgtcttcctctgttctttgggtgccaatgtcatcgaaggcacagtgatcttgtaatgtcttagataggatggtttattggaattcttcgcaagaagaacgtgtaatctgtgaagtgtatttatcattgattatgaatgaaagatcaagattctttttttatacacgagtgatgtgtttcgtctattatctcatgaccaatgcaatactatccttgtcttttttttgtttgagcaaagtgttaagattaaaatcacaatgatttaccctactgataaagaaaaacaatcattcatttgtttctctaaagataactttaggtgtaaaaatcaccactacatataaggccatctccaatgtgcaacaaaaagtgatttaccatcggtctctatatctctttaagtgcgtgttaacattataacgatgctattataacaaaaaaattagacaaagttaatatagcaaaattatgctagaaactatctaaacatggttgagctggatgactgtccaaacacgtgctagctaatggtaaatacatgtagatactactattcattattcaagagagctttgaaatacaactgccctcaaacatgatctagccatgacccatcaacgacttggacactgacaagagtggatctgcagtggagaccaaaggagacgatggtcaaataagccagatctaggctggtgcattttttttttgttttctgatgttttaatcgatgtatctatcatgtttttggggttggatccaaatgttgcactgcggtagtctgatcttatttcatctgttcttgcatattggttgaatctcaatgttccatttgtgaggatgagttgttcaatcttgatccaactatgtttcagcatttaatagattgaaacattttttatttagtggtgaaacattttttactaggagtgaaacaacgcttgatttttaggaaaagatcgggcgtccgatttgtagtcaccttcatatacttcccaaatcattcttgagataaaacgattatccacatcccaaatccgaaataaagaaaataaaagcaattactcccattgccgaatagtagtaatttagggtgtgattggttgggtggatgtgactggataaggatggtcattcaattttttttgtgtgtttggttcatatacaagatgagtgaccaaatcaggtggatgaaccgatgaaaccatccatgttttagcctggatgatgtggcctatgtcgattggttgtgatgggtttaattttttgttagcaaactataaataatttttcctactaaactatttatttaatttctaattcgattacatcattatattcattataattatatctttaaagcaagattttatatgttatattatgatggaaaatatgtatgacaagtgggcctaactaagttttgacttatcctattcatgttaaatctctctaaccaaataagaaattggatcactatatccatatatactgaacaaaaaacaaaaaattagatcgttatatccgataaaacatactatccacatgttatcttaa

SEQ ID NO: 38000 - DNA, 2986 bp, Oryza sativa
gccccccagtaggaaataataagaatacctggtgatcagagatcttgacaggcaccaggaagaagtcattgtccacctccatggctccatagtatcctttcccccagccaccaccacctctttccgcatcttggacaggaggggatcctctttgtccccaatctctgcctgcagcacaccatccttgaacagcttcacacaaagtagcgaaagagaaagataatgccagaatagattgccagtgttgcccagcagaaaaaggaaagtctgtaaattcattctcacctaagatgaacaacagaggtcagtcctcaattctgtgtctgcaaaaatcaaccaagaaacaatgaggataatgagcagcacaacggaattagccaaggaggaagatttcctcttgttggacaaacgaaagaaaaaaagaagggcaccaattaacctgcagtagtagagtgggcgtgctggcaagagagaggaaccgatgatagcagcacgagcagcagaagcaaaggcactgctgccctcgtccgcgtccgccgtcgtcgccgccgccgacgccctcgaccgctgccaccgccctcgtccgtgtccgccgctgcctcgtcctccgagtttcctaatgggtgatcgatcgtcccggacgatcatctcatgtttcctttctgacaccgtattaactttctattttagtaaatttatccacctaaagtttgtatacctcaagtttacacatctaaagtttatacgtctaaagtttagagacccaaagtttataagtcaaaagtttatatatctgattcaaatttaaatttgaattcaaaattttttatatatatagtatttctatgcatctaaagtttatacacctaaaatttatagacccaaagtttataagtcaaaagcttatatatccgatttaaatttgaatttgaatttaaatattttttatatagtatttctacatataaaattttctaactttgtttttttattttttttagaaaattatgatgtagtaggaagagaagaaggggaggaggaaggggtagaggagctgtcataggggaggaacgggtgatcgctcacagcgaccacccgcccattagcacccccctcgtcctcgtccacctccaccctcgaccgctgccgcctccctcttccgcgtccgctaccaccctcgaccaccgctgtcctctcgcgacctccgtcgctgctgccctcgtccgcgtccgccgtcgtcgtcgccgccgctgccaccgccctcgtccgcgtccgccgccgccctcgactaccgccgccctcaatcgcctcttccgcgtccgccgcagccgccgccctcgaccgccgctgtcctcgtccgtaacctccgccgccaccgccctcatccgcaaacgccgctgccgtcgctgtcgccattgacaaagttcgtcgccgccgtgtagcgcccgttccgtcgtggcgcctagcgggaaaattatctcttaaaaaccctaattgcgaaatttgtttccttgcttgttgtctagtcgccgtgccatctcaagatctcaatccccgatctatcgtcgagttcaactccaaatccaattccttccaaatcgaatccctccgcaaaagtctagtttgcctcccccgggttcgatgggccgaattccgctcggcccatctcttccccggccccctctctcccgggcgtctctctctctctctctctctctcgcactctcccatctccccctcccctcccccggcgcgctctccctccgctccgccgcgcccgcgcgccgcgcacgctgcgtgcgcgagcgcgcaagccgcgccgagcgcctccttccccctccgctccgcccgcgcgccccgtgcacgagcgcgagagccgcccgcgccgagtcgagccgcgcctctccatccgccgcgccctcccgttgcaagccgcgcgcgcgtgccgagtggccgaccgtctggttgccgccgccgtcaccctctgccgcgccagcccgcgcctgtcgcctgtgtcgtcgcgccgctccaaaccgccccgccgtcatcgccgtcgtcatcgcctcggccccgccactcccgcgctagcctccaagggacggaggcagagcctccctcctccctcagccgcgcgcccccgctccctgctccttttcccgaagaggcaaggggacaagccccctttctctccctccttttccccttttcctcctcgccggcgtcatccgcctctgtcgccgttttggccgcaagcaccgagcgccagctagcgccttgaccgcccgaagtcggtttccaaaccgacgttgccgcccttaaagccccgggcgccctccctctcttctcctctcgttgcccctctcgccgccgcgccattgccgtcgctcccgtgctctgtctcgcctccgccgtccatcgccgagcaccgggagagccggtgcgttcgtggacgcggaaggggacttcggccgcgccctcttcttcctcttcctcggcccgaggccggagagattactcccgcgccgccggcctctcgtcacagcgcccctcctcttctcggtgatgtctctctccgttcttcctcctcgctccatctcctccccctagctttcggtagtagcttgagtagactccccgtagttagccggcgccgccccgaccgttgccgtcgctcgccgtgtgctcgccgccgtcgccgcccgagctccgtagcacccgctcgtcgccggccttgctcggcgtagttccacccaatccgacgctagcgtcgagttcccgaagccgcgtagatgctctcaccgccgggaatcggtctctcgtgacctcgtcgccgtttccctcttctcccgccaccggttgccgccgccgcaatccgccgccatcgagcaacctccggcgaatccgagccgttggctcgtctccccttgtcacgtgcaaccgcccggtgtgcacgcttttgcccgtatcaccgtggttcgctccgccg

SEQ ID NO: 38001 - DNA, 2417 bp, Oryza sativa
gcttgcgaattaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgttgtgtaaaaaggggttcggtgtttgaaaaatctgcagctgatgggatcagctaggcccgggtggccgtttgaaaagttgttggcccgggtggccgtttgaaaagctgttggccgggtgccaaccttgttgcaatcctaaagactgacacattgcacatactccgaccggacgggacgcactgtctcaaccgtgtcgtttgagaagcactcactcagttgtttcagaaaagagttcaaataaaatcaattgcaaaaataccagcctttccttgaggcctgcattaaacacttatttcccctggcttgctgagtattcccgtacttacccttgctctataaaaaaaaatcccccccagttgctgaagaagatgaagtggatcctgctgacgaggagttcttccaggagcatgtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgcctccctgtgataccagcactatttcctgggactggtatcgattagcaggttaatttggagcgtcacgggctagttccggtcgggactagttcggggcgtgacacgccgtagtcgttgttgctgtcgggggaggcgaatatgcgatgaggccgggagaggcgaatagtctatgaggccggagggaggcgatgcggtgaggagcgaagggaccgagggcattgctacaaaacggaatgagtaccactgagatgtaatccaacggctgataattaaatgatgatgtggcttcaccaaatctcagctttgggttttaactttatagaaagaagggataccttagattttgtgattataataggtgggattttataaaatttattttaacattattatttttacaatttaagacaacgatgatgacgacgatttgtggatgcagtcaccctattgcatcaaatttctccagacatatatttgccggttttctgcgagatacaatttgaacaatctttttgaaacgaggacttggcaaagggtaccggaacacctccgttttctgtgacagccgccaggtgttcgatgtcatccccggcttcctcggcgagcttccttccacgacagatgcgagaacacgcattccgtcgttacctcgttccatttttatgactagctccgcaaatggagacggtggaagctgagccgctgtcatctccttgtcctccgccgccgccggcggcgacacacctagcttcgctgcgcgttcccgcctgcttggcgccattcggaatggattgcatgatggtggagaggcgtaacggacgtctccgattccgagtcgagctcggattgacgaatcgtgcctgacagcgccgacttcaattcggactcggacccggctggtgataaatcctcgcagccccgatcgccgcctccctccgcattcaccacgattccctccacccatcctcgtcgcagcagcgctagctcgtcgtccatggcgcttccccgccgctcgagtccccgctcctcgcgcccgatcatccaccgcgccgtcgacgccaaggggaagaagccgtcaggaggatcgccgcccgtcaacaagatgtcatccgcgccggccgcgccagcagtgtccttccagaagggcgacgaggtgcgcgtccgcacgccggtggggaggctagggaccacggcgctgcgcctcgtcatgtggctcggcgcggtcgtcgtctccgacgccgtcgatggacacctcgaggtcatctacaacggcaacttcccgcgcgacgatcccttccgga

SEQ ID NO: 38002 - DNA, 1431 bp, Oryza sativa
tgttaacattagatttggatcctgtaagcatcacaagtaattgatcaatccatgttaaatgtataattattctacacttggcacactaattaaggtcaggaacatataatgtttttcacaggcttatgtttgtacagattatagaagtgccacttttgttcatttagtttgtatcaatgagttctttacaaagaagagcactaaggagagcttactaggtcctccatggaatgtttaggctatgccaaaccactacctcctgtaaaatcaaggagttgatttaagaatttgtgtgatgaaaatattggtggtttgtgatattttatttgtgataaattgcgtttcttgtgacgagagttaggagattgatagatggttggttttgtgaagtggttgtgcggttgacccgagaggtcagaccagccggcctgacggtctgatcgggcaaggttctgtttgatgtcaatttcaggttatcttgtccgttttggatagtttcttcgtggatttaacttctagattgtttctataagtatggatactgttgttatgctaatgtgagttaagttggaatgaacttgtgttcagaatatggtttctttattgttgcatgtgcaggtgttatttagatcgaagtcaacttgagagaagtggatgtccagagatcaagagaccatgcgggatactaaaggctagagaacgatgcaaatagtgataaaattccatatgacatacaagaggaattatgtgcatatatatggaaaatggagtcgaattcggacgtgagtctaaattcggaaagattgataaatataagggcctattcactttgctaccaaaaaaacattaccaaaatttggcattgcaaaattttagcatagttgtcaaaaatttggtaacttgccaaaattttggcatgatttcttatatagttaccaaaatttggtaacaaactaaatgtagccatttttttggcaactttaccaaaatttggtaaggttgaaaatggcatcaaagtgaacaggccctaagagatgagttagatacttgcaagagagggtttcctacgtggatggaatcctaattaatgttagattcgtgagctttgtacaacattcctcatgtataaatagaaagggagggtgaggcatcccggtatcgatttttgagagagttgaattgagagaaatgttagagttctgagtctagtcgagattttggtgaggagtgttgttggtgcactttgtaaacactagttgatgcaataaagttgagatagttcaatctacatcttctagtttttatctacctgtgttttctaggtcccgacggtcagaccgacagcaaggtgacgttctaaccgacgagagtgcggtggtctaactgcaggtggcgcggtggtctgaccggccagacaatggaagtctgacc

SEQ ID NO: 38003 - DNA, 4817 bp, Oryza sativa
ttcctgcacccccattaaccataacaggaaatacacaattatgtatattaagaatgttaaaaatgacaactgcaaataagatctcgatgaatagtttaggcacatgaaaactataaaatgtagcaatggcaccctgccctcacgacaaaaaataattataaattatatacagcattagggtggcctgttgaccaaattatctatgcaatgcttttagtttgatttgatacttatcgcatatgtggttaacctctaatttttcttacttcgtaggtttcaatttgccccacttgtgccggagagggtggagtcatttcagagtatcgcaaagaaatgtgctggagagggcgtgttcatgttggcaaggagatcaaagtaaaagttcctctaggtgttaggattccatcggatggctgattgagccgggagcgtttcagccgaagcccataggatggctgattcgactgagcccattcagcaaaacaaagtgggctcacaatggagggtaactggcgtttggttgatcaaggtggatattttccgtttcagttttactatatatttatggacaagttttctctcaaaaaattatgaaatgtaaataccctattgattataatttaattattatattataacttgtatgtaattttcatattataatatcaaattattaaatttgcttcaaggttcttgcaaacgtaagaggagaaaatcactgtgcgtgcacggggtgaggggattcgatatcacgacctccgctttgcaggaatcagcatgttacgacggaatttacgaaagttatatacaggatatattgaattacatgcatgattacatactacgactgtactatatttctgcccgaaaatttctctacaaaagcataaacagtcccgctgaactactactcctgtaacctgataggcccaattcaggcccacgaacgtgtttgggccgaaatgtgaacttgaacaggcctggattgaggcccaatacaactatgggcctaggtggaggcctcctgaacacaaaagaaagggaaaaaacccaagtgagaaaccctaaccgcgcgaggcgcctctcctcctctgcttgcctgccatggagttcgatcgccggaaggcggcggcgctggccgcgctcgcgtcgccggcgccggacaagtcgccgaagggcggcgtcgacgcgcccatcgcgccgctcctcgacgccctgaactcccacccggacctcttcaccacctcctcctgctccggccgcgtctccgtcctcgcgcagccgccgccgccgcagcaggccgaccccggcggggccaagaccaagaaaaggcgcggggcggcgggtgggtgtacatctcccacgaccccgcggacccggaggccctggtggaggtgctgttcggtgtgaaggaagggggagggggaggcgatgatgagctcgtgttcaggttcgagccgataattgtggccgtggagtgcagggacgcggctgcggcggcggcgctcgtggctgccgcggttggcgcggggttccgttagtcaggtgagcgtttgaattcgttcagctataggtagtgagatagatggtgtttggttgagttctgtgtgtagtttgtgtaaaagaattcatttcttctgcagtttacttgggtcatttagttacctgtattgtactacatttccatttggaggtgctgtaatttcttgggttccaattctgtttaaaatgggtaaaattccggatgctctttgaattttttaatgtcgatttgatagagtttgcctaaaatttaccggtgaattaaggcacaggttaaattttcaagagttatgctttgacatatttatgttttagatggagatagtgtcatttatattgtctttccactttgcttgccttggtgtgccttttcaaatattctgatcaagctttttttatggtaccatttttaggcatcacaagcttgcagaaacgtgtaatggtagcattgagatgctcaattcggatggaggtgccactaggtcagaccaaagagctcgttgtctctcctgattatattaggtaccttgttagaattgccaacagtaaaatggaggctaacaagaagcgaatgggtggattcctggatcttttgcaggctaaggtatcatttgactttgcataccggtaggcattacatacctcatatttgcacctttctggcattgctgctcatctctaactgggcaataaccatgtgatatcatgcaaagttgaagcatgtatttcctggatatcgatttgatggataaagagaattataatatcctttttccaggtagtttagctattggtcatcacacttctttgtgaagaaaattaattttgtctgtagtgaaaggctcattgaagattatttagacatggaaagcttttattcctcaatttacttattaattctgctgttccatataccaccttatcaataagtatatggagtatggatttagggaatgctctaggcctctatcactttgctcattgtgttctttataagttttaatgcattggttccattcaaactgccagggtctcctaggttcatccaaaggatgtgcaactgcagataatgaatccttagttgcaaaaaagagtagtgatacctataattgtgatgctgataataattgtgataatggatttgtggagatttcactagaagcatcatatttggagagtcaagaccctgtacttcaaaatggtgccaagcatggttttggtaatgctaaacggcatgttctcatatctctttccttttatcctgcttttatttcccctcatggtgtcatgtaaacctattggcctgttcagtccttccatacatatgttgaggagattttggtttgtctaagagaatattaccatcaatacataagtacatgttagttatgtatgctaggcctattgattcagttctgcacattgatcttgtacaataaagtcaataaatgttatttgaaaatgaaatttggtgatgctggcactgtttcacaggagggcatttagtaagccatatttttttatggcattaaattggaaatattaccgtgccagttggctacatagtcttttcaattctaactcataactcagcagctcttatatatatttatcctagatacagagctctttttatatgactaaaccctattattccgtttattttcttctgtagattaacacaagaggaagcattgccaacattgtcaggaaatacaactcactgcctttctactgctgcattggagattactggtgaacctattgagaagctcttcttatggggacaatctgcttgtgcactcactgttggaagagagcaccatatcctaacttttggtggttttggagggccagggaggcacgcaagaagaaattactctcttctggttaatcctgggtcaggattgctgacagaattaaaggttactgggtcgccttcaccacggatgggccatacaattactgtagtaggcaatgatatttatgttgttggaggcagaagtggtccttcagaaattcttaatgatatctgggttttggaaagatctaacaatagatggtcaaaagtggactgcagtggggattttttccgtccaaggtattgtttagacgaaattctttatatctaattttcttttgtaccaaataaaaaaatgctaaaaatagtgctaactagctatgtccaaaagttatggaattagtttcttgaaaatagcaacccatttgcttcagggaagttatgtgtttttcaatgcaggcaccgacatgctgctgctgcagtagatcgcaaagtatatgtctttggtggactaagtgatgatggcttatgttcttgcatgaacataatggacacagcaagtatccaatggaatgtgatttctcctgatgacaaatggccatgtgctcgccactcgcattctctagtgtcctatggttcaaaattgtttctgtttggaggtcatgatggtcagagggcactgaatgatttctatagttttgatacaacaacacttaagtggaacaaagaaaacactaatgggaaagctccatcccctagattttcacattgcatgttcatctacaaagactatctcggcatacttggaggttgtcctattagagaaagcagtcaagaaattgcattgctaaatttaaagcataaaatctggttttatgtatccattccatcattgagccaatgcctttgtgtccgtagctcatcagtcatcattgatgatgatcttgtcattgttggtggtggtgcgtcttgctatgcatttggaactagattcagtcagccaataaaaattgatctgcatttgctggagtcaatatttaagcttgcatacaacaaggaaaaagaaatgtctgtacaacacggttcagtgtcgaatgtagacttattagaaggacatgaggaaaattgcaatcccagtgataatgtgaaggtggtgattgatactgctactctaggttcatctcctttggtccttcagctagaaaagaagtatgccaaattagcaaaagacattctaaaaaagtttggatggttggatcttactagaaaagttcgagtaagccaggataacatccatgttctctttcctgttagtaaaacttttcatgccctaatcactgataagcatctcaaggtacaacctgatgattcatgtgtttttgaagaactattgccgttttctgaaaataagctttttggggccagcatttctcttcagaaagcactagaaattttgttgttatgccgtggttcc

SEQ ID NO: 38004 - DNA, 3051 bp, Oryza sativa
tcatgttaaagttcacgattgttttaaactttgaagaaagggaaataaacgcttggaatagctcaaagattttcgaataaacaaaatccctaagccaacagttccctgcagcctatcatcatccaactggtgacctctaagtctgctcttaagtgcttatctttgtaacccctaaaaacgtgaatataggctgagcagtagctcctaagctatctttgttactaagtgacggttggtagttgcaagctaggcaatctttagttaggttgtttgtcaattggcactctgaaagtgcctgcgtggtggttctttcagggtgcttatcgtcaacatgcagagctagtggttctagtggtatttttgatgggacagtgccacgtttctgaagttctcttaggctttcatgtgcatctcaaaatatccagaagaatgtagtataactttgcaaaagaaaaaatattactagacattatattggaaaacatacagggcactgaaagcaactggatatgctttaaattacatggttacttcaccttgagagttgagagtcggaacacaatttgttagtggcttgttgatgtgctggatgcacgacgaacacacgacgaacatatgaagttctgactctgctgtgttttacttcatatgtagggctgaaggtggcatgctgcacatacatgggaatgtcaacgactcggatgagtcgctctggttggacaatgttgttaagtccatcactaacattgccaaaacacatggtacgatttgcccttttatacacacaagagttgcgaagcattcgacacggttaaaattaccatcttatgctaccgttgcttttcatttttgtctcaggactgtcttggaacgtcacggtggagcatgtcgaacgcgtcaaatggtacggtccgcatatacgacatctcgtggttgatgtcaaatgccgggcaacctaacaaagcgaaagacttgtccaaaatccatgtgctgtaggttgtggtgtatgacaattttgcttactccgtttctggttaatccagagaattaaactatttgtttgttacttcagaaggaagtttgttcagacttttctcaatagcaaagcatctatcaacatttaagtatcatacaaaatatttcctgacatcttattggctgtggctgtgcctgtggtccagttttttatcagatgtctagatgctgtaaatttgcggtattcgctataaaattgtcatttgttgaaaacatgccctgaattcctgaaagcaaaagccacatacatgatgtgttgctccccaggcctgatagagatttgacacctctgatgtcaaatacaactaaaccaataatcctctcggaaatgtgatgatatagaaacgagttttgcagaagaattgaggtgcaaaaatgctcttttattgtgtgtacttgcagaaacaacttacaaaagggaggacattcaaatcactacaccatacacgggcaaggcaagaaaatatacacaatcatctcaacaatgcaaaagctgcgtccagggtaaaccttttatccgtcgactaccatccatggaacaaaaaaaagaaggcgaaaacagtttactaatgtaattgtacatcattttctacaaggaaacagactatttgagcctcataggctgctgcatcccccctcctctcatcatagcgcaaaattcctcgtagttaatcctcccatcctgtaataccccaaaaataagaatcactgtcatggaaggaaattgtaatgtggcatggaaaaaccgattgtttggcaaaggaacttacattatccgtgtcgacttctgatataatatcctttatggtacttgtatcgcccatttcatgctcgattaaagcggattccagttcatctcttgtgatgaagctgcataaaattgaggtaattctctagtcagatcaaccatggggagtttgatgcgcagatggcattgtacaactgcctttttccaatgatggttctagactagtgagcactagatattataaaatgtgaacctgtgaattatgatcataatcatatttggcggactgccattgtgaaaatactgcgacttgtgagtttttttcaatgtgacagttcagaatactcacccactgttgtctttgttttaaaaatttggagacccctttaaaaaaggtttttttttttaaagttggggttaagcctggggcagtgataattccacaaagtggatggatccattgccgtctacatcagcctggaatggatcagagaaggtcagcataaaaggtcaataaaccatggttcagaaaaatactgtaacagtctaggattggtgccatacagcttccatcaactgctttacttcagcttctgaaagctttgatccaagtttggctaatcctgctttgagttcttcatatgtgatggtcccgctgttgtctgtgtccatgtttgtgaacatttgcttcaggcccttgatctcctcctcattaaggtttgaagcaataacctgcatatacaattgcctgtaagcacgagagaagaaaaggcaactaaattatcggcatgacaataataaccttcagagccatctttttcagcttgttcattgctctgaattgcttcatcctagaaagaacagcgctgtcaataggtttgtcagatgcttctccatctctgagccagggatgttctgataacatagaaaccatcatttcttttgcaatttggactaatattaggagtttaatgtatggttaagactcaagaagcttacggagaacttgggccgaagtaattcttttctttggatcttgtgtcaacatctttctaacaaggtctttagcactctcggatattgatggccatggttgactctcaaagtcaatctccccttgaagaatagcatcaaatattcccttttcagtttctggaaagcaaaacagaaaattaataacaatcaaacaatgcaccactgcttaattgtatatatggatttatgaactggaagtaaaaatggatggtataagcaaacgtaccagccca

SEQ ID NO: 38005 - DNA, 14736 bp, Oryza sativa
attcctgcacccctgaaagaatgtacaaaataacgcctgcactccatacatcaatctctttaccataattccgccgaaggacttcaggagcaacataataagcacttccaacaatgtctctatacatttttcctgatatttgaaggaagtcaatatacatgaacaacaggatatatggtatgcaacaattatggtttagatagtaataatgatagaaatgttggaaacttgggatattataatattgatcataaaaaatatacatagtttgtcacatcgaattctatttggttaatgaatcagacaaaatacaaattgatgaaggctggtgcttgcattttaaaaagaacatgataaactgtcaagataaaaaatgtgaatgtaaagagagagggaaaatggctcagctcacacacaatcacagcgggccaatatcaattaaataaaccctagatgataactgggaaggattacagagaatggaaggtggttagggcttactacacattccccacacaccaaatatagaagagagtatgccaaaaaatagagattacatgctatctttgacaaaaaaaaaatcatgtaacgcaaagctgtaaaataaatcatggcagtattttgtattcagggtcggacatgcagaccggcagtgatgaaaatgtacaaggaaagaagagaagacaggaagttaggaactatctctgcctccatcacatcctcatcactaccaccataccatgccataccactaccaaaagaacatcattatttggtaactagtcatgtggaaaagtttccatgctttccccacatttgaaaagcaggaagcttaaagcacatttaggtgttatttgcaactacccagcaccagctaccagcatctgcaaccccaccaccaaaatataatactttaaatttgttcaacttagttttcaggtagcataaaagctctaatatatttgtcaatgtgtacaatagttatacacctccccaaaagtaacagccagtgacaactagtttgctatcatttacatcccatttgcatctttccactacttggagtcgataacaatcaatggtcaagcagtcttaacctcagtggctagggaggactttctcatatgagctaatacaacagatggtgcttgctacatcatcctccatgcctttaaagaatgaataccttggaatggcactatggcagtaataataacatggtgctaataatttcattttaccaataaattttgtggaaccatgtcatttatagaaacagatgtctcatatcatacaaagatgcagatattaggttgaaggatacaaggataaatatagatgttgtaacgaccaacccaaaaacagcaactttagctgtctctgtgaatcctaagtaggtttgtgagacaacttagaattacgatatgattcaagtcacaaaacggtggcccataacataccgtgataggcaaattctccataattcagaataaacaaaatgaaaaacttttcaaactagaaatatggccatttatgaaattctagccctagcaatatagcctgtacagcagaaggtgtaattctcaagcatatgcatcttaaattattcaagttaccttcttcaatgaaaactgagagaccaaaatcagtggctttgagcattgcattctcttctttggttgcaagtaagaagttctccggttttaaatcacgatgcatcactcccataaaatggcaaatgttgacaacattcaccactgccctgcagatggtagcagccgcacgctctgagtagtgccccttggcaatgatccgatcaaacagctccccaccagcgcagagctccatgacaacatggacattgctcttgtcctcatatgctccccggaactcgacaatgttttgttgtccagataggtgctgcatgatctgaatctcccggcgaatgtcctccttgtcggccttgctcacaagcttgcgcttagagatggatttgcaagcatactgcttaccactagcgatctccgtgcacaggtatgtcaccccaaactgtccccttccgagttcctttccaagggagtaaaccgagcgcacatcgtcatacggctttccaagaattgtgtctggggtgggcttcggtggggcaaccacaggtgggactaccggagggttcattgctgatggtgtgtacctcacctcagctggcggcggcggctgaggatggttatagctaggagttgtctgagcaggttttgtctggtgagaatagccataaccgtttgctcctcctcgaccagaatctggagacgtagctctgctgcaacacgaccccatttttagtcaaattctccctagcagttgtaggcttgcaaatttgttactccgcaaacgagatcaaccctgcaagcagaacccaagaaggaacactttatgtcagaattaagcgagccaattaacaaagatttgcgctgaatcaaaggactagtgtgaaaactaagcgaatccaaccaacaaaagattcatgcacaaactcatccctccgcagaagcaatgaaagaaaaaaaaaaggaaaaatgatccaaatactggatctaccagcaaaccaaacaataaactcaacacacaacatcagaaggggaaaacaagcaacgaaaaggaaaagaaaagaaatgcctttgacagcatattgacctcaatctactcccagtcacagcccaggaccgcatgaaattcgcatgaactgaggaacaaggtagatggcgagtccccctttggtgacagtggaagcaaccataggagataagggcacaagggtacacgcaaattgggcaaaaggagacaaataaagcagcatctgaaagcaacgggaccagcaaggcacccagcggcaagagagagagagggggagctaaaccactcacgatcgctatcgtaaaaattgatcctttacacgaggaggaagcgataataaacaaggtacagtgaactagagcttcgtcctctcgtaataaagaaagaaagaaaaaactgtaaattcaccgattacttgttcggtaaaaaattactgtctgcatcagaaatctactgaatccaagaacataacccatgaaactgctaaaatcgagcacttgtggacatgtgaggcgctccagtagctttgcaccgctcccagatccaaaagggccaagatttttctcacagttggatcaaatcctcaatcactgaacctccttccaagaagaacagattaactcctaataatctctgcaacgaaaaacaaatccgcgagactacaagcctctcgaaccaaacaaaccaagaaccgaaaaacagagagacgcgtacccaagcgaaaggagggcgcctaacctttcccaaaccaaccaatccaacaatccaaggagcacagccaccgccccggtagtgtcagctggtacaagaatccgcggtggcgcaagaacaagaagaaggaagaatcaaatctcggcgtgggggaggacagctcggcgcggcgaccgcgtggtggtggtggtggtggtggggggggggggggaggtggatttggagctggagagaggtggtgatcctcgatcgtgacagcgactactaatggcgatgcacacggcgcacgaatcgggagaccacgcgaggaaaacaatgaggagaaaaagaagagcgcagctgcctgccagctgcaactgggtttgggtttgttgagaaagaagaaagaagaggaaagcttgcagtttcaagttgcttcctgctctgctcgtgtgtttttttttgcagttttggtcctcttggagatggaaaaggatcaaaggaaaggagtggtagttttccataagagtccctctaattactactccctccgccaaaaaaaacaaattaggattagatgtgatctattctaatacaataaatctagacatatatactccttccgtcccaaaaaaaaaaaagccaatctaagagatgtcacaacaacgaatctagacaaacaacgaatctagacaaagagatgtgtagattcgttgtactaggagaaatcatatcccctcctaggttggtttttttgggacggagggagtatgtccagatttactgtattagaatgtattacatcatcaagtattatgttggttttttatgggacggacgagtagattagttctatagaaattaggactgtggttgagcagattttgagaagcaccagatagaaaatacctaacttctagatatcatcattttctacggggaaaagtccaaatatcccctaaaaaattttgggtggaactgtagaagcccacgcaaactgaactttgaaatcgaacattcaactcagtaaactttacgacaccatttatataactccataagatgtttttgcacagtagtgtttatgttcaattacatgacatacacattaaacatgtatattaaaatctacacttagatctttctttttatcccttgttagctctcacaaatacgaacataataataatattgatatcattgtataagtctaaattatacaacttgtaactgataatatgcaaaatgttatattagatattcaaagttgttcgattaagatttcaatatatgcaaaaccaccttagacggtaatatgaatggtattgtaaattttagggggttggatgtccagtttaaagttcaaggtactagatggactttcatctaaagtttagacggtaatatgaacggtattgcaaattttagggggttggatgtctagtttaaagttcaagaaggtgctagatgaactttcatccaaagtttagaggagtatttagatttttctttttccttttctatattatataactacagtgccttatataatttaagacgagagatagtccctcgtcatttgctcgacggtaaagctctggagaaaataaacgaagaattacaaaaatatgaataaaaattttctagatgttgttagtgatttaaaagctaatataaaaaaataaactatgatgacaagtctgtctttgttttattattgcttacgagacaagtaaaaagttcatataaataatttgtaaatatcaatctttaaaattcgaaattgcttgaataataataataataatataaaagaaacaaatgtggccaaactacaataaatatatattgttgtatccgacaatgaagtataatgaaaaagaaagaaatgcagcccaactacaataaataatacattgatgtatccgacacatactacattaaatatggagtactatacattgtcatatttgttgtgtgtgtgtgtatatatattgttcttttctacagggaggggaactcaacatcacgtatgtcgatgaagagaatacaaattgcaaatgtatatgctcgttggattgggcttgcagttttgagtcactcggcctgatccacgcgagcagctcagcgtatctgctcgtgatggggcgataccaagcacgtgcagggtgcagcgcatcagtggcggcgtgcgtcagcgcatgggaagcaccgcctcggtgtcctataccagcaaagcctatgccatccccaaatagccgcacctccatagctctatccatggctttgtgcttcagcaagaagaagaataagagaggaaggcaaatggtgtgcttgtactcgctgtgagtttaatggcggcaactacacactgatgtgaagacgaagatagagagtttccttgacatcggaacatactggacaagctgctcacgtcgattgggccaaagctaaataggtgactcaaactataaactcagtccaacttgcaatgggtggtaaacataggtcgtccaaagtgaaaatatagggttaccatagtccaatgtgccactttgatcattttaggtggaccaaagtgaatatttactctaatactattaaagttgtaaacatttgggtaatgcaaaaattagattcaattgaagcaagcccttcatttttacgttatccttttttttccctcaattccacgcgcttttggagtttgcagttcacagagccctagctagattaattaatttcccaacaatcagcggtttaagccagaaaatagttaatttgcttcgtggcaagtggcatctttgatggcactgtctgctactgcacttaattaactactagcaccacgttagtagttgactaggcgtctagtgaggatctggtggtttagttgaaggtttaactgtttttcacttaatattctagctgacttgaaagatatgggaatgttttggttagatgaagtagacgtcaaaaaaatatctaaggaattttcctctctttttccttgtgttgaaaggtacttgtagagaagatttggctcttttttttcttttaaacgtgtgctaaggacgcatcaaggtagttatgcgtgggtataagtttgatgtatcatatatgcgcgtgagtgtatatgtgagtctagctttactctaataaaaatccaaccggaataaatagacattataattttcataatgtgatatcatctttattggtttttctacacaaatttgctataaatatttactcctagctggacattgacaagatcttcaaataaaggctaatgtggtgactattactagtgtaataaattatatataccattatgaaaattattttcaagacaatccacacgagtatcctgtacgcatcctaagaattttaaaatatcaatacttaaagttttaaaaaaattgacgggataaataaatatccaaaacgaactacagttgtacccagacaggatatacaacaacatcaattacttttgtccacaacgttgaaggaaaatgctggacgctgaccctttttttaatacgcatgcatgtgccactacagatgattacgcgcaatcatttccatcaatctacatcaactagcctcgatctatgccgttaaacaaatgtggaacacatgtatataaatgaagcaatccaatgatatactcctatataggttttgccatgaaaaacatatttttattcatgtttgatttatttagataatggaattcatttccgactttgcttcgaaaaagttacagacttcctttttacgcagctacagctaattattacatagagtacgtatcgaataactacgaattataaaatcacaacttgattaaaaacaagaaaactacctatactacgtgcctaaagataaagatggcaaaaatatgaataaccattgtttatcccaataacttgcaagttacatgtagtcttgttttcctcgaatcaggaaatagtatcttcggaaataacaaccgatcattgtaccgatcgaatttcgctggcatcaacgttacaaaaaccagaacaaaagatgatgttggagagtagttgtttttgcagatcttaccaccaccctaaccatcaaattgatccagcaagacatcgccaccgaggacgtcgcactaatagggggatctccaacacgacaccttcaagaaggtcacaacatctagggtgtggttgtctttgtgttttcacctagaaagtccatgccaaagcacgaaggaagggtgtcgcaacattgcctcaaaaaaaagtgtggcgcgcacgggcgtcaccgatgttagtcagatactgccatcacccttagattaggccatcccgattcatgccgtagttgaaggcatgttggtgccgccattgctagagaactgtgcttcaaccacacgacgtcgtctcagccactcacatcgctgccgccaccaccggcaccaacgaagagctcagccactaagttgcgaggtcaacagtaaatgattttgtaatgaggaaggttaaaagtagaacttagtactctgatcgtacgtactatatccattttcagttgatcctacaaaatcttaggcaatatcgcgattctatttattcctacgatcctaaaaatatcatttatgataaagtgcatcgaaagtaatatgaataaatatgctcaaatttacatatataaaaaccatttaaatttatcaaaatcaatattatatgctttaattgatacaacatattatatattttatattaaaatatgcacttccaaaatttgatagtatcccaatactatggtattattccgatcgtatggtactacaaataaaatatgatcatatctagtatctcgatactgattaatttggctgatcacatcatttggttgatcactaaaaattaatccgttcatcccattaagtacaattaaagttattttcctcctctcttattgtgtcgcatcaactcaataaatttcattcattagatctaagtttagcgctattgcccaaaagtatatttgctattaacaattggattcaagcagcttggacaaaattccaatcatatttgcagaatatggccagtactggaattaggttgtagtcattggtagaacagaggaactaattttctacgtgcaccggagttttgaaatgctagcgcgcgctccacctcagctgccgccggcgccccagccagcggcgcccatgctactccgccgcccgcagttcccaacgtccccctcagcggcctcctggccgtcggccgtcgcagccccgaccttcagcgcgccaagatccaacggcggcgcctactgggagatctcgccgccgccaccgcctccacatgtgcccggcccggcgtctgcccagctccggacagtactacccatgtctccgcgaccccagaaccagcaacacgccgcccatgttccttcgctgatgcagtacgcacttctccaggcgccatccttagcccgcctgctccccaaccaccgacgcgcccaacattgaagtccgtctttactgtgccttcgccgcgacacgacgcctaccgccgcgcctacgagctggatccgagagagcggagggacatcctcctccctagatgtacgacgccgagccctgcattcaagccgcgtcctgctttcatgccggccgagcaaggatggacgaaggtaaagcctcggcgctggtggagagagaaggggcattcaagccagagccaacggcccgattcaaggcgacaagacggcgccggacatgcgcctggaagaaggggcgctctctccctggaagaattcagagcaagaaccaggggacgctgcttcgtctgcctggccagcgaccaccgggcatcagcgtgccgcgaccccccgcgttgtttcacctgtaatcgtactggacacagggcgcgccattgcacttcccctcgcctcgcccaccgcccgccgcacccacccaccagatcagctcgcttgccaagggcagcttccccctcgtcgcaccactccaccagagctgctcgtgcctcaccaagaacaagcagatctcgcactccttgcccccaccgccgacatgccttgagtgaccgccacgacaatcctccaccacgcagagagcgccagcaagcgctggcccttcgcgctgccacgccgcgctttccgctgctgcataatcgctgagaagctgctcacctaccaccaccgccacctccctccggtgtgatggcgcaactgggcgaccggagacacgccccctcgaggatgtcgttttcatcccgacatcgcacgccatcgacggggagttgcgcgagtgggagagcacagcggcggtcacctaggcgatgtgtgccccgccatctgtcaccgccaaagacgtcgagcgcaccatcgccgacaagttcggccttcgcacaggggagctcgccgtgttgctccactatccagaggccttcctcctcaagttcaagcaccgccaccattgcgaggaagctgttaagcaggcttcgccaagggtcggggaattgaagtccacttcattcaatggcgcagcttgaagaacgccgccggctccgccctcatgtaccgggtcaagctatgcctcgacggcgtcccgatgcatctttgggcgcctgacatcaccgagcgcatcatcagccggacttgtaccctggagttggtggagattgatctggtccaccccgtcgaagccggcgacatgagagtgaacttgctctgggcatggactccgaatccgagccgcatccacaagcgcgtgtggcgcgccaaacccgcgaccctctcctcgaatcgatcacgattttggagatgccgccggagcactggcaacagggggtcaagcatctagtcctcttccacatcgaggagatccacgattacaccgcggtggccgtcgacctccgcaatcctaagtcctgcaggccggtgacacgcactctgccgtcatggcacttgggcgttctggacggtgagcgccccccgccgcgcctctttgaatatttccctcaccatctgccgccgccgctgacctataccttccgccacggccgcgcggaaggcgtggaggacaatgacgctgctctccaacaggaggctcgcgaccaaggaagcagaacagtccgggacgccattgatcgtgatggtgaacgactccatggcgaggaacaccgcgacaggcgccacgacagccgcgataatcgtggcggccaagacaggcgcagaggccgtaacaggagatacaacaacgatcacccagacgatgatctccaccatggcgggcagcgcgacaacgactacgacgacgatcgcgataacaggggacgtgatgtcacatgcgggcgaggtggcatccgcggcctggacgttaacttccggtgcgaacgcacgcgctcaccgcgcgcccgtgaccgtggcgacacaaggcggcgcgacgggcggcgtcatcaggctggctgcggtgacaaggaagacagggacaatgactgcggaaacggcgactccccccaagcggccctcactccgaccgttgcggcatcgtcctcggcacggaatgctcacctgacatcgcccccgttcgacaaggggcctctgctcccgccgcgtcgtccgcacgatggagcggggtatgaagcccggtccgctgcgtccatcccggcggcgcgggttttcgcccgcatcaacgaggccgttgcggcagcctcggcggaaggggcactgcggcagatgctagttacggccggtgtggcggtggcgcttgacaagctcgccgcgccggtggcgctcgacaaacccgccgcaaatgctgcggtgccatcaccgatggtgacagccatggcgtcgctggcgacgatcagttcgactacaaggaagctattgccgatcgcgtccacagaaaagacgctgctgtccctgaacgctgagtgcgctgcggcgccaactcttcaagacgcgcttgcgacgaatggctcgtccccggccaaggacaccgagacagcaccggcgcctgacatcgccgaattcgactccatttaggtaaccccgccacacgtcctcttcaaagaacttcccccagcaatcctctccacgccgcaggtgctgatcgacatcgccggagacacgcaggtgccgatcccccctgatgatgcactggaggtcgttccaattccagtgactgctgacatgctgggtgaaggacggcagaggagtccaaggctggcccgacagccgatggctggcctaccgatgtcgctgcgggcgcagctcaatctctgccggcgcctgggtacggttccaacggaaggagtcctcaccgacaaggcactcgccgacttcaaagcgatgttcaacaagacgcaatcgacgccctagtgcagctggtcggctttgacaaggaagacgcgaaggcggcggacatggctctggcgaattacctaggcccctctgacattggctgccaggaggagattgctgcggcgtgagcaagctgtgctctgcgcaccggcaaacggagtcctctgtctccatgtatcgatttcctttgcttccttcgtatccgcgtgagactcggacgcgcgctaccgttaagaggggcggcatcgccagacattgctactccgctattcgcagcaacttcgcgaatcagcctctccctactcggtgccgcaactccgcacccaaacaacatcgacaatgttagccaattgtggcgatgacgccagcaaacccccacggccgtcatgcctcgctgacggccagcacaaacgacgcaattctaagggcgccaacgatagcactctctgcgattgtcgacgactgggctgctgtttcgccctcacgtctcctcctaccgccctcgatgctaggtgtggtacaaaaacggcgctgccacgggcacaacgtggggcgacgcacagcgctgcaatacgcgcggctgtcatccccatcagtttcgccctccacctccagcatcaggcatccccggcccaagtcttttcaggccaaggtcttctcaaaccggcccaatttcctgggggccctcaacatgtcttccggcctaggctcatctccccccggctggacttcgtgcaaatggactcggcctcggtccatgagccagatcgaccaactagattgggccgactaccttttagcctgatagcaccgacacggctgtcacccctcggtttcgtgcacaactcccccctgagaaatactggttacacatgacatacccgataatagacatcctctcctggaacgtccgaggtttgaatagaccggccagaagagcgacaatgagagagctcttcaagaagccaaaccccatatcgcttgccttcaagaaacaaaaatgagtaacattgatgccagactggtacattcccttggcgggggacgcctaaaatcttttcaattcaagccagcgacaggaccgctaggaacaagaggtggcatcctgatcctctggaatgaggattttgctgagctcaaagactttgtgcaaggaacattctcgctttcggccacagtctccttaaaagaatgtcagaccaccttcctacttacggctgtttatgggccaaccagagagagtgccaagcaaacattcctgagagaaccgcggaacaccaagccatctgacaattcaaaatggctggtgctcggagacttcaacataatctacaaggcttccgacaaaaacaatgcaaacctcaatcgcagacaaatgcgaattttcaaagaaaccctcaacgcttgcgagctcaaggaggttgcacttcagaataggcgatacacctggagtaatgaacaagacaacccaaccctcgtcaaactggacccgtttttttgcaacgctagctgggacacaacattcgagagacatctattacatgccctatccaccttactctcagaccactgtccgctaatgctaaccggacaaggggaggccccacgatcgagaacttttcggttcgagaacttttggatccagctcccaggcttccacgaggcggtacaagaagcctggacagccccccaaccccatcatgaacctcaccatagaatctttcacaaattgggatgtacggccaaaagactaagatcgtggagcaaaaaattgatttcgcaggggaagcttcatttacacttggcgctcgagattattcttcaatttgatatataccaagagtcaaggcaactcactcaagccgaactcacgctaagaaggaaccttaaagacagagtgttgggtcttgcagtggtggaaagagcccgtagaacacaagctacacgaatcaccaatctcaaagagggggatgcaaatacgaagttctttcatttgaggatgaatgcaagaaagagaaaaaacttcattcagaggctacgagtgggaaacatgtggaaagtaaaacacgatgaaaaagctgctgttataaaagagcactttcagaccttcatggcacacccagctccacgctcaaaagatcttgactgggacgccctgcagttaccgactttcgacagctccgtaattagtggccccatcacggaagaggaggttcacgtggcacttaaacagtctcccagcgacaaagcgcctggtccggacggcttcacaggtgctttctataaagcctgttgggaaacgataaaagatgacatcatggcggtcattcattccttcgaccggctacgaagtaataacttctcgatcctcaattcagcaaatgtggtgctcatcccgaaaaaggagggagctgaatgcgtaggagactacaggctgatcagtctcatacacggagttgggaagctaatttcaaaggtacttgcactgcgcttgcagcctcacatggggatcttgattagtcatgcccagagtgctttcataaagaaaatatgcacacatgacaactttatgtatgtgaggaatctgacaagaaaattccaccaaacgagaacgccgaatcttctgttgaagctcgacataaccaaagcttttgattcggttagatgggattacttaatcgacctcctccagagaaaaggcttcacatctcggtggactaactgggtctcaaacatcctagcctcatcgacaacaagggtcctcctcaatggatgcccaggatcacctataaagcatggaagaggcctctggcagggtgaccccctctcgccgctgctagttattttagccatcgacccactccaccaccttctagagaaagcaacagaattaggacacatgtcccctcttcgcggaagagctcccagatttcgaaccttcctctatgcagatgatgtggccatattcgtgaacccaagtgtccaagacatgacaaatctcactggcattctaagtgattttgggcaagtgac

SEQ ID NO: 38006 - DNA, 3590 bp, Oryza sativa
gccaaaagatttgggtggcctaggtgttatgaacctacaatacttcgcatcatctctaaggctaagatggctttggaacgaatggatggcgtcggataaaccttgggtgggatctgtgctaccatgcaatcagctagacaaagacctcttcgcggccgcaacaacaataacggtgggagatggcaaaattgcacgcttttggagctcaaaatggctagacaatcaaactccgcaattgattgccccagatattttcgtggcctctagaagaaagaatagaactgtgcatgatgccttagcagaaaacaagtggatacgagacattgatgtctcttgcatctccgaggcgaatcacctccaacagtatgtccgcctctggagaatgatcagggatatgaggcctctaagcgaaaaccacgacagcatccgatggaacctcacagcaaatgggtagtactcggcaaaatcggcctatcgactacaattccttggggctgccaaatctaccttctatcagtcaatctggaaggcatgggcaccgccgaagtgcaagttcttctcttggctggtaacgcaaaatagagtatggacggcagacaggctggaaaaagaggatggcaaaaccaaaagatttgcccactttgctacaatgttgatgaatcggccctgcatctcctggccaaatgcaaactcacaaagaggatatgggcagaaatgcagagatggaccgggactgaccttcagatggacaattgggaaaactatcagtcagtcgagcaatggtggacactcgtaacggaatctccaaacaccccacgcaagcctctcaggaccctggtgattttaatctcgtgggaaatctggtgcaaaagaaacgcaagaatcttccgcaacaatgcatctacgccatcctcagcaaagatcaaggaggaagggagagcatgggtcaaagcaggggcttcaatcctccaggagttcgaaattttgggagatatcacttaatccctgcgttttgcctctctttttgcgggttatttgttttgctttttttcatctaaccctatatatatctcgctataattttctcctgctctattaatatataaagggcaaaacttttgccttccttcaaaaacaattggattcaacttgactggctcatattgtatcattactatacatattatcgcttgcatttattcctctttttagccataattatctctatttaatccagaggtcgattaggcaccaattctgcactaacatataactatacgccgtgttaacattctgttaaaaacaactaataagacttgctaaatggacctataattatcgatgctaccaatatattacgatcattagttcctttatgtcatgtttttttaaatatattttagttcatgctgatttgatttaagatttaagttactatatccaatatcttctaatctcatttcattgatttgcttatgtaaactttatagagattctcacactaatatatcgtctagttcacagtacattatttggtccatttgacctgtatcttgcacatttcattcagctggttgcagcagtagacacaaaatgccctggagaaaaacaaattaagggatggcagctgaggtggaaggggaatagggcggtcgggcgatgatgagaaggccacagaaggccatgatttggacgcttaattggcccggggatagcgcacatgagcacacgttgtttttagagcaaggataataatacagccagctgcttacttatagcctatctattagctaactcatatagtggttaattcttcactataaatatatggtccatatatttatctcacagattttcttggttcctgtgtctaagcctcttttcttggttcttggttctcatctctctcctcttttctctcatccatcccagtattcagccttttaatagcccactattggtggtggcccatgcttactgttagttttgtcgccttggacgccgagccacacatggcatgagatatttttctcaatccaacgaactcgcctttaattaattgggctggttaattagtttattaattgtagcaaaaggtagcacgcacccactactttgtcctctcttgacctttggcgattaattacgccctttgattctgctccctctgattaaaaaaaaacatagtaacatcttctagtacaataatgaatctagatagagaattatctagattcattatactttagggacttgttcactttgctactttttccgtttcacaatataagtcattctagtattccccacattcatattgatgctagtgaatctagacatatatatctatctagattcattaacatcaatatgaatgtggagaatgctagaatgacttacattataaaacggagggagtactattttcaaccttaccaagttttgtcattgctaaattttggtaaggttgccaaaattttggtaaggttaccaaattttggcaagatttcatacgcacttactaaaatttggcaacaaactaaatgtagccatttttttataactttatcaaaaagaaggtaaggttgaaaatggtagtaaagtgaacaagcccatatttttttaggacggaaagagtaattgacgtggcgaactggcgatgatgcccattgcaaaaaagagtacacgtgccagtactactgggtttaactgtctgtcttatttttgttatttttagtttattcattaaattattattgtgtattgtttgatttcagattttaaaaatatatcttttaaaagctttcttgcactacattactcaaaccactaggtttatatatattacataatatttaattatttctatagtcaagtagatgatccgtgccaataaatttgctgaatttaatttctccctactgaataatctatttcaaatactcataaattataatcaggtacactcacacacatatgacacttatgtttcacgctcataggtgcatcctatcctatgtttaggtaggtgaagatcgtataccacgatgtcactactattatagttattaatatgtaggtctcatcctcctattacctcacgcgttagtgtttataatgctaataccattcttgtgaataatatgaaccctgtttaaaaagggattggaatcacatgaatatgaggtactcatacgtacttagattggcacaatccatcacaagtaccataatctattactccctccattttttaatagatgacgccgttgacttttgaatatatgtttgaccatttgtcttattcaaaaaattttatgtaaatgtatagatacaaatcatgcttaaagtactttgagtgataaaacaactcacaacaaaataaattataattacgtaaattttttgaataagacaaatggtcaaacatgtgataaaaggttaacggcgtcatctattaaaaaacagaggtagtatgtatgctcacacatctttatatttgcataaggagaaagtactgattttcttttcaaattaagaggtggaagttgttctcagcttgagaaatgtttttcccgggctgcaggaat

SEQ ID NO: 38007 - DNA, 978 bp, Oryza sativa
  unsure (1)..(978): unsure at all n locations
gggcactgcgggggtggtgtgatggtggttaaggggccctgctgcggcggtccagcgccaaaggggcgttgaggtggcacggccgcgaagggcgccgcaggggacgcagcagcctgcgcggggctgaagcggcgccgaacgacggggacggcggggcagcggcggcgccgggcatgaaggcggagacgggcctcccgggtaccccctgcggcggcctatcgttccccatcggcggctgcatcgtcgggcactccgctgctgtcacgcattgcttggcgcagcttcccccactccgccgcctccgcgtaacccgttgccgccgccgctccatggcccccgccttccgcccgtagataggctcagcaatacccctgtctgattcccgttccgcacttacgtttctccgccggaatccacagtagcacccgtcgccatgtccggctgcaaccgccgcccgtcgccccagccaaccctatcccggcccctcgtcactctaccttggccaccgacggccgtaggtctgcgcctctgccgcaccaaccctcaaccccacttcccttcggaaactgatctcctcctcctccctggccgccgcggtgccgtccacctccaaaatccctgatgccggagttacatttggtagggggaatagccaaataggagaagcacacaacctctttgggagccagtgggctgggaatgtnngttctcgaaattggaaatgtcgaanccgnaaaccccaaaggggggccccccgccaccgactccctgacagcctccaccccgcggcctgagagagagaaagagtgagagagaagagagagaggaagagtatgacatgtgggtctcacattttgagatnaacanaatgctgactggactggcacgcgtaccccacgtacaccaaaaccaccgtggattaggtcgaggagggaaattcatccgatttatatagttggggatgaagaatatccggtt

SEQ ID NO: 38008 - DNA, 1110 bp, Oryza sativa
aaaacatcacatcgtatctttcgacacatgcatggagcattaaatgtagattaaaagaaaaactaattgtaaagttatggggaaatcacgagacgaatcttttgagcctaattagtccatgattagccataagtgctacagtaacccacatgtgctaatggcggattaattaggctcaaaagattcgtctcgcggtttccaggcgagttttgaaattagttttttcattcgtgtccgaaaaccccttccgatattcggttaaacgtctgatgtgacacctaaaaatttttatttcgtgaactaaacagaccctatgtagtttctactcataaattgctactcctacgctcatgaatcactgaagcgtcatgtttcgaatgtttcgacgtgacgactgtgatgcttcagtgacttttcgaagcgtcatgattcgacgtgacgcagttggtttggaaaagtaacggtgatggcatgtctcgaattttaaaaaatttcaatggcacacagtagttttcacaaatagtagtggtattttttcaaaccagaaatttgtaatggcacgagtccattaacccaatataatataagggtcacatcctccaaaatctcttatattatacgatggagggagcacggtctactaatactgtctattccctccttttcaggttataatgtaatttgactttggtcaaagtcaaattgttttaaaattgactaagtttatagacaaatatagtaatatttataatactaaattatcttcatcaaatcaataatcgaatatattttcataataagtttgttttgggttgaaaatgttatcgttttttctgcaaacttgatcaaacttaaagcagtttgactttgaccaaagtcaaaaggtcttataacctaaaacgaatggagtattaaagaaattaatattcagatttattaatatgtaaaaacgacgctaatatatttgtcaataaaaacacattcatatggttatatctttagttaatgtttttataaatatattaaaaatattaaaacatgaatattgcagacaccgaatgttctgaacgatgagtataaaacagagatagtaatagtacattgacggag

SEQ ID NO: 38009 - DNA, 607 bp, Oryza sativa
cgctcgtcagacggtgctgggtgcccccgaccctcaggaaggccccgaggccactgcgggaaggccgcacctatcgccctctgaccccgaggctaaccctgtaccgattcgacccgggagagagcagggaggagaggcccccgagccgaacggtggcccaaggctcccgacgaccggagatggccctctgcccgcttgtccgacgacgccaggagcccccgactcccaggacggccccgaggccactgtgggaaggccgcccctgtcatcctccgaccccgaggtcatcggcacagaagacgagtgcgccccgaggggccacttggacgaagagcgccccggggatatggcccctagcgaagaggatcggccccaccgaaaagtgcagcgacctgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtgcacgacgggtgttaaaatgggcaatcgagctttctgag

SEQ ID NO: 38010 - DNA, 759 bp, Oryza sativa
ttcctgcagcccttgatgagttgctctcaaaggcacggatctgttcaagatcacgcccggacctagcatctgctcgtgcataggttggatacaccttcacagggcaccgggttcgtaaaattgatctccaatatgggaaaaaatttctccttgtatatgtgggatcccatcctctgcctacttcctttctcccagcctgttacatagtatttcaataaaagtacagcattggaaaaacaaacagacataatatattcatattggtcagccacaatctctcacttgagaggttctatgttaattaacacaaagtattggtgttttgttggatatgaatggttttactacagtgcagtactgcttaagcaacatgataagctgttgaagcagcagaaggcatgctacaaacatagcaagcgaaatatttgcttttgttgttgcctctaacaacttaataatattacactgcatcttccttcatcagaatcttcctcagagagaagatgcaagccccctttgtcaagtctcagtgttgatattacttgggaattgaaacaattcagctatgttattgagctaattatgcccaacggggttttagccaggcgctagtttaatttcattatttgtattatttcctttattattttttattgcatttaccccttatctttggtaaagaacctgatgagaaacacagtagtctcgatcacattagcgtggcagagatgaatcataattggaatgtgtggcattgca

SEQ ID NO: 38011 - DNA, 10213 bp, Oryza sativa
tcctgcacccccaaacgaaacttggcaaaaaaaaaagaaaaactcatgggcataacttttctactcatgctttacttacttcagcagcttcaagagcctgaatgcaccagtagcacaagtgctgaagctccttttggattgatgattgtttgcaaatggtgggattcttcccactgaatcaagcatacgattttgagttcgggtagatcgattggccattgagttactctgaaagatacggatctgttcaagatcacgcccagaattagcatctgctcttgcatagactggatacaccttcacaggacacagggttcgtaaaactgatctccaatatgggaaaaaatttctccttgtatacgtgggatcccatcctccgcctacttcctttctcccagcctgtcacatatttcaatataagtacagcattaaaaaaaacagaaacatccatatttcagcgtggtcagccatgatctctcgcttgagattttgttagatagtccctttatcccataatataaggcatggtcaaacttgacacggtcttcaaaactaatctttgtcttataatttctcatgtattataagatttgtagtaacaaaattataaccatatgaaagtaaattcaaatgtcaatccaatgatatagtttttagcaagtaaaattcaattcatattgtactaaatgttgaccaaaatgttttgaaggtgaaatcttgaaatgcgtgggcgtcttatattatgggatggagggagtatgaatgatttcactacagtgtactagtacttaagtagtacgcttaagcaacatgataagctgttgaaccagcacaaggcatgccacgaacatagcaagcaaaacatggttttgttaatgcatcaaacaactactaatattacactgcacattcctttatcagaatcttcctcacagacaaaaaaaaaatcagatccaacaaatcattcaagaacactaataccgggcgctagtttaatttcaatatttgtattatttcctttactttttattgcattaccccttttctttggtaaagaacctgatgagaaacacactagtctcgatcacattagcatggcagagatgaatcatagttgaaatgcgtggcattgcaataggccatctgtatttggaggcaattcaaagcaatgggattcgtcaaatttttcaatttgttacctggttttgtaaaaaagttggtgtatctttttttaaaaaaaatcaaacaaggggagggcagaaattcctatagctaactttctgctgccaatttattactagtcattagtcattaccaaacaccattctagtcgaaacaagaccaaacgcagttatcacaagatcatgtatccacaaaaaaagaagaaaaatatatgttagcataatgtaactaaagcaaagacatttttatctctaacttacctattatattttcagatttgttcacaagatactacttctaggacaataccctgacatataagagttcgcattgctccatacaaaggatagtttaaacatgtaaaggtacagaaattgaagcatatgtgtagaccattattggcgaaacaccgccaagaccaagaacttccacaggggggtgtggactagagataggtcttcagatcataacaatggactagtaaccaaatctgacaacagactaatcatgcaagtgacttatccgactgctcccccctgcacactacagtaccacaaaatactatttgtgtggactatacctcacctagtacagctcacaacaaggcactttacagagcaaggtgaagatagagatgctctaatacagtagtatttgattatctttaccttttcctccgaagcgtgccgattagctgtttctgtaaatgccatgtttgcatctataagccatattctccataaaaaaaaagaggttagtgctaattttgttaaatgtaaaaagaatcacttgagcccaacacacctttgctacatgactctctctccatttcgcagtcataaggctgacttcaagaaaaaagtggaagacaaaattaaataatcagcaaagtaaacatgtattctcatagaaaactattgtgtgaagcaatacaaagagaagtacaggttcatagtgtcaatgacttctgcagtggggtaaaacccatactccttgaggatagttgaaacatgttccaaaacctccacatggggcgcctgaattgacataaaagctgttgtataagctagagcaaaaataaacagaaaaggcaatatgccgctagcatagatatatcatatatacaatttaggaatcatataaccaatgatagcagagagatgatggaaagaattgttcggaggagaaaattgcaattatacaatatgaattggaaggcaatagaatagtgtgcaaaaaacagtaagaaacatacaatcgcattcattttgctacatggttttatagactacataacatacatattcacattcatctagattgatttatcttatagttatcttaaagcaaagcctcttagattccaaaagttctgtaatcagagattataatctacacacttcaaaggtacgagttaagaactgcatcacacttctgtatgtttaaactttacagtcgttcagttattcaaattccaactgtaagcattcgaaatcacctcgattgttttatctttatttctcaaagagaaatgtgtcaatttcttcaggctttatgatataaaatgaagttcagacagacttaaagaggtcatgaattgcatactagtgtttgttgagctaaattgaactgtcctctggggtcacagacaagttacggtatgagctctaactccaggtttcttgaaggacctggactttataggctaaataaagtgccttaagcatatattttcagttaacaagaaggttaaattcaaaatctaaatacacccccagctcaagcaccaagaatacccagctcctaaaattcttggagctggagcatatattttggccatgaaaacatgaaagtgcttattttggccaatttatctgccaggcatccagaaaataaacaaagataaatgaaacaagtgcatgccttttgttcatatgcaccatgtgctattaatagcattaagggtgtgttcaggaggaggggttgggaacccctcctctccggcatgcaaaaagaagcacgcatgagcatataactaattaagtattagcttttttaaaaaaatgaattaatgtttttttaaacaactttcctataaaacttcgcacaaaaacacaccatttaatagtttgggaagcgttgcatggaaaacaagggaggtcaagttgggaagatagacttaagaacacagtctaagcctatcaaacactttatgttgattgctaaaaatggtactcctactaggaagtgacaaccagaaaatagacataagggaagcttcaaaaactacattggcatttcacactgtacatgtgaagtgatggacagtgaagtggatggaaagttttttaatctaaataacatcttgcgtatttgaaaaattaataagaacagaatttagtgataaaaacataagaaaacacgctaaattgatttatactacatattgaaaaaattccaaagttttaatatgaaactacaccattatgaccatccagcatagctacagaagttcgctatatatattcatttgtaaacacaaggtcagcaattttagtatcaaaccatagaatgcttgtatctacagaaccacaaattgaattaatctagtaatgagattaatacagattcattagctgttttacatatagcatttcatacaaactaaaaagtagattcgttatttatggcataatcatgtagtaatcagttatcagatgcataaaaaatgtagtaaacaaaagagatatggttttaaagcaaactccatccaacgcttttaatttgatagaagatgaaaagtaatcctttttatttcaagtcatatgatttcaacaagagacaactacatcttctcaaattaccactgccttctttagtgcaagcagcaattacggaactcaattcctttacattagttactatgggtggttgagacagactgattcaatgaggtagcaatagacaactttagtagggacatatagtctcctttttgttttcttaatatatgtgcacaaagcatcaagtaagaaaaaaaggatacatctcagtgaggaacgagcatactcaaaattttcagaaactacacttcttgaagaaaaatcacaaactacgcattctttcaatatattgtcagaaaactggacccttcttggcatgagctgcaacattaggcccaaaggtcaaccactctgaggtcagtagagccacatgtgcatgacatgtggttcatactccctccttccaaaagtctaagttctatttcattctttggtttttccaaaagtctaagtcctatttgtagtcactatgtgctatattatattttttatcggaactcaaaaagtcattttagtacttattggttgcatgttcatttggttttgtcacatgatgaatgagttaattacaccttggtcttggtgcaaaaagaaatagaacttagacttttggaaggagggagtaattgtcaacactcaacagctggtaaaatgtgcagctttatgataaataaatataaatctgggataatggttcggaaaaattgttcagtgataattttgagcttggaagtgtaattctctgaaatttatgtaaaaagatgggcagtagttcatagataattgctgtaagaaaagttcattggtttaagcaagacacctctcaaaacattgaagcaaagcataaaacaaaattggcataaaatcaaatgcaaggttcaatgaaaaataacacttccatactccaagttacaccaaagattaagaaaacctcatgtagtcatgtgtattacatatacaatagttcagtacaaaatataaatgtgttgcaatattattgttaatttaggcttggctttcagataaaatacaccaactctggaattcagatattaaatctcatatcagtaaacaacatcaactacctgtgaaggttgagtttcctccagaatctttcttctctgagaagctagttgggaagattcagggatggaaatatggaatagaacctatctcatgactaatgaaatcctatctccaatcaagagtcttaggtattcaatgcccctatctccgatcacctaacagaacaaacaaagctatgctactgaatgaaacaagagtctggttgatcggagataggatttcagtagttatgaaatcttgcgaaactgttagttttacaaaagttcacttctgtatagatttgttaaagtatgaactcttatcacaaagttatcaaatataacatttattattattattattattattattattttcagtcaacacaagaattattaacattcttcttgctaagaccacatgtattttttaaacaacagctcttacaatggtcaaaatacaaatattaaaaatattaagtaacatgcgtcagaggcaccacagctgcaatataccaaacatgcatacctctgaatgcgcctgaacgtatgcagaaagaggttcaccagcttgggaaattacatcaacaagcaggcctgtgcaatcaataagtgccctcttttcctcccgaagcttctgtgccattccatttgaaactttcccccatctcaaggcaaatgaaagcctcagtatacgcttgtacataatgtcatacccatttttctttctactgccatttatcttggaggaacatccccctcggatctgctcctgagcagccagtagtagaattgcggtctggataagttttccattctcaatataattccagagctcttcaaggagattatttgtttttcctgcaagtagtctagttgtatccaggaagatcttctgttaaaacaaaaggaacaaaaatctaagtgccatttagcatttttatgtgcaagcaagtagtgccgattaactttctatatatggtttcatttcttcctatcaaagtaattatggattagggacaatcttcctatcaaagtaattatggattgaggcaaagaaaataaaattacttactagcaacattttagtatattttattgaagactctccttgtctttaactatatgaagatgcactaacacaaagtaagacaaaagattaacaaagggaaactttactccctctgacaagtggagacaaaaggatgtttagtccttaatataactaattcataataacagctgtctgggatctatggcatgacaacagttaattactctttatgtcatgctgcaaattaaaagtactccagtactttgcatatatatggagggaagagaaacaaaccatttcaggtaaacacagcagatggaaaagcttgtagatataatccagatgatcctggccgggagaaagattgtcctcaagatacttatgcaggcaagtgttctcaatcgcgatatggagcaggagtaggccatcgatgacatcgtcgccaaccgtgcgtacgttggctgatgcaccatggcgtaagagcagcttgatcatctcaatagagaacctttcagcagcttcatggagcgggaagtatccatatttggttacgcagttgggattggcatgcaccccaaggagctcaggtgccctgccctccaatacaactttcgcgcatcgcagggaattgaaactgaccatgcaggttaaggtttgtgcggtgatggtgagattccatgacatggtatagcccttccagttcttgaataatcggaggaagcaacgtgcactatcctttataaagatgggctccaattggtcatatttgtccaagaaggtataacacatccactagatggatccatcacattcgaaaaaaaattgaggcatcagttatccaactaacaaagcacaacaaaataaactgttttgaggtttatggaggtgcatatatgacaacaacaataacaaaaccttgtgagcaagaaagttggggtgggctagagatgaaaccaaacatgaagcacggagaagggaagacagaatataagagcaggtacaatagcagactataaaccagttataaacaaatatcgaggaaataaaagaggagagagaatagcagcgggctacagatttatagccagttgcaacacggactccaaaatataatgtgtgtataacaggtgggaccatgtattaatagtatagtatatgtttataggtgactattgtatgaattggctattaagttgactataggtgatttggagttagtagttggctatactattaaacttgctctaaggggatctacagcctatcatggttcagacatgtgaatccagatgctcttatttaaggttcatattatgacagcattaaataatcaatggttcagtagacttaagtaccctataatattacaggattaaacaaaataattaatataatggaatgattcatcaattgaattctgtaaatgaaggtaacacaaacctcgggagcagggtctgggatgattatgtcatttgctatggtcttggcaatcgaaatattcctttcatccataaactgaaagagacaatgtcaacagtcagcactaggggaagaaaatatatcgtggctgggtagttatcataccttgtcaatctttttataatctaatccctcagcaagttcaaaacgagggggagggtgccgtggatacttatttcttactggaattgatccatctttatcattgccattatttttgtcgcatgcagctgcctcctttttccacgtagcataatcgggtgccttaaatctcaactccatcctttcgggtttactttcctggaacaaggaagtttgatctcgaatcacactccaaacaagataactggagtacaaggcatgcaatggtcaaagaatgatccagaagaccatgtgataaaaatgagtccttccatctaaaatggatcagacatcactgaaacatactaaaacatatttagcgaatagaaagcatatggagactcagacttcatacatctctatcctgagatgtaacaatgctatatgcgaaatgaagggacaaacagtgctagaaactcggatgcatataaagtgtatctagaaacgaaaagcgaaaagccaattttgagagtgcgaatataaacaatggaaaatatagaaaccaaaagctaaatttgggagtggaaatctagaaaccagaaggctatggaaatatagaaactaaaagctaaatttgagagcgctagaaactctgatacatagaaattatggaaatctagaaaccaaaaactgaaaaatattcactaacacccagattatttttttcttggttgggggaactgcagtaaaaccctagcttccagatctgggagagaagataagaagttaaggaaaattcaaaggaaagaggatgcgcatgcttcgggacgggtgctcaccggaggcggaagcagaaggacgacggcacccacctcgcgggagatggatgggaagcggcgcaggcggcgaggcgaggcgcggcgggcgaaactagagaagagacggtagtagaggccgagaagaccgggagattgacttgggccggcgcaaggagtatcttcattcctatatagaataagttcactttgagtccctctatttgtcgcccagtcccattttcgttccttggtcgcaaaacagggtacgacgggtcccccaacttacgaaatcagtgcaaatgaggtccctcggtggtatttagggttgaaaacggagcggatacggatggataatgctcataccatattcgttttcgtattttttaccggatacgaaaacgaatatggatagctcgaatacggaaacgaatacggattatctcgaatacgaataagaatcgaatatgatcgggcacgaatacggaaacaaatttttctcggaacacgaaaaccaactcaacttctaatagaaacaaataccaacatatataattagctcattttatataaaatgaagtataatttataaatattttttaaaatttaaataatattaatagtatggactagtgttaagagataaactactattaaatatatataaatgtatattgaaggttctagaattaaaagaaatggggtatgtctcatggctttggggatatccgaaatatttatccgtttcccacggaaacctttatcccaatttgtttttttttccggggaaaaaaatcccgtttttttttccgtcccaaaatttccaaaaatttcccctcccaaggggtgttctttttcctttttttccaaaaaggggagaaaaatttcccttccattttatccctagagggattgggccccggtttgcctaaaggggggcctacatggctcctttgactaatcctttggcttacgtgtcattgacgtggtgcttaggtggcaattaaataaaaaaataaaggcagcaaaaatgaaaataaaaaaattaaacaaaatatgtgggacccacatatcggtaaaaaaagaaaaagggcccacatgtcagtgggtcccacttcttcaacctcaccctctctacttatttctccttcaatgacgccggcgtgagagaagcggcgtgcggcgggcggcaggagaggagcggcaggcagccgaagtggaccggcgtgcggcgtgcggtgggcggaagacaacgggagaggaccagcgggcgacgggcggcagtcggcaggcggctggagtggagcagcgtgcggcgggcggaagatccgcctcctcatctccatcgtcgcctcctctgcgatggcgcatgccactgtcgctgccgtcccggaagatccggcgagggaagaccacaatcgcggaggtcgccgccgacatctccctccccgcccgcagccatcatcagccagagcggctccccattgaggccgccatcgacatctccccgttcgcggccaccgtcaactagagcggctcctcgtcgaggccgccaccaacatctccccgcccgcggccgacaaggaggaggagagtggctcctggccgctagcttgctccgccgcccttcttgccgctagcttgctctagtcgccggccgtcgtccgctccggcgccgcccgtcctgcttcactg

SEQ ID NO: 38012 - DNA, 3275 bp, Oryza sativa
atgtgggcaatgctagaaagtcttataatatgaaacggaggaagtattaagttcgcttgatgttagcccaagcaatacaatcacgcaaaaattagttagaagctaatttatttcttcacaacctaaaacataccctccaactccagtggtattctgcatttctcagcccccatttattttctcttttatttcaatataaactctatatttttgcgactaattcaaacataaataaatatttctaacacttcgaattgaacaatatttaaattcacaatttggaggcgggaaggagtcgggcggcggggaaggacggtgaccgcggcggctggacggcggtgaggtggctggctgtcggcaacagcggttgccatgcctgcggtggaagaggcacggtggtggtgaccgtgactgcggtggaaggaggcatggcggtctcggacggctagccgagggcgtggcagacggacgcacctgaccggcgcggtagcgattggaggggtcggagaccggcttggcgaagagaggcgcaaccgatggtagtggaggccggcgaggcgcagccggcggagtggaggccggcttggcgcgagaggcgcgccgatggtgggaggccagactagcgcaagaggcgcatttggtggtggaggaggccagtgcagcgtgaggaggcgcgaccggcggtaaaggaggcaaccacggtgtgaggaggagctgccggtgggtgtgtcgcggtgttcggcgcacgaaggctggccggcgggggatgccggtgcagtggtcccacatgcctgcagaggttgagcggtggtggagcatcggtgcgtcagccattgactcgcaggtgatgagcagcgggtgaaaacctagttcggccttggccgggccgacaacgatggttcattccctctcatgagggcgttgtcgtgccgtctcatccctcaagggtggttgccttattgccaggcgaaagcccaatctaggctcttttgagtccttgacggacggcggcggcggttttccgtcgcttctctctttggagacatcgtttaggcatccccttgccgaaaccactcaatcgattggtgcaagcacgctctaggatagagttaggctttgtgttggttgtaagggagtttttgggcgatctcgtctgtgttcctttgttggcctagcggcggtcagtcacgcttagcggcggctggtccggtgctagccttctcccggacctgtgtgttggcgctggcggtatgtgggtggtggttttttcatgctctatcaatagaacttgtgcgagtcgtttaaaaaaacaaattcacaattttaaacaccgcgatttaaattcaaaatctaaatttcaaatgaaaacgtcatacgtacaagaattgaccaaagttttcgacacattaatcacaatcaggtttatactaattaataacatatcaaaactcttaacaaataacatatggaatcacttaacgaagttctcgacacgaaacgaagttcgataaagaaaaataaagagttaattagatccatgtcattgccaaatatgttgtattagaaaaatatcagtgctatttataaaatcagatgggtgccacttcaatcttctaaacttaaaacaatggcactctttgcccctgtcatgaagatgcatgccgctgttgctcctccgcttcccctttctgcaggccactccacatcacagcgatgctcaccgagctccctgtggaggaggacgacacgatgtctgattctcgacatcgtcggattgatttatcgtttatgttgatatcgattcttcctcactttattgcgattctctacaaaaggttagtagacctaatactagtgaaatattatcactagttctcctctattttggtaatattgacggtcgaaactgatcgataatgaccgtcaacaaaaccctacaaatttgaacctttgcttgtccttgggcgcgggccgacatatcggctgcagtgagatgaaaggaaggagtagaggggccatctctcctctctttcatcccgaaaattataaaataatacgtctagtgtcctacggccaattacacaacttttatagtgtccatatgtagtgttaattttttacggtgtccctcagccaattacacgtttttttcgtgtcccgtaacaaattttggcaaaaaaaaaaatcatggcggctactgttccaccactgccgcctaccggggggggggggggcgctacggcaaagtggtccaaaagcatgacgaaacgcggccgcactgactgacctggaagttggttgcgcgcttgcaagcgcggcgcggaggaggtggagaagacgccggctgcggcgacgccgaggacgaggaggaggaggtggtggaggcgtggcctcgggtgtgatgggagagaagccggcaaggcttgggagaaatgcggtgcacggcgcgtggaccccacgtgtcagtgggcctgcccctgcgcttctctcgcttcgcttgcccgagagaaacccaaaaaaagggagtcgctggaatagcatagcttcatggttttttgcatttgtaaattgtttttttcttttttcatggaccaattgagccaagggtaagtacgttcgagaaaaaaaaagaaattgtgaaaaaacaatttgcagatgaaaaaaaagaagaaaagtgacattacagttacagcgaatgcccgctgtttaagagtggcattcgatcgaatcttattttaatgatgatgttttagtgatcgcgtgggagataggtagggagaggtggagatggtccaccacgtggcctgcgaacccatccatctgaatcacaaggggtcctattcttttccccaattctctctattttttggtgggggtcaaggtatgtgtgtgaaaacggtatggaaactttccgaattccggatctatttttgaaaaaagaatctatcggttggattttttttttagaatttttcggaaatggaaatgaattcggaaatattttcttggaaacggaatcgaaaataataagggcagctttcgtcggaactcggaatcggtcggaatctttccggaaattttcttggaatttccaaaaattttgtgactgaaataccctggattcttttttttaagcactaaatagttaatcctatggtgtttggctgttattttttaaaaaatatttgttatgccactccgaagttacataagaatattttttcttgtattaggatttatcaacaacattactctattaaacatagggggtgcag

SEQ ID NO: 38013 - DNA, 635 bp, Oryza sativa
aattgaaacaatttgactttgaccaaagtcaaaaatatcttataacgtaaaatgatggagtatttctttttcttttatataaaatccaccgtttagcggttaagaaaacgtgataatagaaaaatgagaaggttgtagtatggagcgaaagtttagaactaaatcaattgggtcgcatgaacgattaattggaactgtcaactagcgtttgtattacgtccgtccgtgcatctacctaatacgagtatagtgcaatcccacttccactatacgcggaccatttcaattcgattgactttgtctcttaggttgctcgatcatttgcgagaaatttgataatatgtcatccattccaatgccgtgtacttttgcccttcgccacgtacacatgtcagatcttaggtcccgcccaacgccgttgccgctacgcccttccagttgatctatccactcaagatcgatccaagccaagcttgcccgcccctatctatgtgcctcgccgcctcggccacacctttgctgctgtcgtcaagaggaggagctggtaattaaactagcacctgttttcttttcaattaagtaataatataattttcaaatagtaattaagcttatttacacctgcttgcctgctt

SEQ ID NO: 38014 - DNA, 2972 bp, Oryza sativa
tccacccgccgtgcaccgcatttctcccaagccttgcgggcttctcttctctcccatcacactcgaggccacgcctccaccgccgccaccacctcctcctcctcctcgtcggcgtcgccgccgccggcgtcttctccacctcctccgcgccgcgctcgcaaccaccttccaggtcagtcagcgcggccgcgtttcgtcatgcttttggaccactctgtcgtagcccgtagcccctagccccagtaggcggcagtggtggaacactcgccgccgccatgattttttttttttttttttgctcccgggtaatgtggtgcgctggctaattaaggagcagttcgaggttgggggggaggagtagctgaagagttgttgtgttctaggaagaggagcgtgtgggtgtgcagtgctagtagaaatcaggccacgcagattagcatccgctgcgttcctggtcttttagcttgatgatgagctattgcagctttgaggaagaggaggtcccgtttctgtggaaggaaatttcggtttatggaactgtgttccatggcgtgggatactggagtgtttgggggaagattgtgatccaactttgtttttagtgatggatgtgatgtgctcaggctcagcaattaggaaaatacattgtcaagtacagtttgttattctgccaatttcaagtaagtatggaagcagatcagagagaccaggaggtccatgccatttttttacttggatttctctgattgttgaggaaaccagatggctagctttgtttgttcgtcagtacaaattccttctaattgaaaattttgtggttcttgtttctgtttgatgcaactatcttgctttctttcccctgcacattgcattgtactgacctgtttcttttcattccattctgtagattggatgggactataactgaaaccttctgtattaagcttccgcgagggctcacctgcagaacgtgatggtcaccatttactggtgcagcaggcaaaaagttgcatggagcgctacaggctgtacacttttgatttccctgctgttctttttctctggttcaccgcataggatcctcttgaacaagaaacctctcaatttcaaaacagcaccatctaggttattgcgtgagattagcatcagttcaagtcgtgttcagaggtaagttctaaattgagtttctgtagcctcgtgaaggattactacccagagttctaatcttttgtgtttaaaaagggttaacaattcatccgcggagtttgttgcaaacctgaatgaccgtaatgtagaaattgtacaacatatggaagacaacgatcataacatcatcaatgcaactgcaaatgtgacttctgactggagcattgtcaaggaggaattcacatttccagctggaagtgcccctttcaatagctgccatgcttctactattgtagaggtatatgacttctggatacaagtttattttgggtaaaaatgtactataagttacttatagattaattttgtctttttttagactgagaaggatagttttttggtggcttatttcggtggatccaaggaaggtgctcctgatgtgaagatctggctgcagagatacagtgtgggttcgatcatccgggatacttccatttcttattttctttactcagaaaagcggttattcttaagaaccttacctttgtaggatggctgctggcatactccacaagtggctgatgaacaggatgaggtacctatgtggaatcctgttctgtttcagctcccttctcatgagcttcttctcttctacaagattggccaagaagttcagaagtatgaacatgttttatgttatttaatttcttatctcttattcaaatgacaaaaaaaccatatgatagtgcaaaaattgaatgcgactatatgattatttgatattctgatgctcaatataacatgttcaggtggagtggtgccatgaaaagatctctagatggaggaaaaacctggtcggcaagagaacagctaccacctggcatccttggtcctattaagaataaggcatgtctaaatctgtggtgtattgccttccatcttagcaaagcacattgtaaccataaaataaggaaaatattgtcaacctgaatacatatggcagcacaatcattatgggttattaacaagtcagtactcagtagtaatttaattgcctttccattgtgattctcaaaagtttattgatttggttcctgaatggcattttctccaatgtagcctttcttggttgaagatgggcgcttgctatgtgggtcatctgttgaaagctggaactcttggggtgcatggcttgaggtatccattacattgaaaataaaaaaaatcatagactgaactcatgcgtctcacattatgtgtagtggaagttttaattactcttatcaacttaggtcacaaaagatgccggacgaacatggcggaagtatggccctatatatattgaaggcgaaacactaggggtgatccagccagttccctacatgactgccaatgggactattcgagtgttgctgcgatcttttgagacaattggtcgtgtctgcatggctgattctgctgatgggggtgtaacatggagttatgtgcacgagactgaccttcctaacccaaactctggtttgttcatctcctagctaaattagttttctctttgcttcagtacccttgtatagaatagcaaatcctcgaatgctcattagtgaccactgagcactgaacatctgctggtgctgggaacacattattaaacagtttgaagtttccaaaaattttaagatatactgatagatttctgaagaatattaataactctctctctcgacttcaaacctgaagggattgatggagttaagatgaaggatgggagagtactccttgcttacaacaccttctccagaggaacactaaaagttgcagtctccatg

SEQ ID NO: 38015 - DNA, 3145 bp, Oryza sativa
cattggaagatactgaaggcatggagttttcatatcctgcagtgatccagaccatggatgatctcatacatatcacgtacacatacaaccggacacaaattaaggtaatctttctgatgcatattcaaaagaaaatatcgatcttgttttccatcaagaacagttttctgcccgttagtaccttttttaatagtattattgaatgattcacagcatgttgttcttcaacctagcgggaaagtgaggtggtgagtgtgcaactattgggagagttattgctgccaattgcaaggcacgcaagtttttctctatgtgtgtcacatcatattggctggaccgtggtgctaaattggtcatcaatgattctttttttgggtatatttggtcatttgcataatttcttgcaattgtaacctaattaataatctccctgattcctatcaacaatgatattgaacatctgtacatatgccccaaagtttaacataagttgttccgtatatggctgttcttcatgttcatgttgtgataacctaagatattactactttaactgagaacttgagatgtcccttttgctgtgatgcaacttccagaaaataaattatggttatcttgataaaataatatatgtatcaagtttgctttatttaaaaagaaagacttcattattgggcaccatagtatgcttgaataatgatcctctagaaagcagatcctaaatcttattacattatcatccaggtactataatctttagccttttattttctgaattgagcttttcttgttagtaccacaatgggttggaatatagtaaaattcttgtcttgactcttaggccctgtttggatcctccaggctattaaatagccctccggaatcttgctatttaggagtattattaaacgtagattactgaaaaaacccattccataacccctagactattttgcgagacaaatctaacgaggtatattaatccatgatttgctacagtgatgctacagtaatcatccgctaaccaaaactatgaagaaaaggaaatgtctattacaccttgatggatttaacaaaaactcggcctctggtttagggttgctagcagattttgggtaaacagtaggtaactgggatttttctcgtaacagagcaacagaaacagcatttcatgattattagttgttaaggaaccataatcatggtcagtatctcaaaaccaacactacataagaaaagacaaaattatacacacatatacaagttctgaagttcattgtccccactgacacaggtcacagcaaccaacagggaaaaaacattttttttatagatagccaacatcttgtgaaaggaaccttgtatataataagcacccatgtgattctacagtaaacaaagagttgtgccagttatatcaagcatttgtgaacacggtaggcaccattctcttgttcctctctgtgaagagatcttgaaatttacatgtgaatttgtgatctcgtgtactctttatgaaatatacttgcaagttgcaagttactctgacttgtggcacttgatctccctatcaaatttctttctctcttgctgaactcgggcttgcagtttgacctgcctactctcagctctcaggtatgcctcattcctcctaagatgccatcccaacccttgctctatgttttgtatgattagccaatctatcctaagatgccatcccaacccttgctctatgttttgtatgatttgccaatctattctacttatcttatctctattcccaaatagtagcaataagtcaacagattgttccagctgaattctgcttttgtgaaagataaaagaatatggatgtcaaatgctatgatgtgaaaatttccagggtctcacttcgatgctgggaattttttttagataatggatgcttcaatgctgggatagaataatctatcttgaattttatttatgaacttccttcctgtaaggaaactggaaatgcatggggaaagacatacaagtgaaacagtgcctactatacctgcatcaataaaaactgtaaatagaccaggttgtcttctctgcctgcacaggggagtaaagaccacggattaatccttcatatccaagaaaagtgtgacagtgtgtttgaaggatgaaatgtttttttataagaaaaaatctttgtgtacaattattctccttttggcgattcagaaatgaccaataagtggagcgtattgagggaagaatttacattttcagaaggcaacgtacctttcaaaacctgccatgcttccacaattgttgaggtatattatcatccaaactttgttctaattttatttaaattttcttttgatggattatcttctctgtataatgtacctttcctggtcaggttcagaagaatatgtttctggtggcctactttgggggaacacaggaaggtgctgacgatgttaaaatttggctacagagatattacgtatgttaaagttcctatttcctgacggattattgatcttccagcgtatctgtgtattgttattgttcacttgatacacaatacatttaacaatttcacctaatacagaatggctcgtggcactctcctgaagtagttgatgaagtgcccaatgttcctctgtggaaccctgttctcttccagcttccttctggtgagatcctccttttctacaaggttggcaagactgtcgaaaggtgagtgatccattcccatatctgcattcccagcaattaataccccagttaaatgtctgcaccaactgttcagctgaatttgacaatttttgtttagttggagtggatgcatgaaatgctcatcggatggtggtgttatctggtcaaagagagagcaactcccacctggtatccttggccctatcaagaacaaggtgtgtatttgttccagacttgatcagtattttgacactgtcacataacactacgattattctatggacctgcataccttctcatcaacagtgtctcccaatacagcctttcttgctcaaggatggccacctgctctgtggaacatcagttgaaagctggaattcatggggtgcttggcttgaggcaagtcagctgtgagccatcagctgcaactgttcttcaatatctc

SEQ ID NO: 38016 - DNA, 2338 bp, Oryza sativa
  unsure (1)..(2338): unsure at all n locations
aggtttgatgcagtcagtaatcagacatgtggatttgtctcaggagtgaagtttgaactgtaggattggaatgtggaatgtggcaaccaagtgcatgtccagttcgttttttatgggcctgttcactataagctaattttcaaccttaccgaagttcggaaagctaccataaaagtggctacatttagtatgctaccaaaattttggcaactttagtaaaattttggcattgccaaaatttggtaaggtttttttnggcatcaaagtgaacaggccctatattttgcctacatgcttgttcagtgtttactggaattacccaatgacgattgttaattccttcttgacaatctggcaaacatcactcttgtgctgtgttctagtacgtaaataagtgaaaggtgaaactgttgcatttttcagctattttctgattctgatcagcatagccacgttattttgtcattcaaaatagtgataactcacaccctcaagtagccttttttacttatttacccttgtgttctttttttacttatttacccttgtgttctgttggaagtgtctatagttctcagtattccttcacttgttttgaatttcttttctgttcaaattaaacatttaaactagcctacctctagacttaccccagtagaatttctgagtcccatcgaaatcttcctttatcttctctccaactcatctattcttttcctataaaccatcgaagacaacccgatctaaactacaatcccaaggaacactataatcatcgtgcatgctcgctcattcatgaatcttgcgtttaaaataggcgcgaaactttaaccaagtctagtagtttcgaccaatgttttaagagcaagtttaatagtatagctaattactagctccaaatcatctatagccaatataatagctaattcatacaatagttgtttactataatattaatacatggttacacctgtcatacacacattatatctttactataatattaatacatggttacatctgtcatacacacattatatcttagagttcgtgctgcagctggctacagatatgtaacccgctacttttctctctcttcttttatctttttaaaatatgtttatagttgacttatctgctattgtacctgtttaaaaaagaatcctttagtttagtctccttgttccactatcaacttataaagaataaaagctaagcacggtagttaaaagttcgacgtgaaggcatttactgaccgccaggtgctccgccgtcgtgtcgcacaggcagcgccggcgacccagattcccaaaacctcgtcacctttctccgccgcttaccaagaacaagaacaactccctctataaatcgtccacacgttaaactgtccgtggatctcgccgtcgccggcgacatggcctcgtcgcagcaggcggtgcgcgagacggggaggggcagggcgtcgtcgtcgtcggccggcgggaggaaggtgaccttcggttaccacctcgtggagggcaagacgccgcacggcatggaggacctccacgtcgccgagttccgccgcctggacgacggcaacgaggtcggccggcctcttcgccgtgttcgacggccactccggcgccgcgacgtcgccacctacctccgcgagcgcctcttcgacgacatcctccgcgagcccgggttctggaccgacaccgcgccgaccggaaggtgctggtcaggacggcggcgacggcgggtcgacggcggtgacggccatcctgatcaacggcgagacgctggcggtggcgaacgtgggggactcccgcgccgtggcgttcgacgtccgcgcggggcgggcgcagcagctatccgtggaccacgagccgctccgggagcgcgacgccatcgagcactgcggcgggttcgtgacggagatccacggcgacgtgccgcgcgtcgacgcgcagctggcgacgtcgcgcgcgttcggcgaccggcagatcaaggagcacatcagctccgacccgaacgtgaccatcgaggacgtcggcgggcgacgccggcgatggtggcacggagctcgtcgtcctcgccagcgacggggtgtggaaggtgatgtcgaaccaggaggcggtggaggggcacggcggacgcctggaaggcggcggcggagctcgtcggcgaggcgctcgaccggggcagcgaggacgacatcgcctgcgtcgtcgtgcgcctccactgatcggagcatcgtgttcgtggcatgtgtacgacgtgtctcggaaatgctactgtgcgagcgatcgcccttgctcgcccagggcgatcaaattcgcccccccccctccat

SEQ ID NO: 38017 - DNA, 2282 bp, Oryza sativa
tttacaaaccaaaagtttatatattcgattcaaatttgaatttgaattcaaatatttttatatatagtatttctatatatctaaagtttatagacctaaagtttataagttaaaagtttatatacccgtttcaaatttgaatttgaattatatctgattcaatttgaattcaaatattttctatatatagtatttctatacatctaaagtttatacacctaaagtttatacacctaaagtttataaatcaaaagtttgcatacccgattcaaatttgaatttgaattcaaatattagtttatagacctaaagttttataagtcaaaagtttacaaacccgtttcaaatttgaatttaaatttaaatatttttatatatagtattttctatacataattttttttcaactttgtttttttatttttttaaaaaaattatgatgtagtaggaagagaagaaggggaggaggaaggaaaagagtagtgtatagaggggagggggcgatcacccgcccattagcacccccgacgtgtcttgtcagatcgtgatttgctctgacgcgccaaatgctaaaaagctcagaaatatttcaattttcatgcgagatttcagaatttttcttacagcgattggcagaatagagaaacaacatactggaaaattgaagtcaaaactcaaagtcgctctgaattcttatgttttgacttcaattcagaatgtttcttacagcgattggcagaatacgcaatctgtatccatggagcctccatggaacataggaattttcatgttcacagttcacacgtccattactttgaaattcctccattcaaagaggtctgactcgacgaggacttgtaatattgtggtatgatgtttgagatagatttcagctcaagatgtttgagatagatttcagctcaagtaaaacgagaaaatgattagttcggttcattaagttttaaattttacaaaaaaaatatataattaatattctaaaagaattttttaaaagaatatcatttaatattcttaaatatgctgaaagatatgtacttaataatgcaatagcaaggggagtggttggagtggtttaaacacgtttaaaatttcttgttataatgtatttggagtgaattctctctcaaaatcttttttttctataacggattataaacgtgctaacaaaaataggaataaggatgtaatctgcatctgaaacgaacgggcctcgattctaagccaggccgaaacaaagaccgggttgacatgggcttccctcaaggcccaacagaacaaaggaggcccgttcaggcccggcccacgccagcagcgagaaccttccccaaaaaccgtagaaccataacccgcagaaggcaaagccagaagagacgacgcagcagacgccgccgccgtcgttcacgagacccatttcgccacccacccgtgctctccctcctctcctcgtgctcgtggtgggtagggggactaggatactgctagggttttgcgagccatggcgtggaccgccgccgcagccaccgtcaccagggccgccgcaacgccggccgcggagctccgcctgccgctcgccgccggcctcggccgcgcctccttcgccgtcaccggccgtctccgccgcgctgtctccgcgtccctctccaccgccgcggccgccggtacgcatcttcttcttctcgaggtagcattccgttcgcctactgggactggggagggagtcctgctttgttctggccaagaagagggcgtagtagttggggattttgtttgtggccttgtgggggtgttctctctttcatttcaactatatccctgtaaaaatgctcaaaatatcgcatttctagattgttatataatcgattagaggcagccttcagatttttgacaaggcaagcttttggattggattcgtttgttttgttcacataacaaaaaatattgccaaaatgcagggttttctcttatttgtggatgtagatttgagtcgctaataattactagtatactggttaatctctattgagagggcagaaattcagtgtggtttaacgtctacatctgatgtactaaaagcgagcgtgattggctagcgcattgggagtgcgagcttagtcagttaaccacaaaaagtttacatattcatgattcgtgaaccactggtttggctgggctgatagtgcgcctgatggcagcaatagataactagtgtattgcttaaacaaatcacacaaaatagtgtccatttgcagggctgcaggaat

SEQ ID NO: 38018 - DNA, 2514 bp, Oryza sativa
tcctgcaccccaaaattgttcgtcagtctctcttgattacttgttgggtttcctaatggtgtttgcctactcaattactgctttaatagaataggatttttcgggcatgctataagtctataacaatggttctcaaatattataattagttaaaaaggaggctgttcagacagagaaggccccggcagcattaggcccgtattctcaggccatcaaagccaacaatatggtctttgtctctggagttcttggcctaaaccctgaggtttgtccctcaacatatgttttgtgatccttcacgtatctctgcatcataaatgtatgccactttgctggttttaggtgccagtataactgatatagagtaacttctgtctccagactggaaagtttgtatctgaaagcgtggaggagcaaactgaacaggttaacactttgaccttcatttatgttctgtgtagttttgagctctaggaatttcttgcagaatgtggatggaatggttaatagtgcacctactgcaaaatataaattttctgagttgttcccagtatccgcatccatttttgaagtttcccatattctatattgaagtttgtgctgacttttatttgacttatactgaggatgtgtttgtgttttggtaatttctatggaaagaatttgcatgttaggttagtgtttatatgaaagtgtctgcaacaaattcgaatggtggtccagactccgcatcataaatcctgtttttcctgcatgcctctccatagctgcctttgccttcaataaaacagttgattttatcaatgcaattttcggaagatgctctttcttacatcatgtttgtgtttctcgtctgtcacaggttatgaagaatatgggtgaaatattgaaagcaagtggtgctagctactcttcagttgtcaagacaacaatcatgtatttacctgttctttaaatgaaactttgttttgctctaagttattatgatctctgtgacggaaattttcttctatctgcaggttggctgatctacaagatttcaagaaagtgaatgagatctatgccaaatgtaagctcaaaaactttgttcgtccttagtagtactaccttttatttggcctaagtttagtgacattcttgaaacgcattcatgctaatgtttatatgttcaatatttttgccgtgatctctatattttgcttctgaagaattttgcaattcttacttgcagattttccagctcctgcaccagcacgctcaacttaccaagtagcagctctgccgctgaacgccagaatcgagatcgagtgcattgctgctctctagttacctgctactgtctatcaatcaaattgccaataagcattctgtggtgccgttctagttggtcactatcctggaagaatgcactgccattctgaacctgatcttgtagtaccaattaagatcttgaactgcctgcaataaacgttgatgcccaggaaaaaagaagtcccatctgttgtccaagggttccctttaatctccatcatgaattgatcatcccaatggctcacagtgctatgttgcagaggtctcctgctgcaatatctgcaagaattggtcttgccaagcgtcatgagtctaataaatcattaaaaggtttatcaacatgatgtatctccatgttactatcacatatccacatattgacaccaactgagtctgacctggcatctagtatgtttatattaatttatcccactcaacgcaattcggctgtctagttggcgagacagcgattatcgagtagataacgtatgaaagatgagtttacactggcttcttccattaagaaatgactagcaaaatctacagtgcatttctttataccggaagctcaaaattttctactgatatttatatattaatctcaatttggtcgtccttccaaccaagcacacccttacactcccattcgttgcaccgtcacatttcttattctataaatcgcgacaaaaaggttggcaaagggtgttcatatttcccaaattgattttgtgcacgtcctattctcatcccaggaagcatgatggcaacatgaagccaggataaactggctttatttcttaataataataaaaataggttatatcttcggcctctaccattagacacacagcggtcgagtcattatgattttttttttgttttgcatgatttgtagtagcaaaagcacattggtttgtcagcttatctattcccagttcgacccagcttcgcgtaggagacacgtgaggcggcggccacttctgagaaggttatgggaagcttccgtgcggctgcagaggctgtttaattgtgggggtgacaacactgtgatgctttcgtgtaacgataatgtcgacaccttaatgacatttttactggattagttattcatcccagggatatatattttcttttctgagaaattctatggtacagttcacaaatcacagactcacacactttctttgttgggaccgtttggaa

SEQ ID NO: 38019 - DNA, 6388 bp, Oryza sativa
cacctaacccatacacgcggagtagaaaccgcgaggggtcggggcgcctcggccctctggggcgaggcaggagtggtccgacccccccccctcggggagaccaagaggtgggcgcactcatcaccctcgggcccgacgtcccccgagggtgccaggccacgtgggtgattgtgtctgcctcaagcctctagtcatgatactcccggtcccatgtcaccgacagtagcccccggcgttatgccagggcaatcgcccttttcaaggggagcggtcgggcgtgacgccactcctaaagcctggtgacaagtgggaccggtctctacaaataggcagaaacccaacggtcacaaactgcgcacatcggcaatggtaactcggctgtcagcaatgagcggtctcttcaagactgccacattactcgagtagcacacgaatctggacgagccgattcgctttgccaggagatatgtgatggcgcttcggtcggcgagcgcaatcaacgcgcgcacgatatgatctatcttgactgccacaaccgcatatccacctcacgcgccgcaagcgggcgaatgggattagtggaagcgtgggcgcgagagacgagggggcgcaatagtgggcgcgagaaacgaggagccgggcacagcgttggcaagggtataaaggcactgaggaagggatttgtttctttcctttcgccatcattccccttgtcttcgccgcttgcgccctaactccttcttccctgcgcccttctttcgccacacgcgctcgctctccatcttctcttcgtccggcgccatggcacggggctccgcactgcttgatggtagcgtgctgccgccttcccgcatggtgagcgagaagcaggctgggttgccgcgccgcttcatgccggaatctgccaccggccgtgagatagtcatgctgggcgagggacgcccagcgccagactacccgggacggtccgtcttctttctcccctttgcaatggcagggctggttccgccattttcttctttcttcatggatgtcctggagttctacgatctccagatggcgcaccttacccccaacgcagtgatgacattagccatctttgcgcacctgtgcgagatgttcattggggtgcgcccatctcttcggctgttctggtggttcttcaccgtgcagtcggtatcgccaccgtcggtggtcggcggctgctacttcctgccgcgggggccggtgttgaaccgctacatcccctgcgtcctccgcaagaagtgggatgactggaagagcgactggttttacacccccccccccccgccgacgaagcgcgcctccgacttccgagtcagcccccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcggcgcgctcggggcgcctgggagtacaccgggtccgaagactacatgcggacccaccagggagtcagatgggattgggctcctgaggacttcaagatattggtccaacgggtgctgaatctcaactccgtggaggcgtccctcattccccacggaatcctccccctctgcagcgatccagaccgcgcctccatcttgaccattatgacggcggtcggggcctcagaggagcaggctcctaagggccatgacggcgcaggcgggagccgccgaggggaacaatctaccccaggagggggtcgtgcttctgggccccgcgtcgggggctcggggagcaaccgccctaccgacgcccgggggaagaggaagctgggaggaacacctcccccatctcctccccgagggggcggggtggtgcgtgccagcagcaggcgccccggagggggccgcgccaacatcgcagcccgagggggagcgcaagaagaagcggatccgcaagatgggggagacagaaccatcccggggaaacctgatttctcctccaaggtggtcatttaaccgaccccctcgcaggttcgtcccacgctcattgcgaccgtctttcttctatcccaaaagcaagttttctcttacccatcttgtttgtcttctggtttttccttccgcttcagtgatgtcccgtcgcgttcctcccaccatcccaagtccggccagtccgaggccgaagatccggcggtcgcagaggcacggaggcgggaatctgaccggcgagaggccacagatcgcctacgggaagctgaagaggccgcccgggaggccgcccgggctcgccaggctgaggataccgctcgggaggaggccgcccgggctcgccaagccgaagaagccgcccgggaggaggccgcccgggctcgccaggctgaggcgatggcgacttccgaggcagctcgcgacgaggccgcgggcgcgtcgcttgggcccacctcctcgggcgacgctcaggcgacagcttctggggtggctcgcggcgaggccgcgggcgcatcgcttgggcccactccttcgggcgacgcccaggaccaaacaggtccgggggacatccccgagtccggcacgtccattggcgagccgagccgcgcggcatcttctccaaggcagctcttccccacgccttccgtcgccccgctgagcgcagagccccttctgcaggccttagccgccgcaaacaccgcggtgctggatgggttaagttcccaggtggaggccctgcaggcggagcgtgcggagctcgacgccgcatgggcgcgtgtcgaggaggggcggcgctcggtggaggccatggtggaagcgggccgcaaggcacaccgccggcacgtctcagatcttgaagcccgtaagacggcgctggcggagatcgctcgagaggtggaggaggagcggggggctgccctcatcgccaccactgtgatgaacgaggcgcaggactccctccgccttcaatacgggagctgggaggcggagctaaagaaaaagctcgacgccgcccagggggtccttgatgccgccgctgcccgagagcagcgagcaacggagaccgaagcggcgctccggcggcgtgaagaggccctcgaggcgcgcgccatggcgctggaagagcgcgcctgcgtcgcggagaaggacctggcggaccgcgaggccgccgtcgccactcgggaggcaacgctggcggcgcacgagtctgcctgcgccgaagaggagtccgcactccgcctccgcgaggacgcgcttaccgagcgggagcgagctctcgaagaggccgaggccgcggcgcaacggttggcggacagcctgtccctccgtgaggcagcgctgacggagcaggcacgccgcaatctagaatgtgtccgcgccgagagggccgcactggaccagcgggccgctgacctcgaggcgcgggagaaggagctggactcgagggcacgcagtggcggggcggctgcgggcgaaagtgacttagccacccgcctcgcagctaccgaactcaccatcgccgacatgcagcgtgcgctagactcatccgccggggaagccgaggccctccgcttggcgggcgagatagggcccggcatgctttgggatgcagtctcccgtctggatcgcgccggtcggcaggcgggcctctggaaaggccaggcaatgaagtactccaccaaccagggaggcctcgctcagcacctctcgaagatggccggggctctccagcagctccccgaggagctcgagaagaccatcaagtcatcctcgagggacctcgcccaaggagcggtggagctcgtcctggcgagctaccaggccagggaccccaacttctctccgtggatggcgctggatgagttcccacctgggactgaagacagcgcgcgcgcgcaggtccgggatgccgccgaccacatcgtccacagcttcgagggctcggcccctcggctcgcgttcgcccccaactccgacgaggagggcgacgccagcggtgcagacgacagtgatgacgaggccggcgacccgggcgcatcggattgagcccccaggcccccgccaatctccagttttttttttctttttctttcttctaaggccttcaggcctcttttttgtatagatcaacttaatctgcaatcaaaaaatgatgaagaatttttgtgttaattttactttgctatacaaatgagatgaggatgatctgtgccgtggttcttttgtgtcttagcttgatttaagggctcgtgcccaagtcccaatcctcgaaaagcgcgggtcggggctagtgcctggggagatccacatgtcgagactggccaggccgggaacgtggtgaccgagggttatgggtgacccgattgtgggtttttgccgattcccccccggagttcaccacgccccagggcacggctcggttctgggccccgtttggcgattttagctgaccgaaccgagcccccgagggcaaggttgagcatgagtgaccttatttcaagtcaaaattcttcaaaatggaaaaaatggcacagatacagccctcaggaaattgaaactgcttttattgaaatactgagataaaagaaatgagaatgtgcatgtgtggcagcccccggccaaccctgcacacccgagggggggtgcggggttggcccgagcccgaaacctgacacccgacccccccctcaggggtagaagcgacgaaggtgctcgatgttccatgggttaggcaactcagtgccgtcgcccgtggccagccgtatggagcccggccgggggacgccgatcactcgatacggaccctcccacattggtgagagcttgctcaatccagcacgcgtttggacgcggcgtaagacgaggtcgtcgacgcagagtgatcgggcccggacgtggcgctgatggtagcgccgcaggctctgctggtaacgcgcggctcggagggccgcgcgccgccttcgttcttccaagtagtcgaggtcatctctgcgaagctgatcttgatcagcctcgcaatacatggtggcccgaggagacctcagggtgagctcggatgggagaaccgcttccgcgccgtagacgaggaagaaaggcgtttccccggttgctcggcttggtgtggttcggttcgcccagagcaccgctggcaactcctcgatccatgaatcgccgtgcttcttgagaatattgaaggtcttggttttaaggcctttgaggatttctgcattggcgcgctccacttgaccattgcttctggggtgggcaggtgaggcgaagcagagcctaatgcccatgtcttcgcagtagtcgccgaagagttcactagtgaattgggtgccgttatccgtaataatacggttaggcactccaaaccgggccgtgatgcccttaatgaatttaagtgcggagtgcttatcgatcttgatgaccggataagcctcgggccacttagtgaacttgtcgatcgcgacatacagatactcaaacccgcccggggcccgcctaaacggtcccaggatatcgagcccccagacagcaaatggccacgaaagtggtatggtctgcagggcctgggccggctgatggatttgcttggcgtggaactgacacgctctgcatcgccggaccaggtcgaccgcgtcattgagagctgtcggccaatagaatccttgacgaaaggccttaccaaccaaggtgcgcgaggcggaatgggctccgcactcgccttcatggatatcggcaagaagttcaatgccttgttcctgaggaatgcacttcaggaggattccgttagccgcgcgccgatagaggatcccttctaccagcacgtagcgtttggaaatgcgttggacgcgttcactcccttcgcggtcctcaggtagagtcttatctgtgaggtatgcttggatctcagagatccaagcaatcaatctaagggagctaggagcgctcccctcgggtcccgaggcctgggctccgacgggcctcgggggccgatcaggcgcgtccgtctcccctaaggggtcgggtcgcgccgacggctgggcaagcctttcttcaaagacgcccggtggggtctgggctcgcgaggacgcgagtcgtgagagttcgtcggctatcatattatcccgtctgggcacgtgccgaagctctatcccgtcaaaatggcgctccatgcgccgtacttggcgtacgtaggcgtccatctgcgggtcagagcaccggtactccttgcagacttggttaacaaccagctgagagtcgcctaacaccaagaggcggcggatccccagtccagttgccactctgagtccggcaaggagtccctcgtactctgccatattattggtcgctcgaaa

SEQ ID NO: 38020 - DNA, 948 bp, Oryza sativa
  unsure (1)..(948): unsure at all n locations
gattgtcctcatcgcgctccacaaccaacgctgcactaactacttggggggtcgccgctaagtagagtagcaggggctcatttggctccggggcgaccagaaccggaggagagctgagatatgccttcaatcgagtgagggcatgttcagcttcctccgtccaagcaaacggcccagagcgtttgaggagcttaaataggggtagcgccttctctcccagcctcgatatgaaacgacttagggcggccatgcaaccggtgacgcactgcacatccctaagtttgctgagggggcgcatccgctctatagctcgtaccttctcggggttggcctcgatgcctcgggcagagactaggaacccgagaagtttgcccgcaggtacaccgaatacgcacttatcggggttcagttttatgcgggcggagcggagactttcaaaagtttcggctagatctgagagtaaagtctcttggttgcgcgtctttacaaccaagtcatcgacataagcctcaacattacgtcctatttggctacccaaagaaattcgagtagtacgctgaaaagtaggacctgcattctttaacccgaagggcatcgtcgtataacaataggttcctatgggggtaatgaacgcagttttttcctcatcctccctagccatgcgaatctgatggtaaccagagtatgcatctagaaaacacaaaaggtcgcaccccgcggtggagtcgacaatccgatctatgcgaggcagggggtaaggatccttaggacatgccttgttaaggtcggtgtagtcgatgcacatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38021 - DNA, 586 bp, Oryza sativa
cgtaagagaaaaaaccatgggagtgattcagccagtcctctaccagaccagcagtggcacaatccgcatgctgctgcgcccgtccgatgaagtaggtcgcatctgcgttgcggagtccaaggattctggtgtcaactggagctatgcgcaaccaaccgagctcccaaaccccaattctggttagtatcaccgatcattctgccacagtcagttctgaattgcagtacatcttcatctgcagcttgtatgatgctatctatgtggtgggtggaaagcaggtatcgatggcgttaagctcaaggatgggagggtggtgctggtatacaacagcacctcaagaggggtgctcaaggttgctgtttctcaggatgacggcgacaaatgggaggatgtgctgacactggaggagacccatggtgtggagttctcataccctgctgtaattcagacttctgatgggctggttcatgtgacatacacatacaaaaggactcaaatcaaggtagttttacccatgttgtttggtcttcttatggtaattaccagtttcatcatcttccatgttaagaatgaatttcttttggtc

SEQ ID NO: 38022 - DNA, 1119 bp, Oryza sativa
tccgctcttgcaattgggtcgttgcgattacgggttggctgtctaattgtctaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcagatactatgatagcaccgaattttgccaattcggcagttcgatctatgatttcgcattcatggacgttcataagatccttccatttagtagcaccttagagtacattgaatgtacagaaatggctataacagagtttctgttattcgtattaacagctactctagggggaatgtttttatgtggtgctaacgatttaataactatctttgtagctccagaatgtttcagtttatgttcctacct

SEQ ID NO: 38023 - DNA, 3602 bp, Oryza sativa
aactgactaaaactaaaagattcaaggaagaaaaaagggattaggaaatttttttgtatattgtatataagttctttctatagttagaaatcacatcacgaaaatctactctggtttaaaatcaggaataatttgcaataagcagtaggtattcgtttttctttctagttagtaaagaacttttggattctaacaaaaaaattctagtaatcagtaatcgttcttgaattccaagatttttcttcgtctattttactttgagttgaattcctaattgtttgaattgtgtaatctcccattatggagattggtaaccgactcaaagaaatttgattgtaattcaattcatgacgatcataagtagaaagttcatattcttcagtcattgataaacagtttgtcggacagtactcaacacaattaccacaaaatatacaaactccgaaatcaatactataattaagcaattgtttccttttaatatccttttcaaatctccaatccacaagaggtagatctatagggcatacgcgaacacatacttcacaagcaatacatttatcaaattcaaagtggattcgcccccggaaacgctccgatgtaattgatttttcataggggtagtgaatcgttataggtaaacgatttgtgtgggataaggtaattatgaaactttgaccaatgtaccttgctgcgcgtattgtttgttgaccataactcatgaacccagttaccatagggaacatattcgaaatatctatgaaaaaggtatgtttctttctcttgtttgagaggacttttgtgttgaaaatattcttactgttattgtattatcttattttatagtgaaacaagttgggaagaagttgttaataagagattgcccagggaaataggtaaaagaaatttccatccaagatttaataactgatccattctcatcctgggtaaagtccatcttattgtgatagaaatgaagagaaataaataagctttagttaatgtaataaagatactcattgtcatttctaaaattccaaccattttattcatttggaaaaatccaaaaaaggatatatagggaatagacaaattccacccgcctaagtagagaactgttacaaataaagaggaaactaataaatttaggtacgaaacaagataaaataaaccatatttgataccagaatattcggttttataacctgctactaattcttcctccgcttctggtaaatcaaagggtaatctttcacattccgccaaagaagaaattagaaaaaccagaaaacctataggctgacgccaaagattccatccaaaaaaaccatattttgactgtgcttcaactatatcaactgtacttgaactgttggataatcatagtcgacgataacattacagttcccaccgctattccaaaaccgtacatgaaaccttagtttcatacggctcctctatgatgagaaaaaaggaaagtactgtttcatttcgttattatcttcttgggcgtagttggaattatctaagataaaatcgatttcaacgtcctaaattagaccaaaggaattctgtctgctagaataataaaaaacgcttcggaattcatctcatcctttataatataatggtactttttctttgttcagcaataacttaatcttggaataaaacactcgttataacaattaataaacgaaaagagttgggtattagttcatgaagaattctgtatgaatatggataaacgacggaaagaataaataaagatcttttttttgtattgcattccatatcttttgtcctattcttctttccccgaggggtatttaaaaagaaaaaaggaataaagggttaattcgttcttgatagccatttccttaacaagtgaatgggaacatactctggatcggaatccgaagaaagtactacttgctcatttccaccaatttcaagtccttattatgattccttttatgaggaaaaatatctaatgctttagattccctcattactaatcctttatgtactttagtgtttctaatccctcactaacttttgatggattcccttatgattacaactttctgtatcgggaatcccttattattgcccgcttcaagatatgatgactaatcaaaaaatctcaaccttggggtaaagaatttacaccgcttatgtttacttccattttttcttgtacataggaaatgagattttttctttttactacaaattaataagcagttttgtttcactcatatagctatctagtttaacttactaacctgaatatagaataagaaaaggaggataaatattcaatgaatttcagaggaaaaagatcctattttaacgaatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtacttctattgtgattccaagtaagaaggtcaaaatgggtagaatccatatcagtccatagacttcttttaataattccaagtttgaaaaagaaattgatagcttctacctgtaccctgtctattatcatttcaacgatcaacttctcccataatgatatctatactacctaatatcgtcatgatatcagccaatttcatttttttgactagctgaggaagaatttgcaaattaataaaaccgggtggacgaattttccatctccaggggaaatgactatcatctcctaccagataaattcctaattcaccttttggggcttccactcttgcataaagctcttgttttgacaattcaaaattgggtgaaggttttttaccaagaaatcgatattcaaaatcattccattcggaattctttgctttcttaaagcgtcggacttctaaattctcataagggcccccaggaattttttctacagcctgttgaataattttgattgattccctcatttcaccgattcgtactaaatagcgtgctaatgaatccccttctttttgccattggactttccaatcgaattgattgtaagactcgtaaagatcaactttacgaagatcccattgtattccagaagctcgtaacatggggcccgataagccccaatttacagcttcttctccgctaataaaaccaactccctcaactcgttccaaaaaaatgggattctgtgtaataagttgttgaaaatcaataactcctcgtaaaaaataatcacagaaatctaaacatttatcgatccatccataaggcag

SEQ ID NO: 38024 - DNA, 2089 bp, Oryza sativa
tgtataatagttcggttttccgcgattttttccattcctctgtgtaaatagcctaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaagaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtagcacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaaagaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcatgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcagcgactggagtgggggagtcagagtcgaaaagaggattcctcgcttctttctctcatgcaaaaccgtgcatgagactttcatctcgcacggctcctaagtgataaattctcgcgtct

SEQ ID NO: 38025 - DNA, 7956 bp, Oryza sativa
atggaaaacaaatccttgtggaatttcatatcatagaaaaatgaaatcgaaaatattcggagatggcaaatattcggagatgactatgaaaacacctctctggatcctcgaattgaaagagagattgagagggattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataaggacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaaagtttcagaagatatgtctaaagtagatggtgattgatagagcaattcttgctcataagttccagtattagtactgcgccgaacataaagcttgtggttggtagtaaaacatcgatttttcttttgagatagagttcgatcctcaactatttctcgcgatatcttcttacgaagttttgttagggcatctataacagcctctggtttaggtgggcaacccggcaagtagacgtccacaggaattaacttatcaactccccgaacagtactataggaatccgtactgaacattccaccagtaatagtacaagctcccatagcaaaaaaggagaagtcattccaatcctcaattctcctttcgagattcggcgatagtgaatcaattgaacgcgcttcgaagatttgttctacttttggaagaccttgcgttatgtcactagatctcgctttttcgtatataaacgtaactaacctatcccctttgtaaaggatttctccataatgaccatgaacagttgctcctgtagtggccaaataaggcttagctgctcttataacaaaggaatctatatttacaatgaaaatttgacctgatttttttatgtgcgatttaaatagacacattttcgcaaataaattgtccaaggtgaatttttgctgatgtctcttcccaagaatcatgagggagaaagtgccaatttaactggaatggatccaacatgatgttactatcgaaatttgaagtcctttgattttcatttattaaagagtgtttaagtccttgaagtactttgaagttttgtttcaaattgtcaaggagcaaatgcttttttaacaggatctgattatacgttagtaaatagtaagatgaagaaaaattcgatatactaggtgcaatagtacctaagagtcccgaaaaatttcgaaagagcccccaaaattttggaataggaattctaggattcgattcttttaccccattgggattttttgaattcttaaaaaaaccaattcgagaacagttggatgccgacaaaaccatcaaagattggtattctttatttcgattcaacaaggtaccaatagcttcttgatgttggctaagtgattgaatcttcgccttggaataaaaggaattggtattggtgcgatctaacctattatggagaatcagtcctgcacttctgctatcatacctttttcgtgtatacgaaatagtggatttgattaacccaattcttaggaaatcgcgaatcagaccatttgctcttatctcaacaagggaagcacgagcctcctctttttcttcttgttcccaattcaatactaagcaagttcgaacgaattgactattcgtatgataaattctttgagttaacttgctattttcatgagaaataaaattgacaagtcgaagttggagattaccctcttcctgcaagagatcctgtgggaaaagtgttgctaaatttctcccttcgttcatttcatacgcgactgcaggtcgaaccaaaacaaaatacttttccttgctcttgagaatttttttccactgaacatagacccaattttcccttttttttgattccttcgaatcttttttttctctttctagtggtatcaaactgccacctaatatcttatccgcctcttcaggaaaatgaatatctccaaaaaagatttttagttccgtatggcttttttttctcttcactcgaaccaatccacccagccgacttcttgtattttttgtgagttgtgtatccactccaataatactattgtcaagtacctttagggatgaggatctcggcaagatatgcagttcttggagaatgaaaaaaaaccgatctacttctttttggtattttagactaaattcttttgttcctcgatgctcaatcaaaacccccttttttaagacggaatcttcctccgggttcccatattcgtcctctgagtcttcctctgagtcttcctctaaagtcccatgttcgtcctctgagtcttcctctaaagtgccatatttatcctctcggggcctatatttgttctctggactcccatattcgtcctcggattcctcctctcgagtcctatattcgtcctctaggattccatattcatcttctagggtttcatattcgttctctgggatcccatattcatcttctagggtttcatactcctcctctcgagtcctatattcgtcttctagggttttacattcttcctctcgggtcctatattcgttttctgggctcccgtattcgttctctgagtctttctctcgagtcctatattcgtcctctagggtcctatatctaaatttaacaattcctgaacccttttttagctttcaaattgatgccacatcttcaagattgccacatcaggacaaagaaagaaatcatatcagatgataatatatagtttcccaaaaagagatctagccatgcttccgaccgttttgattctttagaacaactcgatgaatttagtagatccttttaggaggccctcaatgaccatagatcgaacctatcctatttttacagtgcgatggctggctgttcacggactagctgtacctactgtttttttcttgggatcaatatcagcaatgcagttcatccaacgataaaccaaattccaactatagaactatgacacaatcaaacccgaatgaacaaaatgttgaattgaatcgtaccagtctatactggggtttattactcatttttgtacttgctgttttattttccaattacttcttcaattgagagaaagaaagagagtagtaagaattctcttatccccatttggaaggataccatccttataactatccatgactgtttttgtctctagcatgaccacttgataaaatgtggaggaaagtaggggaaatggccgatactactggaagaattcctctttggctgataggtactgtaaccggtattgctgtgattggtttaataggtgttttcttttacggttcatattctggattgggttcatctctatagtaattggagggaccaggttgtaaacatgaaaaaataggaacttagcgggtccttaccccttttatctgattagagcggaaaggacccgcggaattcttactcttataacccgacttttttaatctattccgtaacctacaaacgggtttcctattttgatttgtaaaaataacaaagagaaagcctttgctctgatggtcagaatccctctatttattcgttttgtttgttaattttgtttgttaataatgttagtgaagtaatccatcagttgatttataaccccctcgccaatgaaattaattcacttttatgaagcgaggagaaagaaaggatcaatcgaggatccaatattttattccccggaggaagtctcttgtaaatcattgatttaatttagagtaataaactaataaaaccttaattaaaactactctcaactagcctaaaaataaaaaacagccttcaatggaagagtatccttttttttgcaaaatttctgtaagttctaaattgaacttaattgaacaagtcaagcaattctatttggtcacaaaaaatttgtcccccgccatattttctttccctctttttgtccactacatcgcctgaacctaagcaaaagaggttcaagagacagacccaaataaagaagaaatagtaatctttgccgaataggaagaaaaaagattcatatttcgatacaagaagaatcgacacaagaaaatggcaaaaaagcctttttcttgtgcccaatagaggattaagaagaccagcaatccctcctaaaaggatttgttccttttattgttctcgcccttgccttgcattctcctcgttttgcatgagatgatagaaataaggaattgcagacaagacatctcgcaaacaaaaaatagtctaaacaaaaaaaagatttccaaaatggatcatagagaattctagcaatcgccaataaatcgcggctttttaccaacttgatggtaagaaatcccgggacctagaaattcatttcgtacaattgaaccttttcaaactgtttctttttgagaaccaaaaaaacttgtgccaaaataacggatgcgaagaagaacaaaaggccttgaacgcgtaatggatcctgaagcactatttctgcatccccctgaccaaaccctcccacattaggattacttgttaatggttgatcaagcttgatcgattccccctctgaaacaagaagttctggaccgggaggtataagatcaatcacttggcgtccatccgatgcatcgactatggatatttcatatccccccttttctttacgcagtatttttcttactacaactgttgacgttgcattatagaccgtattgttactcttgctaccatcaggatagatctgtccccttcctcggtttccccccacatatatgggatattttaagaaatgaacgtctttcttcatagcagggtcgggggaaagaatgggaaagacgatttcactatatttcttaccgggaacagggcctatcacaagaatattttttttattgggacgataactctgaaaagagagatttcctatcttttctttcaactcaggagaaatacggtcgggcggcgctaattcgaatccctcgggcaaaataagaacagcacccacattcaaccctccctttttcccattagcaagaacttgtttcagttgcatatcataaggaattcgaagaactgcttcaaatacagtatcgggaagcactgcttggggaacttcaatatccacaggcttattcgctaaatggcaattggcacatacaattcgtccagttgcttctcgtgggttttcataaccttgctgcgcaaaaatgggacatgcatttgaaatagatgtccgagttattacgtatatcatgatcgatacagaaatcgatcgagtcatctgttcctttacccaagaaaaagtatttctattttccatgtccaatcacagatcccggaatttctacaataaattagataggtagctaagctaatctagttccctatacacgaatctgttgtcattctactgcaacagttgtactggaatgatgaataccttgagcaggtagaaatagaaaaaaagaattttgctaaaatggaaaaaggctttctttctaaaggaaaaaggatgctaattttgattaatatcaggagatcaaatgagtttatgcttcactaattgaatgataaatgactacaagcgaaggagataggcggtttaaacaaaaaaagacccaaaatttcaaacatgtatctagaatcacaggaaaacaacaaacaaaaatagtgaaaattagctcgttaggaacccatccaagatcgttatagacccaacgaattagtagttcccaaccgcgggtggagtgaaatccaacaaaaaaatcagtaactaaaagaataaaaaaagcttttactgagtcatttaagttatagaagaattcctgaacccaagaattcaaaataacaagttcctctttacccagaaaaaaagaaccacttagaatagccaaacagattatatttgtcgagaaatgcaaaatgatatggagatgaccctcattatctattttggccaattgtattatttccttgcgtattcctataggggggttttgtacatgtgtattcggtttctcttttatcatttcgtccaagataaaaaggtcttctaattccatgaatctttctagaactcttttctcttgaatagcagttaagagagtttgggattgcctggtattccaccaattcttaatccaaagttccagacatttgttaaaagagaaagagactccccaaggcaaaagtacgataaatacaagatataggaaagaaggcaatgctttcttttttttcatttttgatctgtaaattgagttgttaatgaatccgctttattcgctgactctatatgatatttctttttctttgaaggaaaaaatctataacaaggtttgagaccttgtatctattcctcttttttctatactagtagaatttcattgcattgagttctttcttagatctagatggagtggaatagagaaatagaaaaaagtcctttcggatgaaaatggaagaatattacgccatatatcccacttggacaaattagaagcaattttctcttatcctcatttgttccttcctttagataaatactcaaaatccccttacaataatgcaatttcgaagggaccttttccctcgtgttgagaaaacttttcttcttccaattcttcttcattcaattcatttcaaaaaattcaattggtactcaaaatacttccattggtatgcgcaagaaataagccaattcggcagctttttgttcaatttctcgtggagtaaaaaacttctcatcagtacgagtcaagggaatggccccctggccccagatttccatataaaggatacgacgaggaaaaagaccttctttaacctgaattctaattgattggatatcccgcataaggaatcgaaggaagacgcgacgttttattccagggaatccccaacgaaaaatgcacactactccctcttttctatcgaatcggtcataaccactgcctacattccacaaaatagtgcaccacaagtaagcgctaatgaataggcctgcgattccgtagaaagacatcacgaccccctgtggaaaaaaaggaatttgttgagatggaagtacagatataatattcttaccaagataactggaagccccaaccgctaagaatcctagtgaacctagaaaaagaatacaggcccagaaaaaattacctctttttcgagaaccttttagaagttctatccatatgtgttctgatcgccaattcatattagatatactaacagcggtcgattgaaattgagagaataagctaaatgattttgactttactttttttgattctgaaatcgccttcgccttcgtagtaacaatataaacatcaacaacttcaaattggactcgtttccccacaacaaataaaggcttgggctaacaaaacactacctaatggggaagttgttggcgaagtcacaaggccctccacttttcattataaaaccgataaaccagaaaaagatggattgttttgcgaaagaatctttggacccataaaaagcagaatttgtgcttgtggaaattctcgagcgagcggacctgaaaacgaagacgaaagattttgccaaaaatgcggagtagaatttgttgatctagataatgtttcctaccctgaaatttt

SEQ ID NO: 38026 - DNA, 630 bp, Oryza sativa
taaggttttttatattccgatgaaaactttagttcttagaaaggatttactcctttttctctcaatagcatattgaggaagaatatgcattttcgcgatttgtacccaaagactaattgaaattgcatccaaaaaacaaataggatttcgattatgagtacagagtcgcgaagcataattttgcattggattaaggattccaattttttaaatatgagtaaaggatctatggatgaagatacaaaaaaatttatttccaatcgtaactaaatcttcttttgttaaaaaaggaaatggaagccaaatagctaaaaaacggtagttttggtttactagagccatcagcatattgtttcagctcggtggaaacccaattcttttcctcaggatctcttaaatgaaattagggaacgaagtaattagattagatagatttaggcaaatttctatctcctactctttagggatcatctagaaagcagagagccttggttccattcagacaaaaaagctgacttagatgttaagtggtgagaatacccataaaggagccgaatgaaatcaaaatttcatgttcggttttgaattagagacgttaataataatcaaccaacgtcgactataacccct

SEQ ID NO: 38027 - DNA, 70030 bp, Oryza sativa
  unsure (1)..(70030): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtggtacgagttcattttcaaatccgctaccctcgatgacagcccaggctgcggcttcttcgccaacaccagggtcaaccttgccaacgacatgtgagttagcttcttcctctctacagagatttctggtgatttttgtttaggcggaacaacgactacacgttgatgcggttgctggcacaggcggacgccatcaacttcatcttcttcaccaagatggacattggtgggttgttgtgctgccttcaattatgcagggttgggttggactctatgagggtttcgagggcgtgtgcattgctgaccatggctgcgggtggtcctcacaccaacagcagcctgtgactccatgaagtatcgtgtctggatggatggtgagtgactggctttcttttttaactttctgactagccctaattgccacctaattctatacattcacctgttcatccagcgattccagaatgtggcagtggcagtgcggcttgccttgatttgatttgttgtgctccacgattatcagttcagaatgtcagataagtgaaggttggttggttagctagcaggaagttccctgatcattctgttatttgtcaaaatgtgacaagcatactgatctctttgttttgtagtgtggtgctacctagctgggatgccggtagcgatcgctgtagtggccgcggcgacgattgcttcttccttggatgggagccaccgttcgccaaccttgctgctgccgacgctcgcatatccttccctgtctgtgtgccagaggtaaacggcagtttcttcctgttcttccaccgtttgtgctgatgaatgctgtgcattccctccttgtttgagctcggccatggaggagtcactggtatctctgggctggcggtgctagaacagtacacatggtcgcgttgccgagggagctggacggccttttcagggtgggttcctgcaggacagggcaaagatgatggttttgtcgaggaatttctgtgatgttatgagccattatgttgatctgcttctgtttcccttccaggatttgtgggatgcaagcaacagcagcaacagcgaccgggcacgtctgattccagctatgttcagcatcatgtatgggaaggtggggatcagtgccgacacccccagttctacctccgattctttcttcagtgatagtcttaatagctcttgtgggcagtcattgataggcatggtgtgtacttaactgcttattgaaatgatcaggtttactttccattcctaccggttcatacattgttctgctctaaatattttcttttattcgaggggataggcagatgttcgcacaggcatggggcaatccggtttcctttctattttgtttgtattgccatggtgcacttcgttggattgtggtgttctgtgtagttttctactatatttaggtttaccacggcttgttgtttactggttgtaagaaagcacataagaaatgaaacctgaatatctggattgatgggtgatgggggaatatttatgtttctgcttaattggatgggtttgatttctctgtcaattaatattccgtatacatagagcctcaatttttggtagagggagattgtcaatgctcttgcctcgctcgctatagatttcctttctagataattatagacatgttttgttagtttatatatgtgttggttggctgttcctatttactccgcatgcagaggattgttcaaggtgaaagaaagagcatggagattctctgtgtcgtcctatctatatttggatcctattttatcatgctcagtgtttttttgttgtgcaatacctttggcttttattttcgtgccaaacagttttagaattggttcagacatccttttacttctatggctgcaatgaggttgcggcgtgatggagaatccttcttgatattataggtgcagaggcttatgcgttctttcctttatcaaaaaaagatagagttgttcttaaaaaggcactgcccatgttctcttttatagttctctgtgtatttatcgctatgggaaaaaatgatccgtgataaaaaaaattgttagcttgaacgtagagtgtcaacatgttccttaggtgctggtcactacattttgttatttaaaggtcggtgtgataggattcctttatttctggtagatgttcagttatatatgctattggtagagtgcctgcagaaacatagagtgttccagtttcatctattttgtttccaggtgctcatgcagcattcgatgccgcttttgctcgttcttactggtgtttgcatgttggtttatgtccctgtgtttctgctagcatggtgcattccattgccttgtggtaccctatgtgattttctatttcatttctgctggcatggtgcattccgttggcttgtggtcccctgtgtaattttctattatatttacctttgctgcagcttgccatctactaattgcatggaagcaaacaggagataaaattttaatatctgcgttgatgtgtaaggagtggatgtttatatgcgtgtttaattggatgggttggttccactgccggttaaggttttatatagataaggcctcaattgttggtagaggaaggttatcagtgtctatggttcacttgttatgcatttcctttgtggatgattatagacagattttgttaatctatatatatatgttgattggctgtgcctttttattccgcatgcagagtgttgttcaaggtaaaaagaaagaaagtagaaattgtctatgtcgtcccatctgcttttggattttattttatggtgcccgatgttttttattgtgcagtgcctctggcttttattgttgcgccagacatttttagaattaaccgagacatcctttcctttgtttcctgtatagtttcaaatcaaatcaaacagacatgtgcatcaatcatccaaggtatcaatatcagctatcagcctcacaccagagcaattactatttctgccacttccactgaaggttatcctttatcatttctcatacaactattatttttgtatatctagcccatcttatgtgcttgtttcttcatctagagatacacatatataaatgactgtttattccaaccatccaccacatgcagatacatcagacacttcttccaacactaaaactgatctatcatctgataccccttccaacaccaccatgacaggtaaatctaatccttgttttatgtaaattaattaaatttgttcacacagtataatgaagatcaaataatctcgcatgataaaactacatggaaaacaatcatgccaagcttcgtataatgttgtcagtacattttactcacactgaccttcttaaaaaaaactccgccagctgacacctaacatctattttatacttatgcaattttcacttcacttacagtcattacaccctatctagcagcttgaatactcctcagctagatctcttaaaactccgtcctaagttttttagatgctaatgtaccagttgcagcctgcaaaaactctcttcatcagcaacttttaaatgttcattcagttctttcgcaaacaatgcaaatactaataggagtattttcatacaggcagcactaagcgtgcgtttaacgagctgtgtttctgtgcaaagaatgttgatccaacagctgacttgaaaaagtatatcgaagatcttgagtgcctagaccgttcaagcaaattctatgctgttgctgtgaataacacattcatgaagcaggatagagttgtaagttcctacatctgctactcatttatttatatacaccatacatggctatctatcttaccaattatgagtcaaggctgatatacaatgccaattacagtactgtactaaagaattttctcaagactacttaaagccattaatggaaggcaaggaaaccatcagcattggagttcaaattgcaggtggtgtttcaaagaatatgatcctccatatgtcaacggatggtcgatgcaacctgaagaaaggatgggcaaaatttgcaacccacaatcacatatacctacaatcactatgcaccttccatttctacaaaacaactcgcctggaagccaccttcgatgttctataaagaacatagcaatactcatggctatgttgcagccatccttttgctgccatcaaccaggttgatcactgtcaagataacatgtattagttctaggccttacatggtaatcatggaacctcctaatatgaagaaccatctatatatgtacttactgctattagagacctctaaatatcaagatgcctgtgtgcaatttgtactgtggtttgcttctatgtaagacacttcctcgtactttcttgaccctggttgcgtccaggcggcatttcctcgtactgtcattggcgcgcccctagctctagtgtgatagtagggtggactttctgtgcccaccggcactcgcttgcacagccacaagctataccgacaaaaacttcagggaagcagctagaagtcaaaagttctcttggagtcgagagatccttcgactgttactgatcatcttcacttttacttttcgcttcaggctgtgtttagatttaaacttttttcttcaaactttcaacttttttatcacgtcaaatgtttagacacatgcatagagctttaaatgtggacgaaaaaaccaattacacagtttgcatgtaaatcgcgagacgaatcttttgagcctaattatgtcatgttttaataatgtggtgctatagtaaacatttgctaatgacggattaattaggcttaatagattcgtctcacatgtagtttacaggtggaatctataatttgttttgttattattttatatttaatactttaaatatgtgtccgtatacttaaaaaaatttaacacacaaactaaacacagaaacagaacctaatctggagagatgcctgtttgcagatgtcactctggtacgagtgcgacacgcagtcagtccagtacacataagagagcaagaacaggtgtccaccatgtgattgatcagtgcgccccagtacaccaaacaaaaacaatgatcatctgatgaaaatgatgttatttttcgttgggctggaacacaatatttttacttgagcgatcgatctatggaagttggaatatcgttctcacagggcagccaaatggcagcacgctctgagaattttcacaactcgatcgatcacagcacagccgaacttacaataggaattgaagctagctagagaggagaggaaaaaaataagaatgtgccaacatccatgcacgatcatgcctcaatttctaccctagcaagcaatgcaacaaatcgcaatgcaagcgcgcctgcctcatctcatctgatggaggtggcagaggcggaggcgaggacgccgtggaaggtggcctcatcgcagggcagggtgatacccatgtcgtggtcgaagccaaactcctcctcggccttcctgagaagctcctggaactctggcgccgcaaggcacgccaccggcacgatgtagcgtctccggctgatgccgacgtacacggcgaagtggcccctcggcacgtccccaggcagcccatcgtcgtcgccgccggcgccctttatcccgaggctggacgagcacctccgcagcatctgcttgagctgccccggcttcttggaccccgtgatcgccatatggcgccggtcgatgtccaccggacgtccggacggttagtgcgtgcagcagtagtagtggtacgtcgagcagcgagacatcgacctgccacctgcggaatagcgtggtatttaagggggaagggtgggagacacgcgggtgcatgtgggcgtgggctcgctcgggcacacggcggcagcggcacggccgggtgggtgttagtagtagaaggctggtagctagtgggtcgcgcgcgaggtggaatgtacggtcctaccacgctactgcctggcgccgatcgcgcgccgcggatatggctgatttctctactccggtttcgcggcctctgggagcgtggcggggtagggaccgtgtaccgggcctaccggcacgggtgcgcagggcggtatgtggcgcatgtggacgttgtcccggcacctgctacgccagaagccgttgctgcgtactgtactaacccggttgctgcttctctggagagagggataacaagggagattttctgtcttgcgcggtcaattgattgaatgattgattttgattcgggcaggacggtccttttttgggcgggtttatcaggccacagaaggctagctagtactagctgtctatactgattgcaggatttccgaaacaccatgttctctacactgccaatctgcgatgttcaatgaatctactcccaaattgcatctgggaatgtactgcttttcgggggttgctggctggtgatcagtagggaccggaaatggtaggtgaggattgtacgtaacactgtacgactgtttgtactcctcgcaagttgcagccaatgctcccaaaaaacatttctttatgccatatttcaaatacagtaaattaatcacttttgggctgtcccttttaaagaaactaggtgatgcgggaattagtaaacaatgctcaatttgtttttcaagagaaaaaaaataataaaacatcagggtttatcaatgcttatcatgaaacaaacaaatgataccccgtattaatgtgaaacatattgataagtatatcttaaatattgtaaaaatgatagatttgttaaaatattgtgcaaatgatgtgaggggtgatgattagatatacttacatgttgatttataaaattaaataaattgtagatgatgttgtatgcttgataagaatatgtaattattactagtgggtgataatgtgatatggttgcatgttgagctttagacttagtgggatataactttatagaaagtacatatgaaagaatacatagataggcacgcttctcaaactactaaacgatataattttaataaaaactttatatacatatgaatttattaaaaatctgtttaaaatataatttcaactttataataattaattcattctatggatctgtttgggggagcttctagcagctgcagcttctcctagaatctccagtagccagaagctccctccaacagttcagctttttacccagattctgagaatcaatctgtagtcgtagaatctagaaaatgaactagaaaccaaaagctgggttttctagcttctctagattctcaccagctagcttctcagcagctgcttttcataatgttaagctcccccaaacaggccctattccatttagaagccgcgtgcatatagatactatagtatccatcctcccttaacaatacaatcactggtggagaagaagtttttactcccggttcgtaacccccctttagtcccagttttccaatcgagactacaaatccggaactaaagatcgctatcgttagtcctgggtgaaataaccgggactaaaaatctatctttaggactaaagatattgcctttagttccggtactaaagatagagccaggctgatcccggctgctcctttattctattcttttcttcattgtttttaatatattgatttcactccatccccatctccaaaatcccaaatcaattatcacctccaaatcctcaaatcgatcatctccaaatacatcacaaaatcttaaaaaaaattacatcacaacttctaataaattcatcacatatccacatcacacacaaatcaaatacatctcagatccggatcacaaattctcaaaaaaaaaaaaacaaaacaagccgccatcttccgcctgccgcccagccgccgccttccgccttccgcctgcggccgccagccgcccggccgccgcgcgaggccggcgccgcgcctgcagaccggggaggaggggggagggggaggagaaggagcctcgcgcggcaccgccgccgcctgcagatcggggaggaggggggagggggaggagaaggagaggaggaggaggaggagagaatcctccgcgtgtaagatagcgaggagaaggggatcggaggagaggagaagaggagaaggggaggaggagatatgtatcttgatcccgcacgcctcgatctctgtgcgcatgccgatctttttttccggttgatgttactaaccaggactaaagattgattaccaaccgagactaaagatcaaaaagtacctataacctttttcaaccgagacttaagataatctttagtcccggttttattgtaaccgggattattatggaatctggtcgaccgaccaaagatggtttctccgccaatgaattataccatgttcagacacgaatattctacaccgctcgattattgagtgtaccgatgataatgagcaccatctttgctcttcaacttatcaaacgtgaccatattataaatttgattttttttcatgtttttaacattgtttaatttaaatatataaaagtttgaaaagaaattcattttttcccttaagctatttcaccagagcactcgacctctaaacaatttttgttcttcttttacacctcaaactattggagatggtcctacttaatccctaactgcatttctctttttcccttcctatatattacttcttctgtttcaggttataagactttgtagcattgcacatatttatatacatgttaataaatctaggcgcgcgcgcacatatatatatatatatatatatatgtatatatatatatatatatatatatatagattctttaacatatatatgaatgtgggcaatggttgaaagtcttataacctgaaacggaggtagtagtaagtaatattctcctataagtctcgacactatttataattttttttatcatcattgttcgcatggtttggaagctccaaaagactgatctaaaaatcaattgctctacaaaactacagcataaaaatatatagcttacatagaaagttttgaaaagaaaaatattattatggataaagtaaaccattttcaacagtttagagtaaaatgagcaaataaatagtataagggttaaatgatcccatgaaataattcgactgaataaaaaaagttttttttttctaaagggacataaattaattttttgctactaagcattgctgcctaataattaatgacagataaaatatcgtaaattgatcgatttaattgcatcttttagataatggaaagactcccggcctttgcttcagagaagctacaaccattccctaaaaaaaaaaagaacctacaaccacttattacatagttcactcaataaagagcacataaaaactaggaaatgatgaaacaataactaataactcgaacatcgtttattcaagtccatttggaaatatacacccaaagttagcaaatatatacatgaccattgtttctaggtttcagcacgcaatatatattagtttcttgtcctcgtcacatctttgaagttgtgcccagaaccgaaatcggtacgttgcccttaacaggacctgcagataagatttcattaatgatttgttaaaaatcatatcatttttacaaaacaaaaaacccaacatatagcagatgcccctactagaataagcttctttgtttttgagtcaatacctttaagccaatttccatcaatatgagaagtactaactccatcccaaaataagtttatttttacacataccaataaaaaacaaaaaaaaaacagaataacccaactttattaaatcccaatgcaactatttctcactttatcaaatcccaatacaattattctctactttcacaaactccaatgcaatgattattctaaaaacaaacttattttgggacaaatagaagaagcttaaaatgaacctactacgggatagaggaagtaatttttagaggttccaagccacaagaaatatgtattgatctccaaagaaatttagcaaaatggtactaaaaactgataaatagtttcacttttaataaaaaaaaagttatattgctattccaattccttcatggtaaattatctttagttaatattacttctttaaatggtaatacacaaaaatgtttattttaagaagcattttaatttctataaaaatatgtttctcttaatatggtcattatttattaaagccaagtgcatagaacaaacccaaaattaacaaatttgatgaagattccatctaaatagtcaatatcatcattcaattgaatatgcacaattaatattggtcactaaatcatgccaattttccaggttctggcctaccaataatgcacttttaaagaaaccatttagtggaatagaagtcatgaccgttacaactgaaacatttctctttgagcaatattgtagagaattggatatctatccataaagtagaggaaatatttcctaaccattatccttccaatatcttacttgcttcccatcatttactacccatgatcctaatttttttaataaaattcttgacctttatgaggcttgaccaaaaatgagaatcctcttgttttctcttaacttgggtgactgtattgttttataaatatttttctttaatatgtccggccaaatatctttctaattaatcagtttaaaaacaatttgcttaacatatatttattatgatttctattttatgcacccctagtctatcctggttctttgattgagcaataatattccatcttgctaatctatatttcttttttatcatctcctaaaaaatacgatctataataatcactttaattgcatataaaatatgattgtatcaattatacactaccagcgacgtacgtcttactttctactagcttgtggtccactctagtagtacgtatttatttaatttaagttcgattgctgttcaataaaggtcccgcattatctaatagttttaatttagacaaattttacggtacattgtactgcaaatatatactaccagtacattttatctaacggtgtaaattaatctgatttttctctaaattattctgcaatataaattaaatagggtatatttgtcttttcatctatttgcgtggagggtaattttgtaaattcgcatttcctcacttagtcagatccggtcgataggcgcccagtcaaatccgctgctgggggaccgtgccataggcgcacagctgcggcagctcgcagcggcaagggcagccgagcggcggcaggtggaagtagcagggcggcatgcggtagcagctgggcagggaagccccgcggcggcgatagcctataagtaatgcaaaaatcacaaattaatatttctactagacaaggactcttgtccgaccatgacgaccataaaaattcacaaataaaccaattcacaagtgtttgtagagaattacttcgagttgaactaattagagataggtttaattattgcttgtgtatccattgtcccgggtgaaataaccgggagtaaaaatctatctttaggactaaagatattgcctttagttccgggactaaagatagagccaggctgatcccgactgctcctttattctattcttttcttcattgtttttaatatattgatttcactccatccccatctccaaaatcccaaatcaattatcacctccaaatcctcaaatcgatcatctccaaatacatcacaaaatcttaaaaaaaattacatcacaacttctacaaaattcatcacatattcacatcacacacaaatcaaatacatctcagatccggatcacaaattctcaaaaaaaaaaaacaacaaaacaagccgccatcttccgtctgccgcccagccgctgccttccgccttccgccggccagcgccgcgcgaggccggcgccgcgcctgcagaccggggaggaggggggagggggaggagaaggagcctcgtgcggcggcggcgccgcctgcagatcggggaggaggggggagggggaggagaatgagaggagggagaggaggaggggatcctccgcgtgtaagatagcgaggagaaggggatcggaggagatgagaagaggaggaggggaggaggagatatgtatctcgatcccgcatgcctcgatctctccgcgcatgccgatcttttttcccggttggtgttactaaccgggactaaagattgattaccaaccgagactaaagatcaaaaagtacctataacctttttcaaccgggacttaagataatctttagtcccggttttattgtaaccgggattattatggaatttgatcgaccgaccaaagatggtttctccaccaatgaattataccacgttcagacacgaatattctacaccgctcgattattgagtgtaccgatgataatgagcaccatctttgctcttcaacttatcaaacatgaccatattataaatttgatttccggcactgatgatagtctgctagttacgaactgacactgatgttattttctgtagtagtgattattgaggaaaacacagaccttttcgaacgctagaatactgttctcctcgctagaatctatacgcacgaatgactagaataaaaccatgaaaaatagatggaagaatggcggaatctattatattattaaaacagcttgtgttgacaacgagtcacagctctacaccttaaacacgttgtgtgcaactcgtggtggcaccctaagacagaccactgtacggagtgcgtagatgtcgccgaacgaacacccgggagaggccccgtcagggtggacgttacaccggtttattttcgactcggcaggccagttagaacgtcctctaactctgtagagacgagagacaacaagcaattttgagattggaggagaatacatttgggattggtagtaagaaggagggtgatatagaatatagagggtttggatactaaatagatttggacaattgattggttgtttattcaatcgatcttagcccacttatattaataggaggggcgggattccttcccatggttttttccacgtccaattaggtgtagaaaccaattaagactctaaaatcttaggctttagcaagaaaatccgaggaccgacaaatcagacttagaatcggactccgttggtttgaccggccccctaccgtctatctgactggccagatggctatggtcagactgacctcacgtgacaagtctttgcatgtctgggttattttcaaatttaatcatggttttctattattagtgtaggagcaaaatttggattaacgccttgaaaggaagcaccatgttcattacggaggctaaaaactagtgagaaaagaagacttcgactaggaatacatttagaagtaattgaaattcgaaataaaaaataaaaataaataaaaagaagagttcatgtaaaactcaactaaagagattggactaatccaatgtttaggggtcggagaaggagcgatggcggagagggcgattgggcggcgactcctctcgcaggagagttcatcggcggcgagggtctctccggcgacctcggcggcgctcagagacggaggtaaggttcaaggggcgggatccggaagtttgaaagggcatatcgcgacaaaattcctcgcgggaggggtttcgcgctgcttttcggaagtttctggggaagggcccaaggagctcatccatggcggagggagattgggccatctagcccatccctatagccggggttttggccctagactttcacgtcagctggcacatctggatcggcacctgaagcatctgtggggatcgaatcctcgagagctagggtttagaggggggtggagaaaagaggagttgagggaggtgaaggcggcggcggaggagtggccgaggctaggaattggtggcggggaatcgaggtggacaggtacgatcaagggagatacgcgcagatttgagaaggttgttcgaggtcggattccagcaatggcgcaacaaggagggggttggagagggcgcttccaaccaaggccagcgttccatgggaggcgaccgctaggagtggagcatcatgggaggcaaggccaggagggagttcgagcagttcatccactaccagggcgcgctgaagaaaagagggatgagcaagtctcggctgtggcaaccaaagaggggagtttagtgcagcagatcaagccgatgcagatgcaggagaagaccgaagtgggaattactgtctcaaacctcaagcaggatgaggcgaaagctgaggttgcagcttctcgtcctcctccccaagcaaacccaagacatggtatgaatccgaactctcacagaatcttttgtgtgagatgcaaaggtgttggtcacttggttaaggattgtcatgttgctgtgttttgtgtcaattgtgctaagcctactcacaagactaaggattgtctatatgataagcaacccagacctattgccaagttggtgagatatggtgctccagggcttggatgtatattgattcagaacactagatctgagccagcaaaggaacacattaatcctttggcaatgatttcaatcattagtggagggggattaactgtggcgcaattggaacaaggttttactcagcagttcaagtggaattggatatggaaagcaaaagaaattcctaatgggacctttcaaatgaggtttcccaataggatgaggtttgatgagctgtcaaactttgatcactttactgtcaaggggactaatgtgcaggttaatgtcaaagaatggacccaagaacctgaagctgtagggaagatgcatacagtttgggcaagagtgacaggtattccggatgaaatgaagacttaccctgccccttttgaggttggttctaacttgggactagtgatggaagtagacatgattactttcagggcaaaaggtctcatcagaatcaaggtgggtatgatggatttggaagcccttcctctaaaactaattctgactacaccaaaagggctgctattccaggctcagtacactttggaggaagtggtagagcaagggtggtttagagagcaagtctttgaagaggataaggaagctgtctatactccaaccaaggtgggatagagggaggaaaaacaacatgtcaatgaggggggagaacagggaccaagtagtaacaagggtgtgtatagggctgggaagggggatgaagttgtgctagtactggaccctggattgacaactgaatctgatgtggctaagtgtgttcagttccatagggacagagatttggccatgaagttgcaagatgaggagatggaaaaacaatctgctaggattttggtccaagaaggaaatgtgattctatctaaaagcaaaggggctgggaaagggtctgagatgtctgaaattcccattgtagaagagacacgtgctggagatggggctttatctagtggtgggacaggaactttaagctgtttggaggtgatggctgagactgaattgggccctaggggagaagaaggagaaagagttaacttgggagacagtgaggatttcctagattcccaagaatctgaaggaaactttgccaagcaagttggtgtggttctgactgaagagggcatcgacagtcaagaagaagacacaaggagaagcaagagactgagagataaagaagacaaaaaaccacaagacatggcaatggaaaggaaagaggctcagaatgcctttattaacaaaggtcaggcttcaatcccttctattattgatgaaccaaatagctctctcatgaacattgctaatttgttaggagttagtcttgggtgtgccttggttgatgttgattctaatcttcatctaataaaggatatggagaatgctagagtcaatttgtttatgaaaaatcaagaagcaattttagacaaaactcaagagagcaaatcaggagattttcctgaactctctggcttgggagaattatactctttagaagatgatgtggactctgaacttgatgagatcgaaaatttgattaaaaacatacacacttccagtgggaaagggaaaagaatgaagggaaaccttgacactgttaaggtaacacccatattaggtaagagaaaagggaaaaataattctaagaaaaatgattggacttttttggaatattaggggaatggggagtcctgaaaaaataggtcacttgcaagacctaatcaaggatcatcatttagattttattggcatcattgaaactgttaagcaggaattttctgctactatgttgggtagtcttggaggtggtaggaatttggtttggaggtggatccctgctaatgggagatcaggtgggattcttgttgggatagattctgataggcatgatattttagatactagctttgggaactatcatgcgagattgaagttacaaaaaatagatgataagaggtgttgggatcttgtggtagtatatggggcagctcaatacgcacaaaagaacaactttttggctgagctagccaatgttttatattatcagaacagacccttggttgtaggtgaggatttcaatattctgagaaaggaaagtgaaaagaataaacctaggggatacaacaaatggagtttcttatttaatgccatcattgagcaatccaatctaagagaggttggtatggggaatagacagtatacatggtttaacaaccagattcagtccactctagaaaagttagataggatttttatcaacaatgattgggaggctgcttttcctctaaccactgctagaattttagtgacgactttctctgatcatagccctgttctgatgagaactgaggcatttgttaataagaaacatttgttcagatttgagttaggttagttccttagggaagacttggggagtgtgataattgatgtttggaataaacagtattctggcaatagtattgagagatggcagaaaaaactcagggcgcttaggaaaaaaactcaatgggtggaacaggaattgggagggtttatataggagggaaaaagaaaacattctaaaataaattgatgccattgacatcaagattgaagcacttggtatgacccataagtatagggaagatagaaaggagttagaacagaaactagcctatgttataagggaggaaaaatggaagtggtttcaaaggagtaaggttagagaaattctagagggggatagaaatacaaaatactaccatgcaaaagctaatgggagaagaagaaattgtcaaattcattctcttagtcaagaggaaggagaaattgaggggcaaagtaatttgctgtgttatatcactcatttctataaaaagttgtttggtcattcagttgaaaactctatttctattgaaatggaagggatctgccaagttactgaagaggataagaggagactcactgagcccttctctatggaggaaatcaaaagagtggtctttgaactgaaacaacacaaggcccctggccctgatgggatacctggggaattctacaaaaaattctgggatttaattaaaaatgatttgtttgaactccttagtgatttccaaaagggtttgttaaatgtggaaaggctcaattatggcatcatcacccttgttcctaaaacaaaagatgctgcccaaattcaaaaatttaggccaatttgccttttgaatgttagcttcaaaattataacaaaggttctgatgaacagaatttatcatgtgatgtgttatattatctcaaaaaatcaatctgctttccttaagaacagatatattttagaaggggttgtcattttgcatgaaattttgaattctcttcatcataaaaagcaaagtggcattctcttcaaagtcgatttggaaaaagcttatgacaaagtgaattgggtttttgtgcatagaatgctagtctctaaaggtttccctgatcaatggtgtgactggattatgaaagtcattaagggagggaaggtggctgttaaagttaatgatgagataggtcctcttttccaaactcacaaaggtctgaggcagggagaccctttgtccccattgctgttcaatttggcagctgaagcacttactttactggtgcagagggctgaggagcactctcttctggagggtctaggtaataatgaagaaaataagatctctattttacaatatgctgatgacaccatcttcttgctccctgacaacttagaatatgctaggaacttgaaatttattctttgtctgtttgaacagctttcagacctcaaaatcaattttcataaaagtgaggtcttttgtataggagaggccagagatagaaaagtgttgttcagccagcttttcacttgtaacataggtgatttgcctatgaggtatttgggggttcctattgatcaaaaaaggattctcaataaagaccggaaaactgctgagaatacaatggaaagtaaactgagctgctggcagggcagactccagtcaattggggggagattgattctcattaattccagtctgagttatgttcctttatatatgatatctttctatagacttcccactggtgtgaaggaaaggatggatttctttagaaggagattgctctggcaagaagatcaggggattaggaaatatcatcttgtacagtggcctgtgatttgtactcctagagatcaggagggtttgggtgttctagatttggatcttatgaataaagctcttttaggaaaatggatttggaaacttgagaatgaggacgggtggtggcaggaggtgttgagggataaatacctgaagaagaaaacaatgtctatacagaaacctaaacctggtgattcccacttttggcaaggtttgatggaagtaaaggagagattctataatttttgcacaaagaaagtgggggatggaaggtccattatgttttgggaagatagttggctcgggggcagacctctggctcacttattccctactctctataacattactctctcaaaacatgtttccttggttgagattaaaaacaaaggttgggaggttataaagtttagaaggtctttgtatggaagcaaattgagggactggaataaaattaaactttctgtggaagggattcaggttgaggagggggtgagagataagcttgtctggaatctgacaaaaacaggggtcttcagtgtgaaatccttctacaatgcactatctgttcaacaaatagacattcctcttaagaaaatttggagtttcaaaattcctttgaaaattaaaattttcatttggattcttttgagaggcaagaatctgactaaggacaatttgtttaggagaggttggagaaagggtgatacaaaatgtcagttttgtgacaaacaggaatcaattcaacaccttttctttgattgctctcttgtcagactaatttggaatataatacaatgtgcttttgatctcaaaacagctaaagactgccaacacctttttggggcttggctttctgctttctcgaacaaaaccaaaaacttgattgtaactggtattgctgctgtaatctgggctgtctagaaaactagaaataaagcttgttttgataaaaaaaattgcctaatgatcccactgatgtagttttcctggtttgccactggatggaatcctaggctcttttgcagaagcgggaggcagatcaaagaaagctgctcttgggggccaagctcataaggcaaattgcaagtgatgtgtacaattctaggtttggatggaggccgacggggagactgcagtgttgatcttttggcgggggtagagtatgctttgttgattgtgtggatgctgggttcatggctcctgttagtcctggaagtcttgttatgcagttgttgattctgtgccttctggatagtccatgtatggtcaaagcagccggtgtgctggcttctgtcctttcttttctgttcttcagtttgtaagactttgatcttgtaatctctttcatttctagtaatggaaatgggggcgtaatgcccttggtcaaaaaaaaaactcaactaaagattaattatctctaattggatttatagtttaattgattaaaacataccgctcgtaatggtaccatccacgattgaaatataccgcttatagtttaattatatcaatagtctttcatgtgggaataaaaaaataaagactattgaaagaagagaccatctagaacacaacacgagattaattaaaattcagaaaaaaaaatccaaaaatataaaaataattgtaggagttaaagtatgaatacaatttataaataacaaaatattgaaatgaaaaatatattttttttaaaaaaaatagtccatctagaacacaacgatgacaagtgacataaagaggagagaagcaacaaacctgtaagaagtagtgttgtgggggttgatgggacctctaaaaactataagcaaaactattgacagtcattaagtaccaaatgcgatagtcaactatgataataaataaagagagaactagcatttcttacatgtattccaataataaatagtgtagtactactatgcttgaagaattaacatgaatgcagagaataaacacacttctggctaatcacgtgcgagcacacggattgagtcacccacaagtcagctcaaactgactcaaagtggggccaaaccaccgggaaccgaccaagaggcccacttgtcaaccacacaccaaaggaggtggctaatggcggttactctggttcagctgaaccagccttggagcgcccaacactcccttccacttggcaactcctcattcactcctgatggcagttatgcttgattcccggcccacaactgccttaagcaaccaccatttaaagctataaatagtgataaggacataactagcttggatatgtccatgactaacttgtgtatttatcaaccaaaggtacatatgttttatattagatttacttattactccgtatatatttgaataaacgttactacaccatgagttttgtatcttctcgtttgcagatctacttgcgtggatgatggaacagagaccgggcgtaaggaatgcatggatgatcaaaaaagttgattgggaccaaaccaagaccttctcctagtctacttttacctaaccacgtcacgtttggtccaaagaagataagagataaagttctacacgttttggattcggattcgggccttctgacagcattaacttcaaacagacctagccgctcgtataaaaggaatttcggggcccatgagtacttgttggaaagcttatggagtatactttcagatggttttggtcatacattaaaattcccaccgagttgtcggaaatctgcaaaacaagcctcataccttatccagtccaaatctgatttgggttttagaccttgtaattatgtcgtcgcttagaccaaaggggcgtgcgccattgggcaaccctaggacgtccctaattatatatatttagtagtcgtcatcgtttagagtcgagttttgcttagattatttctgccattgcagtttcgccgctaggtcggtttgtggaaccctaaatttgagtgcttaatcattcgtatgcaattgtgttgcaatctatcttattcttgcttgtgttcttcgattcgcatgcagggattagccttctcggcgtggtcaaccggacgatgcacggttgataaccagaggagacgtggtgctgcgatttgcatggttcggatcgtgttgatcggaagccggattgtgtgtgtcaagtttccgccaaatcgagagttatcaatacctatcgaaagatcgagacctagcatcctcatcatagaggagatcttttcacttcccaacacacacctcaaggagcaattctctctatctatattgtgttctctacagttttagtagaaataggcttggagtatctccggtcctatagtcttcttagagattccgatgtgtgtttagttctttactattttggtaagactatatttgaattaaggaacaattgcttacttgaccctagtttgaagcccaactactaaattgaccctattttttcaagtttgctcatttgaccccattttttaaaactgaacatcagagctgaccctattccgtgaagaccaaataacagtgttaactgtgaagcaattatcatttttgcccttgctcatttaccaatgttatatcaaagatttttttttctttcattcagtcctttttaatatttgtagttcatctcattgtcattggagctcaggacagtgttcagctgctcgctctccaacaccgggcaggagaactcggccgtcgagatgacgatggtggcgccagtggctgcctgttgctgttgacctgttgctgccgtcgatctgcaggccggggatgagaggctgtgccatgggcatgtgctctgttggctggatgaccatccggccaccgccgacgtcaatggcattggagttcgccggaactgacagaagagagagagcacaatcggattcgagcacttgtgtcagcccgcgcgcagtcgccgccacccctcagcgcgctggcgccggcgccactgccaatcgccgtccctctctccctccgcacggcagcaaccgctgccgctactccgtgcgcccgcgccgaccgccttcgctcgctggcgccgctcctcctccctccacacggcagcagcccgtgccgccactcctccgcctgcaggcgccgccggttctcctgcctccgcgtgccgacgccgcccctccctccgcgcggcagcagccgacgccgctgctcctccacacacaggcgccgcctcccctctgcgcgccagcgctggcagtcctcctccctgcgcggaccgccgcccctccctggctccctccctccgcttggcagcagtcgctgctgctactccaagcgcgcgcgcccatcgccgtccctcccttcgctcgctgacgccgccgcccgccgctcctccttcctccatgcgcccagccgtgccaccgagatgtgtgggtgaagactcttgatttgtaacttggataaggttattatttataatcaggggtatattggtcagttcatactagcaattttattttttttcattttgctaactaagacactaacggactattaaaaagaggctcagatggtggctttgattttaaaaagcggggtcaaatgagcaaagttaaaaaaaaaggggcaattgtatccatgcccccacttttaaaaccaattgctgttttaccccatattttagagtttgtatttttacccccactttttgaatctgaagcagctgtgtaccctcatttctaaccgccacaactaacggtgtcagttgtagagaaaaagacatatatacccttggtggttattgtagttttgcctccattttttttagctttgtgtgattttgccctcattttttttcagcttgtgtgagtgttataatgtgaggctttgaacggcctatgcattcactctgaaccctctaaactacacatcaacgccacatttagttgtacatggcataatacaacagagttgtgaattgttccaaaaaaaaatacaacagcccatgtaccctagatttttttgttaattgttgatcgctctgtgtccagttcttcattgcatagagcaacaaaccgcaattaacgaagcagaatgtaagcaggaaataacagaacggaggagcatcatgcatttctatagctccatctctgacgacaaatgcagatagcaaccgcaaaatgagagctgcagatcgatggatcgatctctcctttatcattgtcgcatcacttgacgactttgatccactcagtgcaccctgcatgcgaatgcacaacacataggcaaattaacaaaagctgcagctaataacacagatcaaaaccgttattgatggcaaatgaattacctggagcagtcggtggaagggctgatggcgtaggggatgttgacgccgcacttggaggggatgccggcgacgaggtcgggcctcaggccgcccatgccgctcgtctgctgcttgatgcaggcgcaggtggtctggtggtcggcggcggcggagttgagggtcctgaccccgtcgcagcagccgccggtgggggcggacaccctccccgtcgcgtacatgatgcacggcgcaagcatgcggccaacaactttcccttttctgccttgtcttgccctcggctgtgagaggccgcctccacgtggaagagcagcggctgccggctgtggacctcctgcgagcgggcgccggcgcacgcccgcgtggccgcggcctcctcgcgcggccgccgccgccgccgccgccgcctccgtgccgcgccgccgcccccgcgctagctagctaggatttcgacccgactcacggagacgcacgggaagaaccctatccattccctttccctcaggggtacaaatgtcattacataatttctaaaacctttttttattttgtttttatttctttaacacaaaatgtgggacccaccaaacagttgtcacaagtgggggtagaaggctacttcagatttaaaaagtgggggtaaaaatgcaaaccctaaaagtgggggcaaaacagcaattggctttcaaagtaggggcacagatgcaattgccccttaaaaaaaatagggtcaatttaatagttgggcaaaatttaactatttgccattcttgtgacatggcaattaacgatttaccatactctatcaattacatgtgggctctcatgtgtatatgacatgtgggcctagtggcaaatcgttaagcaacatttgtaagagtggcaaatagttaaaagctccttagggtcaaatagcatttgccccttgaattaatggaattatcttattatttatttatttatttatgctcatagtatgtgtattcatttattggatatgtgttctatgagtagtatatatttcgcatatctcctacagcctaggctagtcgatccatgtaacaattgttcatttagaactaactgaaattcaaaattaaaaaaataagaaaacaaagagtagagcttagagtccacgtagaaatactatttagaaatatctaaaatcaaaatttttaaaaaaggatattggaagaagatgctagaaaccttatagtaatactcctgcaataaaggaattagaaaaggaatactgtaagaagagtctatagtccatatagggatacaatttagaaataacgaaaatttagaattaaaacataacgaatattaaaaaaaattctagattccatataggaatataatttataaataaatgaaactagaaataaaaaaaagagaaatattaaaagaagagtgtagtccatatagcaatacaaataacggaaattcaaattttttttaaaaggagtgttgaaagagaagtctagagtttatatagaaatacaatttttaaataactgaaatttgaaatttaaaaataagaaatatggaaagaagggtttagagaccatataggaacaaaatttataaataaagaaaatttgaaattataaaaataagaactgttgaaagataagtaatttagagtccatacagaaatataataaaaaataattaaaattagaaatcaaaaaataattattaattatcgcgtatatacaatacactataaatatcacgtatcgaatagtttggccaggtcagaacagaattgaaaattatgttgtcattttaatatattttaataatacaaaaataaaaatatatatgctattatgtgagaaaaaatataatgattctagccgcgcaatatacaagaccataatgctacttgaaataaaaaagaaacagatagagcattaattttgtttgcgagcttcattgacaagcataacctttgcctagtggtgtgtttggatggagggatataggtggataggacatggcggcccattttttgtgggtgtttggttcctgggcaggggtgggatggagcggcccggggaggaatattccccccagatgccggatgaggggatccggccgaattggccggatgcagccgcccgagcgcggggcgagcgaccaaggcagtcgcatcactcctctccaagaaagagcgacggcgagggcggcgaccagcgggagctcggcggcggctgttgcgagcggcggcggcggctggtgcgagtggcggtggcggcgccagatgcgcgctcggccgcggcgccggatgcgagctcgtcggcggcggcggcgggaggcgcgctcggccgcggcgccggatgcgagctcgtcggcggcgggaggcgagcttcgtggcggcgccggatgcgagattggcggcgacgggagcggcgagctcggcggaggcgcctgatgtgagcgccgaagacctttttattttcctatttctttgttttttttcttttttttctctatatatatatatatatatatatatatatatatatatatatatatatatatatatatatatatgaatttgtgatttgtagtatatatgaatttgatgggggtatactcaccctctctacagtgagaggtgaccacatctgctcatccacctactccgcccaactaaacaaaaaaattggatcaccaaatccaccttcatcactacaaccaaacagttttatcgatattcacctaaccaaacaaaaaactggatcgccatatccaacaaaatatggatcgccatatcccattcaaccttgaccgtgaaccaaacttattggccatttggtggtggcctggtggagacgtacatggtcgcgcacacgcacgtacgactcgaactgttaggggacaaattgcaagacacccatatctacgccaaccacagagtcatccaagagtataatgtaaaggcgacggtagtgaggagctagcttgaaaagcagataccagcagcatccagtgagattgtgaatctatcgcccgtacgccatttctacttttccatgggtgtccctactaatgaactctggaaggggtgtccatgattgaaacctaccaaatagcactgtaatggagattaaattcaaacctctctcgtgcacggtaggtgcagtctgcatttcagtctgctgttttatcaagagcacatctttcttgtcaagttaattcccattatacgcccctgactagctgtaggcgctgtagctagtcgagatatgccaatcatcatcaagttttatcaagaaggtcacatcaggcagtgcgcgcctgaggtgagcaatggtgttctccttcatttgatcaaaaccattcgaggaacaaatcaatcaattggtctccgcattatatacatacgcgcgtacgtacactaagctagatagctagctaaaagcagcaaattttgctgcatgaaccggcaagaattcgtgaaagaatcccacgagcaagaagcccggaacccccaccggccaccgggcagctgaagcagagtctacccgcccggtgattgatcggtttccggccggaactcccatgtttgcatttccggtctacactacacaaccaagctccaaccaatgccagccgtactgccactgcgtgtgcgtgcatctctggtgccccggccgagcgaccgggcagctgctgcagcaccgtgcgccggaagcggcagccaccaacgacgacggccgggtaagtggtcgatcgcctcatcgattgaacggtcactcaggcagtcagggcggcgaggagggcttcaaagtcggcctcgtggcagggaagcgtgatggcggcgtcgtgctcgaagccgaactcctcctcggccttccgaagcagcagcaggaagtccgggtgctccaggcaggcgatgggcaccacgtaccggcaccggctctcgccgacgtacaccgggaagtggcccctcggcaccgcgccctgctgctgctgcctcctcccaaggctcgagcacctcctcaggatctgcttcaggttggccgccggcgcgatcttcttcgccatcacagctaccaaattccactggatcaatcagctagtgtatttctctctctctgtttctgttgctgctgcaaagcaatgcagtgaagctagagtgctcaggaggaagaagagcttggagagttcgtggtggagatggccggtgtgcagcgggcggtgtggctgggtatttatgggggaggtgagggaagaggaggaggtgcaagtgcacatggtagggccggcaagatgagggggcaggaccacgggggtgatggggtcgtgtgttttggtggaagagggaaaaaaaacaagttaagcttggatgccatctcaaaacctagggtagctgtacgttcttccagacaagctggggcctcctcatctcttcatctctctctgccctccatctttttttttctctttagtgtctatgtccaggaaaagtttaaggagttcaccaaatagttactcaattgatgactccggatttgcttattaatacaagctatagcgctaggctactctagctccttgattgatacttcctctgttttacaatataagattttctagcgttgcccacattcattttgatgttaacatctatatgtatatgggcaatgctagaaagtcttacattgtgaaaatgatggagtataatagattccacataatggactgggctgggggtgaacaggtgcatatatcctcctgcggctatctagatggcgcaggtagtgtggctaacgtgatttgagcggttccgtccactttgacgttctgattgaaaccgatgtcgttgttccataaacagagaatgagaacaaatttatggacaccgctagtcatctttgtcaaaagaaaacatgttgtatgattctcggtttcttcatgttggttttagtttttatcatgcttgtgacagttgatcgctactgaaagtgaaacaaagtatgcaattactcccgatgactgctagtgctatataccctatatgcgcatccggactgatatcttcacaacttgatatagttgctaagagacgtacaacccgcatgatctaatgatcctgtagtgtttggggatcggatagactgtcagcccaggcgcaagatgcgaactaacataacacacttatcagtttcgacgcaagcattgagtgggagaaaatgttgtgccacagaatttccggtcatggcatgtgccgtgtccatgagttgcagagagagtctgcttttctctttccaaaagcgaaatggacaagatccccagtatatactacaaaatgatttgccttttgcattttcaaacaacctatatatggtttgcttaaagttcaaacaacgctcttcatcacataaatggaaatatatataagatgtaccagtagataggagtactaagcacaaaaaagttgactctgattaattatgaccgtcttttagaggatctcagttgattttggtcaaaccgcatttgctactctctgttttttttcaagcatgggcaagaacattgcacgccattgtcataaattaataagaaaatagttgcatcggtgccaagcacctagtctactgtaaatacatgtaccatgcattcatagatggatttgtcagttaattgacacatagatctacaaactgtcgatctgtacgcttggaatcaatttgctacgccagcagttggtcttgcaacttgtgtgctagtttcatttgcctggtcttgcattgctccaacttaattaattagaagactttgcctagctaaacctcagatttctatcacttaatcttggagactgagcccatgaatgcttaggttctttgattatcacctgaagagtcagtagtactgtttcgattggatacccctgcagatcgagaggtagctttcttataatctgaagagtcagtactgttagcaaagtcttcagttgttgtgtcctgctatacctagttacgtacaagtatacgtacaacacgtacacgcctgtagctcgttgcgagagagagagagagagagagagagagagagagagagagcttaggatttagaggtgcagatgcgggtacaagagagtggtactatcatgtgcggcctgggaaagttgctgtctgctgctgttgcatgtgactggcgttgaggaccctagcgcaagggccgccgattggtgatcgcccacagagtcacaggcgctctcgctgccattcatttccggtttcccgtttccgccggggtacattgtggctggctggcccatgcattgcatgcatgcatgcatgcgcggggcatggccatgtgttcctcccccaatcatcattggcactgccgcgctcggttacatttacatatttacacccggcgtttccaccaccatccacgcacgcaccaacgctcgctatctacctactgctagtgctaggtggtcacaaattggtaatgtcgcatgcattcagactaattcgttgcatgcatgtatgagtgagaaaaatatctcgatataattggaataggccgatccagtggttggaaggcccgggagcaaagactggaccaggtctctcggctacttgcctgcctagtggctgccggcctgtttcacgcgcatgcatgcagcccatgcattcatgccactccgtacatggttaacacagtacacttgtaagttgtatcacaccccagacatatgtaggtcctgcagatataagaaaaataagtttataggtcatgcaaatgcaataataagcgtaattgtaatgcattgtacgtggtggaaagtccccaaagacgcagctacgtaccgtctataaggtgggtctgtgggttcttgagcccccactatctgtgttgtaaccatgggagccctcataaagtccccactaaaattntctgtcatacatccattagaaaaagactataatcttttgtatagtttgtttagaccctcctgttaatcctttctagatctggccctaatataaaccatctagttagttttttcttttataaaaaaacttctagttttctctcatgccagcagattcagcatgcatgacggcgttcatttattacgaggaattcaggttctagatgaagaacaaagaatgcgttcatggaggcttggggacctacttgatttccaagagcaatcctagacagagctggccttcggggaccccatcccaataaaatgtgaggcccatacccaacaccaatacaacgccaataggaataagtccatttgtcgtccctcatctctaacttgagtttacactataaaaaatcctaataggaaacatcctcgtaggtgctagtaaaaacatcactttgctcgcctttccaccatctcatatatatatatatatatacatatatatatatatatatacatacatatacatatacatatatacatatatacatatacatatatacatatagaaatcggcgcatataatcccttatgtcgattgtttattaaaaatactggcaccaataatatctaaaccagttttttaataagcgggcacctatgatatggttataggtgccttttttttttttagaaaacgaacacccctgagatagtcgagccgatgaccgatcgagctggcccgtttttttgtatggatgactcagccactagtgtctacccaatctatctcactcattgttagtatttcttaacgacattactagaaatataatttccagcaatggcgcaaaaatacatctggtatattatggctacagagttcatcagcaaacacacggatataccattgtagcatttcacccgagagtattccaagggtatcgtatttattttatcccgtggaaagatcatgtagagcgaactcaactaataatttatatattacttgtgataatcatattctaatcaggggttaagataatccaagggtagagtgacacaaaagcatttaactactcatcctcatcatatattatctaaactaagtggaaagaaaagagaaaagaagtctattcctatacttctaatatacatagttgttaacagtgaaatttggtaatcggcaaagacgtcatcggcttagaatcattatcggctgcaacatctcggaatcagcctatgggagttatcaagtcaccaatagtcggattcctgctatattcggttaaggaaatcaatctactaaaggaagcttatccctaagtgaccgagtttaaagaggatgcggcatgacagtttatctattaattaaaaatagtttgttagtttccttttatctttaggaaagtgagtttagtgtccgataaggactttattttttccttttatctttaggttagtttctttcttgtccgacaatgacttctatcaacccatgggtataaatatgtacacccggggtctatgtaatctaacgctacgatcaatacaattcggcgcatcgccaccctttttacttctacttttgctttttacgttccggcggaacttggcacccgacgcggggctgcatcgtcttcgatctccggcgaaggggtaaatctaatgttccgtcggcccaggcaattgtctcatctacatcggcgtcgttcaaggctgcatcagtacattcgacctcttggattgctctggtttggatgatatatttgcctacctatttatcatatttctctgttaatctaatcttagcatatcaatttagctctatcggctatatctcgctttagggtttctgccggtatcggctaaatcgcattgctagattagattagcataggcatctaccaccctgaaaatcagtcatcggcttgattgtctagatattatgtttcttttcatacttagtgctgcatcagttaagtttgatctactaagttgtgcttagaaccacaatctctagcctgcttattgattgccaataagggtttcatcggggtttcagccggtgagttatctgtacgttgcatcggctcatgaggattgcatatacatataagttggatttagccgatgacaacaaaggtttcactgtttaatccaatcttgtggatttcatgacatcggacctccagccgatgtgtgctttaacctttggatcgatgcttatttatcatatcattgctagccgattggtttatattggattatattgttattttattacatcatcatcagccgattgcctttatatcattatctacattggacatatagccgagtgcataaaccctatcgctatcggctggtatcgacatcggctattatcgactatcggctggaactactccatcggcttgtcagccgattggctgttttgatctactatttgcatatctttgtcagttgcaggatcaaactgactggcacgcccgcatctcatcatatttggacttgcactggagctaagcagatctcccaggccggtgtgttcgattttttcgtcaacaatagtatacatacattctagttaattgatatactagctaataccctctatccgatgccctcctggtacttcgagaagccacctctgactgccgagttccttacgacagcccgtcatgaccatccaaccagggctaaatacggaggaataccctccccaggaaattaacttaggattatatataggcgcggaggaatacctttactgagctgtcaccatcagcggcctacctctcatccgcaatatataaccccaaataatgatatcccgtaatctagacaccacgtctaaactaccagatactactctaatattatcgtcatgacatagagtaattgcataagcaaacactatacccgcaccaaagcatctcccagataagctagccgtacattcaatataacaagaacataatgtaaagtaggtactcatatactcggaaagtatttcaatatcataaatgtatatagaagagtattctaataaaagtacaaagcttacaaaagaggaaatgaaagctgctagagccatacgcgaactcttccggactcctgattcctattctatttctattccaccagctagatactactaaactaaacttgagaggaatgagagagctcttgcttaaggtgtgtgagtgaagtgagaatggcaacttcttttttatagccccccaatgatggttgtggcggttggagtggtcggaaatgcccttcaactgtcattgggggctaatccacaccgtccaggtgaagccctggatcggatggcgctaaggagggttcggccnaaccccctggttcggccgttcctggggccggcccgatccagcccaatctcagctagcagcctcctctgttgttcctcttcgtagacttgtgaattttggcccagtttgtcgtgtcaattctgagttcgtggcccattcatgcataagtctggttctcgacatcgccttattgatttatcgttggtgttgatgtcgattctcctccactttatgatcattctctgcaaaaggttagtaaacctaatactagtggaatattattattctaacaaatatatgcattgcaagcatcactagttcactcctgttttagtaatattgacggtcgaaactgatcgataacgaccgtcaacaaaaccccccaagcttgaacctttgcttgtcccgagtgaaggacgaaaggaaacaaagacttggttgttgatcaggagttactactatgctgcatatctcaaagatacaggtgcaaggtatatgtattctctctcagattaaataatctttggcacggtggcttacccttacccctgattcccacgagacactgcttctccttgccttgggcggttgaaagacagaacaacaactagagcaccaatcacccgatctttattcaactcttattccggaagttttcaaatgattttggaaaagaaaaccaagttcctcaattgattcacttagtccctctaagtgtatcaatttgaattcctcaccaaatgatgcctttttgattcctactctaaggtttatatgtggagctcggtagagaccaaacatggcacgcttgcattcacatttattactaagtcaaaaacttagactaaagcagataactaaacatactcaaaatcaagatcgtgcataatgtgtgtggtatatagtggaaatggtatatgaggaaaaataaaagaaaaaatgcttctcctttgtgcttactttcttctcccaaaaatcttttttttattgattaggagagggcatggctacatttttttttcaacatcatgctcatgcttgatggagcataactttatttatttttttttcataaccatgcctttccctcttttttttcttcaaaaggatttttctttttaggagcagaaaacacatgaaagcatggagaatttatattggtggtaatatgaaaatggaatggaatatgcttagctcccagtgtaggagtttagcatgtgcatatatgtgggtgtatgatcttgattatagagcatgagaagtatcaacacaagtcacaagagtttgacaaagttcaatggaatgtcaagcaacaaaaatgcatactgtttaatcatgatagcacatttttgtctctggtaggaatttatatcaaatgagaaaatctcaatttatcattttgggaaaaaaaaacatccggaattcaagtcaaactagtatcagtatcatagctactcctagttactatctcatatcttgcaaccgcttagacttagatcagcaagtgcggcccatttacctcaggttcccggataattgttgcctacttatattcaatccttgagagagtatttaccaagaacccatatatcagagatataaaacagagcaactattcatcatttcaacaaagagaactagcttgtcttacctagcatgactcaaatctatcctatctttttggtattttctattttgtaaatttttatgttgttttcaaaattttataagatgcaattggaaagcaaatatgcaattggaaagctaatatgcaatgtgatacaagttacctcaatggggggagcatgtctccccccaagcttggttttcgctcagggtccttgataaggattgaacccttgataatgaaagtacgcctgaaggtcaccatgctgttgctgcatcatgttgttgatgttgacgaactgagcatcagcagattgtagccattcttgtgtttgagctatgtgttccgtgaggttgtactggatctcccccgtctgcacatcaagggtgtccattctcctagtgatttcacccaagtcccaacaagaggaactcgagtgccattcacttggagatggaggcacaccacttgatctggagggttgattgtccccccagtggatgccatgaggcgcatgccaccggtcctcactggcacttgcccaggttgagactccgatgctatggcgtggagcttgggtccatccgcgtgcatccccagttggtgcccaacctgcctcatacatctgcacgggtgtcaaggatgatgaactctctcgttcgttccttgtcatgttgcgcgtctccctgtatgttccacttccacgagattcttctatggtctgcaggggaatggttagtttatggaagttgtacaaatgatattcgcatttggcaacgagatttcatttgtacaaccggggaaaaagtatatcgaagttccatctgctccatgtttcaaaatatgcccttgcactagataagcctcatcaatacgcggacgagcggctgagataaaagcaatttggtcgctaacgacccctagcccttttgctatccgagtaatcagagaagtgcactcaacaggagcagagaattttatactttctaaccattgctttatcatacatttcacaggagaaattttgatttttctaaccatggcaaacatgataattaattcatctcccctaatgggtctcagatcacttctaggaaacaaagtcatagcaatccatttgtacatgagcctaagtgtaggattatggatgtcatttgttctaggtttcttgcaaattagagcacgagaaatatcttcccaaaacctatttttctcgaacccagaaattcctttctggagatcgattttacaggaatcgtgaaaaccaagaagtgtactcaaacctttccatgtgagcgtgaactccttacggaaaaagcgaaaagaaatgccatcttctatttcttcaaagtgcacagaaattgtaaagtaagcaaacgagaaccaggctcatctaccacagcaaatctctgccaaccaacagctttccaaatagagtgaaattcaacatccatacctatctttttcagcagctccggtgagtattctctcgtgtgagcatactcctggtcgctcagcatgtagtacgcttgtctctcccgataactgacaaggtcgaggtcagcgtcgtttaggagttgtcacggagcgtcggcgtcttccattgagacatcagctgatgaacgagtactagactcgccatgatgacttgatggagaactggaccccttgaatagacgagacaatcgcctcctcatactgcacaatggagcaagaatagtctaactcggcgggggttagaaatgacaagagtttcacccgccggttagtttcaccaaagcaacttgtatatatgcaactaaatttgtttttaatctgaaggaaactatcaaagcttgaatgatcttgagagcaaactttggagagggaatgaaaatgtgttgaaatggggtgaagtcccttctcctggccggttggcttaagtagtgcacccacaacggtcaaaatcgacgtatggggaccactagccgttaccctaccaaaagtggcagggagccgttgcctggccggttcagccgaaccagggtgttcggccgaacccctggtgggcccaattggccccactttcggccgttggattccaacggtcggtgtggtcgtggcacagtaaatttttgttgaaaattttaattttgtttgctcttaaaatttcatttgaagaatttcctcaaaattcaaaaatcctaaatgcaatgttgaaattcaaatatgtgatgatgcaaaaattcaaattgttgaaagcaaatatgcggatacataccaatttacctgttggcgaaggtcgcttcatttaaagtccaacgtgcaagacagtacctccttgtgttttagttcatggattttccacccgtctccggaggtggtggagcgggtgcctttggcttttccttccacaccttctttgatttcggtgcggaagacggtctcttctgagccggctgctctaatttcttggccagtacaggtgattttaccggcgtcctccaataacggttcctgggcattgttgtttccttttccaggaagttctgcataaatttcactagactgtccatcttgggtggcttcacttcgacctcttgaatattctgcgggttcggcccgtacttgattctgaccatggagcattgttccgtcctcggttgaaactcaaacttttcctccttcccgttgatatggaaatggatgctccttgttcccacatcaatgttggctcttgcggtgctaaggaacggacgccctaggatgagcggcgtctccttccccgtgtccatgtccagcaccacaaagtcaatcgggatgaagaaatcacgtatcttgactggcacatcctccgctatcccagccgggtaacggactaatgagtcagccagttggaggcgcattggtgttggtgccaacaccgtgaagttgagtttgtccaagacatattttggcatgacgctgacgctagctccaaaatcacataaggcctggtcgaattgttgtgccccgatcgagcaggtgatcgtgggacaccccagatctttcttcttttccgggagcttgtggagtatgatgttgctgcagtgttccgtcagcttaaccaccttcgttgttgggagcggtctcttgttgttgagtatgtccttgagataacgggcgtatgttggcacttgcattccatccaacaacggcacattaatgtgaatcttctggattacttcaacaaaacaagcgaactactcgtctaccgacggtttcctactccgttgagggaatggcagcagccgcgtgtcgcagtaatcctccggcacggtcttttctggctgaatctccttgtcagccgagtcattagatggcacttcttttgtcaccccattagttcctacagggttaggatacggtggatcacgagtggacttacctctcctcgtcgtgatcgccttgacattttcaatggaagagtcgggttgccctggaatcctcccagattgatttgcaaggactaaagatgccaactgagctaactgggtttctatcattttattgaagctcggctggttttgaaatgtggaagcgaagccatctaatttgacatttttgttctctaggatcttttcgttggctgcaagctttttacttagcgaatcagtagttttggcgtgtgcaaaaacaagatcctttaaggagggctggttagagaagttaccgttattgttacctccttgataatatgagcgtggttggttccacccctgacctccttgtggacggtacccgttgttgttgcccatgtacatcgcctcctcacgggtttccgggcaatcattcccagaatgacccgtgccgccgcagacttcacacgtgtgttaacaaccaaatttggtaatatctgcatcgggaaagaagattagatcgaagcaaagttggaggcggagatcgaaataggaaacagagcaggaattggctagagtccagatcggctacgattaggatcggctgggtttgagtcgggctaggtaagccgatgcaaccgattccgacaatgcaacttgatgtatgacatcgggttgaattgaggcgcttcaaggtgattgccgcacatggatagagtcctgagaaggcaattgtatctagtaattaggatgttttatgtaatttccttagagatatgattgggcaaaagtctgccgcaaagacttatggtatctttgagtttgttagagatagtagtcgtgtccgttttggacatatcttgtaattctcgggtataaatagacccgagccctatgtaacttttaacacacacgttcaatacaatctcggtgcatcgccacctttttgctttagttttattttgacgagttcttgctttcgggttgagctgcatcgatttcgatcttcaacaagaggtaaaacttgttatgatgaattatgttctcggaattagtgcttccatctttatggtactctaatcttgtctatgtaattcatcaagttatcatatatcttagataatcttcgacaatatcatgatctaacctacaatcggctaacatctgttaccagaaggcagttgatttggttaaatagtgacgttgacctagattatataagatatctaccactctatgaaacttccagtggcttgattgtctagatattgttcttcttttcatacctcatgctgcatcagttgagtttgatgtcttaagtcgtgcttagaatatcaatctctagcctgtactctggttgccgattagggtagtatcggagtttgagccgatcttatctgatttaaccatattcgatctatatgcttcaatgacatgttaaatccaccctttgtgtcaagataatgtcgcaatctaaatatattaagcttctgtttaatacattatacctgttttaatatcttgatatagagtagtatcggagtattagccgatacacgctagatctatctgatcggctatgctataaacatatataatcctgttattaatatatatttcgatctaagtgatttatactgtctcggcatggtgaccgatctatcccaatcacttgatttaagtatatattaatataagaactatatatcgttaatatctacagccgatcgaatagatttagttccttactatctgtttataaccgccgatcgattcgtatatgacatcggctcaaagataaatgatgtgtcatcggcacctagccgatcggctatcatttatagatttaactgtggtttctttgcttctatttcttgttgattacaggatcaaatcaactggcacgctcatacattcgaaggcgagctttggacctgcactggagttaagcagatctcccaggcttcgtgttttctgtcaacacgcttttggcacgcccggtgggacatttaagaagtcagccaacaattcgtcctcatggccgagaaacaaccaccaccaccatccccagctagcccagactctgttaaggaaaaggtgctgaaattagggttgtttgacgtcaatgaaggaaacgtcgtgccgatcgatccagaaagattcacacctgagcagagaaagagtttgaagcaatgttgcagcaagcacaggatcagttcttgaactcattcatgtagacccgaaaggggacacttgttcagaagtacaaaataaaagtggttgctgatgatccggggaccagttcttctaaggatggagatgggaaacaagctccagatggctcggctcagctgagtaacaaaagtgctaccgacagctctctaggaaatcaaggtgacaattctcaaggagtccatggagtgcaaggtgacggggtgcatggagttcaaggtgatggtgccgaggggttgcaaggaggaaatcttaatcagaatagtgatgcggcacaagattttttcagtaatttccaagatcgggttgactacactgtgcatcatgctttgatcaatcaatctggggtgttagttaataccttatcaaacatgatgaagtccatagccgatggttcaatagctgagcatcaggctgcaggcccggtttatttgcaaggaggtgtctttccaaattatcggtctttgattaacgatgttcagccatcaactcaggcggttccctccgttgcaccaacatctcagccgacggcactggcgtcaactcccctacctgttccatcagcaatggcgctaggccagccagtgaaccctcggttgttaataagagagcagccacagcatggcgggcaggttgtgaatcggctgacccaagatcaggttgctgccacgtttctgccacctcaatctattgttgatccaatacagcagcagccgattcagcagacgcccccaattcagcaggttgtgcaaccaatccagcaacaggtcatgcaaccagttcagcaaacaccaccaagacagcagcctctgcagccgattcagtagacgctgttaagacagcatatcgttcagccgatctagcaccaaggttcaataggcgcatcggccgggtttgcaacgcctggtggtcagcttgtacaacaattttcaaatcaagttgtcccataacacttggttcaccacatacagccggatggcacagtaatacctcaagttgttcctgagcgtttggtacgtaatacccagccgaaccttcataattaccaagggggtaacttgaattatcaatatcagtctccttccccgcaagcccaatatcagccagggggattggctcaacctcagtttgcgcctcaatacggtcagttcgagcccatgcagcaacagtcacaaggggtagctcagcaacaaccgtgggccgatgtgattgctgacataatgagggaacagtttgggcttaaaccaaaagagactggaagcttgtatcggcagccttactctgagtggtttgagagagttcctcttcccaatcggttcaaagttccggacttctccaaattttcgggacaagatggtgtgtcaacttatgagcacattagccgattcttagctcagtgtggtgaagcataggctgtagacgctctgaaggttaggttattctggttatctttgtctggatcggcttttacttggttttcctctttgccgtatgggtcgatcaatagctgggccgatttggagaagcaattccacacctatttctatagtggggttcatgagatgaaattatctgatttgacagcgattaagcagtggcatgatgaacctgtgcacgagtatattcagagattcagggagacgaggaacaaatgctttagcttgtgtttaactgatgcccagttagccgatctggcctttcagggtatgattgctccgattaggaagaaattctcgtctgaagactttgatagcttgtcacatctgatacagaaagtaaccttgcatgagcataggtctgcggaagttagtaaaaactctaagaaggttaatcatgtttgtccgtacatgtatgggtcggatgatgatgagaacaattctgaaatagctgcagccgagtgggtgaggagtaaaaaggtcataccatgccaatgggtaaaaagttctggaaaagaggagaagtatgactttgatattactaaagctgacaagatctttgattgctactccgagagaagcaaattcaacttcctgctggtcatacaatcccatcggctaaggaattaggcaaaaagaggtattgcaaatggcataattctgggtcccattctactaacgattgcaaggtttttagaaagcagattcaggtggccattgagggaggcaagattaggattgatgactccaaaaagccgatgaaggtcgatggtaacccttttcctgttaatatggtgcatacagctggccaaacagccgacaaggcccgtgcaaggggtttttaggtgaattcggctaagattatcaacaaatatcagaagaagtatgacaagcagcaggagaagcatcatgagaaatacgatgatggttttgatcctcattggggttgtgagttctttagattctgctggaatgaagggatgaggttgccatctattgaaaacagccgtgggtgcagtgatatcgtcgagagctcaagtcgatcatataataggggcaatcggctaaggcagacgagagtttccattcatcaaaggttgggtccagtaaatcaagatcatggccaaaaggaaaatgtaatcaggaagactcaatggtgtccttctggtattttcacgaagaatcagaagcgaagggttcaaagattgaggaacaaggagcgccttcaggaggttgaacaagaagttaatcatcggctgaagaaagcaaagccaaggcaagagtggcgtgttaagaatcaagttcctatagccgatgatgttgcagccgatgaggcaaagaggttggcaaaagggaagagtgttgtgacagcaccggttaacatggtctttaccctgccagccgaattcgggatcgatgaagccgatgtcgacgaggtggaagaggaatcggctaagttggttccatcaccagaacaggcagtgttcgagaaacccgagggggcagagaatcggcatcttaaaccattgtatataaacggctacgtcaataggaagccgatgtctaaaatgatggttgatggtggagctgcggtaaatttgatgccctatgctacgttcaggaagttgggtagaaatgccgaggatgtcatcaagacaaacatggtgctcaaagattttggtggcaatccattagaaaccaaaggtgttctaaatgtggagctgacagtcagcagtaagactattcctaccacattttttgtcatcgatgggaaaggttcttacagcttgtttcttggaagggattggattcacgccaattgttgcattccttcaactatgcatcaatgtttgattcagtggcaaggcgacaaaatagagatcgtgccagccgacaggtcagttaatgttgccagtgccgatttagctctttgggagatggattaccttgattgtttatctggaaaagtctgggatggagattttctaaaagtatccgattctgatatacagccaattgaacatggagaacccaagctattattttgagggcgtcgtggagggttcaaatgtctacactaaggacacggtagatgatctcgatgacaagtaaggtcaaggtttcatgtcggccgatgatttggaagaagtagacataggtccaggcgatcggccaaggccgatgatttattagtaagaacttatctccagagtttagaaccaagctgatagagctcttaaaagagtttagagattgcttcgcttgggagtattacgagatgcctggactcagccgatcgattgttgaacatcggctacctatcaaaccaggggttaggccacgtcaacagcctccgaggagatgcaaggccgacatgcttgaaccagtcatggctgagattaaaagattatatgatgctggttttattcgtccttgccgatatgctgagtgggtttctagtataattcctgttatcaagaaaaacggcaaggtcaggatatgcattgatttccgaaatttgaataaggccaccccgaaagatgaatacccaatgccagtagccgaccaactagttgatgctgcttcggggcataaaattttgtgttttatggatgggaacgcaggatacaatcaaatttttatggccgaataagacattcataagacagcttttaggtgtcctggtgcaatcggcttatttgtatgggttgtcatgactttcggcttgaagagtgctggagctacatatcaaagagccatgaattacatatatcatgatctaatcggctggttggttgaagtctacattgatgatgtggttatcaagtctaaagaactagaggaccatatagctgatttgaggaaggttttcgagagaaccagaaaatatggcctgaagatgaatccgacaaaatgtgcttttggtgtatcggctggccagtttttgggaattcttgttcatgagagggggatcgaggtaactcaaaggagtgttaatgcgatcaagaagattcagcctccggagaataagacagaattacaagagatgatcgacaagataaattttgttagaaggtttatttctaatttgtctggaaggttagaaccttttacaccattgttgagattgaaaaccgatcagcagtttatttggggggcagagcagcaaaagtctttggataatattaaggaatatcttagctctcctcctgttttgattcctccacagaaaggaataccgtttaggttatatttatcggccggtgagaagtcaattggctcagtcttgattcagaagttggaagggaaggaacgagttgtattctatctcagtcgtcggctcttggatgcagaaactagatattcccctgtggagaagttatgcttgtgtctgtatttttcgtgtacaaggttgaggcattatctactgtccaacgagtgtactgttatatgcaaggccgacgttgtcaagtacatgctatcggctccaatattgaaaggaagggttggaaagtggatattttccttaaccgagttgcggcgcgcccgtggggagaggccggatgggccgtggggagaggagagagagagagggggggggagagatgggccgggccagcccaagggagggaagggggactttttagggtttttctttttataaaaccttttaactttgtttatttcttaacaattattatttgtgctctgaaaattccactaaaatttatttacgtattttaggcttttaggaaatatacaaaaatcctctaagcattatttgacttttaactttgcacattttaatttttggaggctttcacacggattttaattattctaggcataatttagatgatatattttagggtcgttttgggacgtgacaaacctacccccctaaacggaatctcgaccccgagattcggaagaactggcgaagagatcgggatgggctgccttcagctcgtcttcacgctcccaagtagcttcttcctcagcgtggttgctccattggaccttgcaaaaacggattacccggttcctggtcctgcgctccatggcgtccaggattttcaccggtctctccacgtaggtcaagtcttcgcgaacttcaatttgctctgagtcggcctgctcggacggcattcgaaggcatttcttgagttgcgacacatggaacacatcatgcacgttgcccaatgatgcgggcagctccaactagtaagcgacttctccgcgttgagcaatgatacggaaaggacccatgaaccgaggtgcgagctttcctttcgtttgaaacctgtgtacgccccgcaatggcatgacccgaaggtacacaaagtcatccactgcgaattccaggtcacggcatcggttgtctgcataactcttctgccgagactgggccacctttagattctcccgaatggttctgactttcgcttcagcttctctcaggatatcagtcctgaacacttggctttccccaacttggtcccacaatagcggtgtccgacatttgcgtccatacaacgcttcgtagggtgccatttgtaggctggcttggtagctgttattgtaggagaactcggcataggggagactcttatcccaggtcttcccgaaatctagaacgcatgcgcgcagcatatcttcgaggatctggttcagacgctcggtctgcccatctgtctgcaggtgatacgcagtgctgaaatttaatcgggtacccaactcttcttggagcttcttccagaagtgagaggtgaattggcttcccctatcagatacaattttcttaggaacgccatggagactcacgatcctagcgaagtagagttcagctagtttgttccctccataggtggtcttcacaggaataaaccgggctaccttggttagtcgatccatgactacccatatagaatcatatccgccctgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgtttcatactaacccaccagtatttctcgttcaagtctaagtacatcttcgtactgccagggtggatggaataaggactttcgtgagcttcctgaagtatcagctgtttaagttccttgtcgtccggaacgcatacacgatttccgttccatagggtccatgttcatcttctgtgaaaccagcggctttaccttgtttcatattcttgaggatcccatgcatatctggatcattcttctgagcctcgcggatttgatcgagcaaggtaggcttggcttccagcatagccaaggatccacgactaactatgcttagattcagggcttccatctgttgattaagttccggtggaatgtcatggacgccaagagtgttgcaacggctttttcgacttagagcgtcggcgaccacgttggccttaccaggatgatagtaaattcccacatcataatccttgatgagttctaaccatctcctctgccgaagatttagatccgactgagtgaagatgtatttcaaactcttatgatcagtatatatttcacagcgattcccaatgagatagtgccgctagatatttagagcatgaaccacagcggctaactccaaatcatgggtagggtagttgccttcatgaggacgaagctgccgggaggcataggctaccacatgaccttcctgcatgagcacgcaccccaatccttggcgcgaagcgtcacagtacaccaggaagtccttgcgagtatccggtaagattaacactggcgaggaaaccagcttttctttgagagtttggaacgctttctcgcattgcgggctccacacaaatttttcttccttcttcagcaactgcgtcatgggtctggcaattttggagaaattctcgatgaattttcggtagtacccggccaaacccaaaaagctgtgaatttgagtgactgtcttgggttgcttccaatcagtgacggcggtcactgttttggggtccacagcaactcctttagcagatatcacatgccctaagaatttgacttcggacaaccagaactcacacttgctaagcttggcatacaattgatgttcccgcaactttcccaacacccgacggagatgttgctgatggtcttcctctgattgcgagtacaccaggatgtcgtcgatgaagaccacaacaaacttatccaagtattccatgaacactttattcattaagttcatgaagaaggcaggagcattagttagaccgaacgacatcaccgtgaattcatacagcccatatcgcgtggtgaacgcggtcttcgggatatcttcttcacgaatacgcaattggtgatatccggagcgaagatcgatttttgaaaagacagtggcacctttaagctgatcgaacagatcatcggtccggggaagagggtacttgtttttgatagtaacttcattgagagctctgtagtcaacacacatcctctttgtcttgtccttcttttccacaaaaatcacgggagcaccccagggggaagtgctcggccgtatataccccttttctttcaactcttccaactgtttcttgacttcggccagttcatttgctgccatacggtagggttgcttgtacagaggagttgttcctggagcaagatctatccggaactcaatctctcgcttgggcggcataccgggtagttcttccggaaacacatctccgaactcactgacgatgggggtttccgacagtcctatctgatgaagttccgaactgccgacagaggttgggggtgcaaagaaaactaccggttgttccggccctcggtacagagtgacagtgcgtttgcgcaatccactactccttggaattgagccaaccaattcatcccaaggatcacatccaagttcttcgtgtctagaagaatcagattcgagggaaaaggaattccctggatttctataggaacggcagggctataatactttgctgtcataacccctccaggggtggtgatgagtagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacatcctcggcagtcacgtggttcacacgaccccgaatgacatccttaccaccgttgttggggcggggaggcgcttggccttgctggcgcctcggctttgggcatttatccgcaaagtgcctgggcttgaagcagttgaaacacagacgctgctgaccttgaacgtctctgcggccttgtccaggctgcacggctggcgtaggaggacggggcgcacgggtcccttgctgactctgctgctgctgcagctgtggaacgcgcaccacgaattgagctcggggcgcggagtgaggttgctgctgctgttgctgctgcgaggaggatccccctggatagggattggtgtagcggactctttggttagccccctgttggttgcagaaatttgccaagcgatgcttgtgcgactccagtttcttgtgcttggcttccaagcggatgctcttgtccaccaaacgctggaaatccggataatccccggagaccagacgcacggacagctcagggtccatccctgccaagaacttctcttgcttctcctcatcttcacgaacatcctccggggcgtaccgggccaggttgttaaactcatgcaaatactccatcacagagcggttgccttgcttcaactcttggaattcccttttcttaagggccatgactccggcgggcacatgggtcctccggaaagcggcggtgaagcgggcccaagtaataggctgtccttctggctgcgtagcctggaagtggtcccgccatagagatgcgggcccctgcagttggtgagcggcaaagatgactttctcctcatcgttgcactgcacggtgtctaactttttccccacggcatgcaaccaatccaaagcatccacggggttattggagctagagaaggtaggcggacggatgcggaggaactcggcgagtttagagtgttgcgggggtggtggtggaggtggagcattatgctgtggcggattttggatgtggtggaggaaagcagccatcatgttggcctgctgggcgaggatttgggtgaggatggagttggtgtctggtggtggtggtggaggcgggggaggaggcggaggtgggctgccatggttgttgtggttgctaccttcgggttggttgccatcaccggtagtagcacttctcctggttgtcaccatctgaaaatcccacatagaaccggcaaacagagagagctgactattaaaactaaccacccacgactaccataattcttgaatttattactgctattaaattggttcattaaggttcaagttgcttaagcaaataaaataaagacaggctccgacacagttataccacacaccggtataaccatgccccacacgactctggcagaaaaacaaacgagaagaacacacgcgcaagcctactaactgctcgtctacttctgcgacgggccagggcggaaggtgagcagcagcgcatcctccgtgctgccaacgccggaggctccctcctcctgaggaaccacaggcgcgggctcggcacgaggggtctcgacgaagcaggtccacgccagggactgacgaacaagttcgggcctggaggtactcttgcgggcggtgatcttcaggctgcggcagacgcgacggcgcttggggcgacaaacctctccctgggcgatcttgagctgacacagctgcgcctccactgcgtctaggtccttcttcagctgcagattctcctgacgcagctccaggatcttcatgttgttctcgaccaacccacgacgcaccatatgatggaagtcgatacgagccgcgtcgtaagcctccaccatgcgcgccaggtgcatgatggtggcgtcatcctccgagctagcatcccggaaggtggcgtagtcgcgggctcctccgcgacgagggtggtagcggtagggcgagtgctgcaactcgtctaggtagcgctggtgcagagtgccaatggcgaggagagcggcgttctagcaagcggcggagaaagaatctccacccacggtgactgccaacgaagtcctctcgggtgagccagtgaggatcactgcagtgacctcccaagtagcgtggggctctgcatcatcaccctcctgctccgggagttgcttgccctggtagtccactccatgcggataccccaagacaacgcacatgccccgcagctccaaaacgaagccagtcaggtccagaccacgacggttgatgctgccggccatctacaaacaaaaaaaacaaaagagaaaagcaacaatttaaagattagattttggcgataaatgaagcagcaggacagagagagactagaggattttcacaaataagaaaggatttttatttcgaaaatattgctaaggcttgggatctaaggctcgtcctagggtcaagggggctctgataccaacttgtcacgaccggaaataacccaacgggcgttccttacgtgcgtgcattattccttgtcccaggaggcaaggtgcataggccttacactcaatgataaacaaaaagatagcggatgcctacagaagcagcaaccacagttactcgacggaggtaagagctagtagtccaagccttcttctctagagcatccatcttctgaattagatgtgagctagaattagtatcacttatagtactcaacaagcaatactagagaagtacaataatgcatagggataacaaaggaatgtcataatatggtttatttttcataaagccaaagtttaaacagttcataagttcaaagtatattttaaaacatgatcttaatctaagccataattataaagttcacgaggctgcgcttcagcacaaccaactcaagtttcaccatcttaaatccattatgattcctttatcccaaggtttttaaaaagtcaaggccaacttggagtaatattgctaggcatgcccataactgagggtgtgataagttgaatagattctaacgacaaggcatgtcctctcgccatgtcttccatgcgtcacgatcaacaggtactcagacggagtccatgtcaagaccttttatgtaattcaccacaaaacaatgaaactcccgatggtgaccctcggtggaacccactaaagcactcacacaacgcccttggtcgacaggttgggactagcaattgcgagtggatacactcaatctgtgatagacccctggtccaaagttttgagatgcactaaactgtcgatcaggccttacccatagacttgtggtcgtacggaaaggctttgcaacagatgcccgagagagccccaaaacaagtttcagttttcacaaagaaacatcgtttgtcccactcaccaactgcccagttgatggtccaacaagtaatcaagtattcggtggataccacagcaccccaattcattcaaaaattctattgctgaatctaagcatggtaagcataaacctatggtaactagtaagtccaacatatagggtacttgactagttaatttattttgcctagggttctcaaggacatggatatcaaatcaataacgctataacaaggatcataggaataatattaactaatataacaagtgaacgatgcaatttataaaagtaatgcaatagtagtaaaacaatatagttttcacaattgtaggattcaacatgcttcaagggtaagatatgacttgccttgattgctcacaacgtattcgtgatccactatgaggaagaacaaatcttttagaactgcacctatgtttgcacgacaacgcaaagtaaacaaactagggtaagaaaaaccacaaaaacagtacaataaggcacaaaaataggttcttggcattataaggaaaaattagagacttcaacggatcgattcggagttcaaatggctaagatatgaccatttgaaagttatgtgctctttaaatggatatttttgaatttgttgaattatttttcttaataaaataatgatgcttccttcagctagagggagagggagagggggtagagagagagcgagagagagagagagagagacagaggggttggggtgtgctgacaatcggacccacacattagcctccggaggacaccggtgggtgggccccatagggaatgcacatgcgggaggccggcaccagtggcatggctacggaaggttgctggcgcgcgcggcgctgttgaggacggcgagggaaaactgagaaaggatggcgggctcaccaacatgcgcaacacgacgaggggaggacaagaattgccgacgtcgagcttgaagcagtggagatggcactagtcgatggtggcggcgtagctacggcgatcttcaagcaatgtgaaggtgagaccatcgaagaagttggtgctgcggtgcagacaaaggaacaacaaggtcagggcggtgcttcggtgaggaagaaagggtagctggaggttctctggcgaggaggatggagaggctggcaaggaggcagtgatgcggtggcctcctagtgaagccgaacaatgccagggatcgagctcgtcctcatggagctgagggaggtggcggcgcggcaaagcgatgcgctaacgaggagaaacaggcggcttgatgatgcccagtttggaggagaaagaggaggagagtggggaagcgtcaatagagctcaggatgggaaaaagggaaagtggggagggagaggaatccattttgtaggccgagggggagagctatccaaggtgatgaggaaatatgtcgcgatcttccaataggtattgataaatctcgatttggtgcaaacttgacacacacgaactggcttccgatcaacacgatccgaaccatgcaatcgtaggaccacgtttcctatagttatcaaccatgcactacctggttgacctcaccgaaaaggctaattcctgcacgcaaatcgaagaacacaagcaagaacaaggtagattgcaactcgattgtatatgaatagctaaacactcgaatttggggttctacaaatagaagatgaggcaaaactgcaatagcataaataatgtaagtaaaacccaactctaaactatgatgctaatgaataaatatgatttgggatgtcctagggttgccctagggcgtacaccaccatgggttttgtccacaacacaatcacatgtccgaaggcgcaaatcatattcggactggatgaggtatatggcttgttttgcagattctcgacagctcggtaggaattttgacatgggaccaaaaccatccaaaagtggattccataagttttccaagaagcactcatgagcctcaaaattcattttatatcagcggctaggtctgtttaaagttaatgctatcaggaggcccgaatccgaatacagaacgtgcagaacttcatctcttgccttctatggaccaaaagtgatgtggtgaggtaggagtagacttgtagaaggtcttgatttggtcgccaatcaatttctttcatagtccatgcattccttacacttggtcttatttcttttacccaagcaagtacctctacaaatgaaaagatacaaaaacacatggtgtagtaatgtttgttcaaacatataataaataaatatatagaacataatcaccttttgttgattaatacataagataggcatagtcatatctgagctagttgtgtcctcatcatcttcaccttcttgattggaaaccgtcttcggtttcaccttgtcattgaacctattgaacttatctttgttatcacaacaccaggtgagttagatttctttatgtccatatggttggattctaaaatcttgatagccgacaaccacaacactcccttttttgcaaaccaatatataactcatttaaacaactagaggaactagatacagaattacttatatgcatgtggttctctagacaatacatcttatcatgaaaaggaggtatattcaatttcgaacaaatatatactcgatgcacattatattatgctttactatcataattgctaacaacatggtaaatcacatgagaaggacatggcaattcagatctagcaaataatttcacctctaaacaattgagtggacaaagattatcaaattgaatatagccccaagtatttaaagaagattgtaatttaaactcttcattctcgccagcaatgtgaataacatgtttaaactcaacacatgatggttcaacaaaataacaaacatgctcattcactagttgtgccatggatataagtgaagcatcgcacaactcttcttcatcacaagaaacatcaagcaaattgttttgtgacaaaggtatttcaacaattgttttcactatgggttgctcttatatagcataaatagtggatatatttagcacgtcattactatacataccttgagtaaatctagcaccattatcattaccttcattcttatcttcaaaaattataggcacttggttaattaaacattcttcaaacatgcatggagcctcctcaactatcaatggttaacaacggttctgggtaggtcttctttctctacgtcttttttgtttcctcattatcttggttgttctcaagtacctgcaaaatattagaatccaaagaaagaggtacaacaatgcattagtttcataataactcaggcttagttgaaagcatcgcaatattagtatcatcccagatatataatatcattgatttgattatgtattaacaatatcattatgcaaaacattttatcgtatatccatggttgaccaaacaatagagaacttgcttgcataggcacaagatcaaaatttgcagtattatggtaacttccattcgaaaattttattttcacaattctacataacttggacttacgaaaagaattgaacaattggatgtaatatcgatgaggatgcggttttataggcaacccaaggttctcaactaaatctgaactcacaaggttgttgcaacttccaccactatcgaatataacacgacatgatctatgcttaaccatgaaccttgctagaaataaattgtggcactgtttttgcttcgctttctttatttgaaaacatggcactggttgcactaaagtacttatattttttatgtaacaaagtacttacattatctgcacttatggaagatgatgtagcaactatggtttgtgtctcatctaactttatctcatgcccacgagtggtgtaatctgccattgtgagtagaaaacaaaaaacaacaaaaaaaaagtattatctctattaactacggaacaagggttgtagtggaggctagaaattggaagcatcttaccaagcttttacaagtgtcttacaagcaatgataatgacgatagaaccgatggttggttcatgaacaaaacaattcatattcaactttatttcacaatccattattacttacctaactaattatatgtttggatactatatacttgacattaaaatctaacaaaaagatgtcaaaaattcagttcaaacttgtttgaactaattacaaagtagtaaaaaagttaatgttcatacctaaacattttaaaaaaattcatactcatttgaattaggtatatactcaatttaaatctttatacccgccaccatggaaccctagttaaatggcacataataataataatatatatataggacactcatatggggcaccataccatggtgcctgtgcaccatggtatgaaatatacaaattcgtccaaatttttcaaaattttcaaattgtgagtatatatctaattataagtattcgattcatacctatatctatcaacaaaacaactcaagcttaactttatttcacaatctatgattacgtacctaactaattatatgtttggatgctatatacctagaatcaaaatctaacaaaaacaagttcaaattcagttcaaacttgcttggaactagttagtaaagtagttaatgttaatacctaaatatttgaaaaagtttcatactcattcgaattggatatatactcaatttcaaccagggtggtcgggcaccatggagcaccaaacaaatttattatatgtgtgtgtgtgtatgtgtgtgtgtatatatgtgtgtgttggaggcataccacgaagggccttcggccggaccagccgaaaccaaggattcaagcgacaagcccagaccggacgtaagcggcgaagaccgagaagggaaccatgtgggcgagagtctcatggcgaaggccatggctcggacacccggacatcaccagacaaggacttcgctagaaggcagtgcgggcgagacgaaatctctggcaggagggcctaggcttcactaggtgccgaacctcaccgaaaagtggcccaactgtcatgtcctgataaattcatcccgaattaaaaatcattctctaaaaggaataatagaattaattaaaattcgaaaagaaattggcaaacactaaaatgcgtacaagaaaaattcgaatgtggcccggagaatttttgttaaattctccttggtttaaaaggagccctcaaattttacttgaattttcagagcaccggaaataattattaagcaacaaaaacaattatcaaagtttagtaaaaagaaaaacctaaaaataaccttccttcctcctttgggccaagtttggcccaaagtccactctctctctctctcggcccgcggccgaagtccctctctcctccctctttttctctccctctccctccccctcccctctctctcccgggccgttcctccctcccctcccggcctgcccggtcccgggccgccctgccccctcccgcctgggccgtgtcccggcccagccgagcctccccaagccgcgccgcacgcgcctgtcacgcgcacgccgcgcgtgcgctgaccgcgcgcctgaccggtgggtcccacgcgccgggtcatcgtcctcctcccgcccggccgtcctctctccctctcccgtgaaccctagcgccattcctccctcaaatccgcgcgattcaagcatgggattcccaaattgattagggggaattaatcccctttccctcctctctctttcccccttaattcccccttgaatggtgccccaatcgccgggaacggacgcgccaagtccggccgctttccatggccgtcggccgtcattcccgtcgccgttccgccctctcccgtgcccggctccctcccccaccctataaaatagaaccccctctttgcgttctaccgttttagtctcctcccgagctctcccgtggtccctagccacctccccgccgtcgtcccctctctcccgtgccgccggccgtcttcagccgcccctgccgccgcgtcagcacgtcggccggccgtgccgtcgcctcctccagcatcgcggccgcctcctcttccccggcttgccctccgtttcccgcggagacccccggagctgcgttcccgccgtcgcccttccctttcctccgcgccggccgcctccaggcgcctctgtctccctgcctgagcgccggttgacgtcgccaccacctcccttggctccgcgacgccgccctcatccccggcatcacctcctcctcgcacgaatttcgccggaacaccgtcgcccgcgccggcctctccttcctcctcgtcgacgtctcctccggcagccccttccgccgcgcccgtgcatcagccggcgctgccgtcccctccctcggcgtcgccgcatcgccctccaccccggctgctcctcggtttcgccggaacgccgtcgcagcgccggcctctccatcctcttcgtcgccagcgtcctttcggccgccccttcctcctccccggctcgtcggcttgctgcacctctaccatcttcggcatcgcagccgcgacgtcgtcctcggcctcgcctcccctccgaccgaacaccgccggtgtccgtcgtcgtcttcaccgttcatcctcgccggctcgccgtctggcggcgccgcctccgtcgtcggcatcgcagcggtgtgttccacgccatcctcgcctccgtgcagccgctgccggctgccctcgtcgtctcctcgccggccccggtcgtcgtcgtcgtcgtcctctcgtcgttcccggtcgttgtggcgttcgtccctccgtcaagccgttctcgtccgccgcccgcgtttcgtcaagtgtgcaacagccccgtcgtcatcttcgtcctcgcctccgcgtcgtcaagcctcgtgccggctgtgtctcgccttcgtcccaggatcgccgccgaagtcgttccctcgccgtccgccgcgcccgttcgtcgttgtcgttcccacgcctcgtcgcgtggtggtaaggatccgtcctctcgctgccccgtcctcgtccttttggtgtcgccccgtacccgttgtgcggtcgtcgaccccggtacccgtgtaccggtgtcggtagtcgttcacgtgtgcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgtcgacctgtggaccgtctctgtgtacctggtctaccgcggtcctttaggttgacatgtggggtccgcatgtcaacagcgcagccttcctgtcttttctaggctagcgcttccacatgttttattgttgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagtcttcgtcgttccggaggttcccgaagcgtggttttcggtcgtcgccgaaggttcggaaggccgttctctctgagcaaggcaagtcacatcatccttgagcatattgaatcccagtttataaaattattttaatttaaattaatgcattatcgctttatttaaattcccgcgttatcactgttttatttagccatgcctatttacctttgttatggccttattattattgctattgttattattaccttgttcaccctaggataaacaaaccccccccccccaactagtgggtactctatttatggttccactagtgtgaacttaggtagatgcttcgctggttaattaggcaacattaggtggttttataactttagacattgggaaatctcatatcatttggacattatggaattgttggattatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttttggctcagtctagttataaacaaaagtacacggatggaggtggatgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaataactaaaatgtggaatggttggcctgggttggcttgggacgagctgggacccagggtcgggttgccagttcggtctgaatcatcgtaggccttgggttaaggcaggttcgtgagggttcacggccttgattaataattttgtgtagctctaggatcgtctttataaaatggctttgggcaactaagtgacttttaaatgctgtttactgcaaaacttaacccctatattattatccccttgtacccccttgcattaatcacgcatctgccagtgtgacttgctgagtactgtggttgtactcattcttgctcaatctttcccccccccccttcagtaagagaagctttggagaagaagtcttaggtggagtcctggcttataccccagttgagcgcctgtgaagatggagccgtaggcccgctagtccgctactgtttatttttgattgccaggcctgaagcgcctctgtaataatgtaaatactatcgatataataaagatgtgtcttttatatcatgtttgtgtggtgtaccccgacttttcctgggacggggattaatacactagcgttcgggaaaacgtatttttctcggtcgtgacaagctggtatcagagccatctcgactgtaggataagccaagtggataaaacctaaggacatattttataaataaaactatttgcgaaagttcctctttttcttcttcccctagtgctatttgcaaaaggtttacccttttcttccttcttcaaatttcaactagtactagatggtcaggtcagtgaagaagaagacatcgtcagttgttcgccgaagctccggaagactgcaggatccgctagcgaagtggaggaagcagtgaagccagctgtgaaggagtgaagatcttggagaacccgtcgcagaacctaagccaccctatagggtagtgttgttagtcgtgtgttccttgcttgtgtgtgtagcgcgtggtttgcatcggtgggttgtgatgtaaccatgctaggttgtttgcttaatcaacttgcagaataagtgaaacaaacaacacatcaacaagaagagttagttcctttaaggtcttgtccctagttctggtccattctttccttgtctgcttcccctctcaacctctaccttgtgacagatggataacactggtaacaaaggctatgggaatgatggatccgatgactcaagaacccaagccagtgggaatgagaaaagcatcaacaaaacctcaccagagctaatccaaattgtggttaaccaaaccaacatgttggcaacagcctttcaactattacagtattggaacaacccagcaggggcaaccaacgttcaagtacctacagtccagcaacagtgcaagttatcagaatttctcaaaactgagcctccaacctttgccattgccgtcgatcctatggaagccagtgattggttgcgcacagtcgagaagaagctagggttgattcagtgcaccgaccaggagcgggttggcttcacaactcatcagttggttggaccggcttcagagtggtgggatagctacgaagcatcacggccagaaggacataccatcacctggaacgagttttcatctgtattcaagagatcacatgttcccgcaagaatgatcacactaagaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactactcctagaggattatgaagattttgagaaacttgtggacaaagccatgcaactcgaaagtgagcataatcggatgacgaactgcaagagaagattgtcacatnccagnttttcatgtggtaaccaaagacgcgcactgagccacttcagatcaccggatcttctgttgcgcatcaagagttactaccccaagaagatggacacaacgcagacaacaacattagcaatactaatgctgatgataccaccaacaaccatggttcttgccccattcatgaccacttagatcaagcgtgcaatgtcaacagcattcaccaagatatcgacgatagtatcaatgaaggcacccagaatgacaaccctagcaattttgactctgagaaagactccaatggtgatagcaactatggtaccactgatgccaatgttagcaaggatttccaaccaccaattccaactccaagtcagaatgatcgttcccagacggacaactcagtaaagaagacattgatttgttacaactgcaaagaaccaggtcatttctccaaagattgtccacagccgaagcgtaacctgcgtcatcactccggccattatgcaagaagaagacaagtcactcgccttgtggtcactggagcaaacgccatacctgtgaggcctcgagttaatcataacccatagtagaaacaatgtaccgatgttaagcatcttccctttttgtttaaggtagtgccttgtattcgtgtaataagggagaaatgtgtaatacggacaagatttatgaggattcttttggaagatgctgatatgggattatgtgtataattggttactgtcaaaggagacctagggtctcatttcagaggaactatgttctaacctcgagttaatacccaacctgatgatggaaaagaaaatcaagtgattaaccaaagagacatttgtttggactaagtgtttcagatgtgtcttctttggatcaaaggcaacaaccgtcagtctagcttttgatgaaccacttcaaggtttcactgaaaggcagcaagccaaaggacctcattgtcaccagaagcatccacaactctcggagtgaagagtacttggttgacaaagtttaaaaggtgattgatagaagatatcagcaaaggtgtttattatcgggcaaagaagtaggtcgaaaggtgattgataagagaaatctaaaaaaaagaatacgtcagggttgaatgtgtaaaggcatactttgaatgctaaataataacaacatgaagagaatagtggaaagtgaatccgagttgcttgttcgtgagagctattcccagttatgaaccaagtgatatgttcgaagatagtttacagaggtcagattaaaatcacatgtaacagcgaagcttcagatttggcaggataacgatcagatcataacaagtccagcagtaaagtcatttggggagacgtcaaagcatgtcaagtgggataagttggttctttttagaaacataattcaaaggcaaagttaccgacccttgcatcgaatagcagaagtagctggcacccggagagcaggaaagctaatatgaggcagttggtgacaagttagaagtaaatgacaagcatggtaccctggtaatgacgagctgatctcgacacatgacatgaagtgggtaacttgtatgaggttgactccaaagatttgaactatgcgaagttctggaactgaagccccatcctcaagtgccgcaacccagtcgaagtcagctaaaggttcaaccagggacaagtcaggtgaagagaagattccatctgcaacaagggatcgagacaagcagcctagagtggagaagtttttctaggcaagtttgttataaaagacgcgacggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaattcggaaagaaattggcaaacactaaaatgcgtacaagaaaaattcgaatgtggcccggagaatttttgttaaatctccttggtttaaaaggagccctcaaatttaacttgaattttcagagcaccggaaataattattaagcaacaaaaaccaattatcaaagtttagtaaaaagaaaaacctaaaaataaccttccttcctcctttgggccaagtttggcccaaagtccactctctctctctctcggcccgcggccgaagtccctctctcctccctctttttctctccctctccctccccctcccctctctctcccgggccgttcctccctcccctcccagcctgcccggtcccgggccgccctgccccctcccgcatgggccgtgtcccggcccagccgagcctccccaagccgcgccgcacgcgcctgtcacgcgcacgccgcgcgtgcgctgaccgcgcccctgaccggtgggtcccacgcgtcgggtcatcgtcctcctcccgcccggccgtcctctctccctctcccgtgaaccctagcgccattcctccctcaaatccgcgcaaatcaaaccatggattccaaaattaattggggggttttaaatcccattgattcctcttcaatttcccccttggatcgtgcccccaatcgccgggaacgcccgcgttttctccggccgctttccatggccgccggccgccattcccgtcgccgttccgccctctcccgtgctcggctcgcttccctccgctataaaatgcaaccccctcgctccgttctatcgttttagccccctcccgcgatctcccgtggtccctagccctctccccgctgtcctcctctctctcccgtgccgccggccgcctccagccgcctctccctcctcgccagagcgccgtccggtcgcgccgtcgcctcctccagcatcgcagtggcctccccttccccggcttgccctccgtttcccgcggagacccccggagctgcgttcccgccgtcgccgttccctttcctccgcgccggccgcctccagccgcctctgtctccctgcctgagcgccggttgacgtcgccaccacctccctcggctccgcgacgccgccctcatccccggcatcacctcctcctcgcccgaatttcgccggaacaccgtcgcccgcgccggcctctccttcctcctcgtcgacgtctcctccggcagccccttccgccgcgcccgtgcatcagccggcgctgccgtcccctccctcggcgtcgccgcatcgccctccaccccggctgctcctcggtttcgccagaacgccgtcgcagcgccggcctctccatcctcttcgtcgccagcgtcctttcggccgccccttcctcctccccggctcgtcggcttgctgcaccttatcctcgtgaactaaatgagagtgcgaatacaaggaggtattttgtgtttgggaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaatccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccttcgattctaaaattcaaattcttctacattgaatgtatagctgcagcaataaatttggatcagcctttctactccctgcatctacgttgagcaggtatctttaggtaaccgcacaatacctaacctaatttattgataagagtgcttattataaatcaattcttgcaatttttttcaaaaattgatttttgcatttttaggtgtcaaaataaacaaaacccatcctagtggatttgtgtggtaaggaaaaacgggtaatctattccttaaaaaaaaatcttggagattatgtaatgcttactctcaaactttttgtttatacagtagtgatattctttgtttccctctttatctttggattcttatctaatgatccaggacgtaatcctgggcgtgacgagtaaaaatccaaaattttttcttacaaattggatttgtttcatacatttatctacgagaaaatctgggggtcagaattccttccaactcgaaagtcccaaacgatccgagggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcagaatcctatttttgttcttatacccatgcaatagagagcgagtgggaaaagagaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaaatcgtccacagataatctatcgtatgccttggaagtgatataaggtgctcggaaatggttgaagtaattgaataggaggatcactatgactatagcccttggtagagttactaaagaagaaaatgatttatttgatattatggacgactggttacgaagggaccgttttgtttttgtaggatggtctggcctattgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctattcaatttcggccttataatgcaatttcattctctggcccaatcgct

SEQ ID NO: 38028 - DNA, 2264 bp, Oryza sativa
  unsure (1)..(2264): unsure at all n locations
ttaggcgcggctctgctatgcgctattcttggggcaaccgtggaaaacactctatttgaggacggtgatggtgcaaataccttccgtgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcatttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaaacaaataaagaaacaaacgtattcaatacgcaaaagaaaagagagaggaaagcaaaaggagagagagggattcgaaccctcgatagttcctagaactatannnnnnnnnnnnnnnnnnnnnnnnnnnnnnnnnnnnntctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaa

SEQ ID NO: 38029 - DNA, 1415 bp, Oryza sativa
tctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgtgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatcaccttgccaaggagaagatacgggttcgattcccgccgctcgccagcttaatttagtaaggtactatgataaaaaatttagtctacttttattaaagtaataggtgttagtctagtaccatacccctttactatcttaaccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggagggggccttgagagttcctcttgtggtagcaagttacttcgcaacctgctcaatttggccttatagggtcgggaactaatgaataaaaagggttggataccgcccaaccacccagccctctaccatatctagacaaatagaatagtccttttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaa

SEQ ID NO: 38030 - DNA, 13708 bp, Oryza sativa
tacttcgatcgcgggcctttcctttactttcttttttgttcagaattgaacaaagaatttggggaagaaaacatcttcccccacttatcatgaaatctgggccatagagaaagagtgagatgtttttttttatttatcatagactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagagcatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaagccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctagttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctcttttattcctctcttacaaacaaaagaccttttcttattggttattgaaaggtggattattatctatttttagcgataataaatcgcgacatactagttatgtcattctcactatacccccatacgatacgggggtatgtagtatatgattggtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccttatttcactttttttagttcgcgtttctcagtaaagagaggagagtataggaatttttttatcactacttctggttgatagcgaaagacatacatatcatacgtggaagggatcctcctatgttatactattccactctcaaccatgaattgatttgatagatccgatattcataatattgaattgattcagtattatcagaatgcaagtcctccccttgaatttacaggatacccttttccctctccatgggattacatcccgagttattgcgaaaaaaaagaggttatggaagtcaatattctcgcatttattgctactgcattgttcattctagttcctactgcctttttacttattatttatgtaaaaacagtcagccaaaatgattaattggaagttcaattaatcattgaagaaatgaaaaagggattaaataaaataaaaatccaagtcttaaatgaaaggatccggttggaatcataaagtgtggtagaaaaaactacatatagttttttctaccacacttagagtctttctattatattatcttgaatctacatagaatagaatatcttttttcactgcatccacttaatttcaatcaagtcaaaatgaaaaaatccatggagggagagaaaaataatatgagaatagactatagtaaaagaaaaaaagtaaaaggaaaaaaccagcgaatctttcatgcttaaacatgtcgcgaaatgtttcaaaagtgcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtgctataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttgaatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattatgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtaaaaagaaaaagctattttggagttttatcaacaatttgtttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgtggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctatttatgcgagaattgatcattggtggggatccgtagagagtccattttatgaaatatctgagaaagcaaagaaaaaaaaagagagacaggtggtttatttatcaccaaatagagatgagtattatatgatagcagcaggaaattctttgtccttgaaccggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggtttgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctattgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacaaggatcctccagaatcttttcgagtgcttgttcgagaactacgatctttggctctagaactgaaccatttccttgtatctcagaagaacttccaggttaatagggaagaagtttgatcggaataaatataaattctttttttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcacgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccagaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcgggccgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagaatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacacgtagacttgttgaagtagttcaacatattattgtgcgtagaagtgataagtacttgggcatgaatttggaaacctcctatttgccaatagaagtgttggcctacttctacgcccgatatatcgtataaccccttgagtgttttaatggaacacggtataatattcatattgtcccctgataaaaaatgaacttcaaaaaaagaattcttttgattcaaccatctttttctcaactcagcaacgtgaagtattaatcttatatttaggatatcaagaaatcacatcagatgataatatatatcaataccctctaatatatatcaatattccccgtcctttttctatgcaaaacaaaaaagaatagtaagtgattccataaatctacgcagttgcccaagaattaactattcttcttaatcaatgatttcttatatagagagaacggccctcacaaattgcaaatactaatttgttaagaatcaatcgaattgaagtcatagtgtcatcgttggctggaatcgatatattcgcgagatctgggtcacaatttgtatcggctaaagaaatagtaggaatccccaaaatggcacattcccgaagagctatatactctttttgctgatcgaggacgatcacaatgtcaggcaacctcgtcatatatttgatcccgccgagatatctttgcaaggtagataattttctcttcaagattgccacatctctttttgggagatggtggaatttttccatcttttcttctgctcttaagtctctaaattgagaaagtctagttttagtaatcgaccaattcgttaacataccactgaaccactttttattaacataatgacaacgagcccttattgcagctgatgctactaaatccgctgctctttttttggtaccaacaattaagaagctttttccctgacttgctgcatcaaaaactaaatcacaagcttctgataaaaaacgggtggttctagcgagatttgtaatatgagtacctttacgctttgccgagatgtaaggggccattttaggattccatttcttaataccatgaccaaaatgaactcccgcttctatcatctctttcaaattgatgttccaatatcttcttgtcattttttccacacttccttttgattttttcttttttttcatcctacctttccattacgaaatttctttcttttcgaagattaagaaagagccgaaatagcttgaaataaataataattgttccgatggaaccttctacatggtataagcataaccttaatgaattaactaaacttctttttaaattaaaataaaaatagaaaatctaacctcttagcgttctaaggtaaaaaatctagtttaaagtaaaaaatctgctttatgtatccttaaatcatataaatggggtaaatggtgattctgatgtctcatagaaattgtttgttacgtcagaatcagaagaaactaattctgtatggagaaacaaaatatctctcatttccgacgcaaatagttttttttttgaatttcgaaataaaggttcttgtcttgtgggtaacggtgcacaaatttttggaatccggtaccaacaggtataatcccccccagaactacgttttctttcaggcctttcaaccaatcaatacgacctcgtaaggcagcttttgctaaaactcgatcagtttcttgaaaacttgcttcagatatgaaactttgggtattcagggaaacccttgttattcccaataagattgcccgataatagatcgattcatccaaagcccgccctgctcgctctgctcgcaatagtccaattaattccccaggtgaaaaaacattagacattccatcttcggaaacccgcacttttgatgttacttggcgtataataatctctatatgtctattatggatctgtaccccttgggatcgataaaccttttggatcttattaaccaaagaggtacgactttgggctatggttaactcagctccaatcaagaatccccaaggacccccaagaattcttggtatacgctcattccaatcctcaattctcctttcgagattcggcgataatgaatcaattgaacgcgcttcgaagatttgttctacttttggaagaccttgcgttatgtcactagatctcgctttttcgtatataaacgtaactaacctatcccctttgtaaaggatttctccataatgaccatgaacagttgctcctgtagtggccaaataaggcttagctgctcttata

SEQ ID NO: 38031 - DNA, 814 bp, Oryza sativa
ccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataatccaacaattccataatgtccaaatgatatgagatttcccaaagtctaaagttataaaaccacctaatgttgcctaattaaccagcgaagcatctacctaagttcacactagtggaaccataaatagagtacccactagttggggttttattttcctagggtgaacaaggtaataataacaatagcaataataatgtcttaacaatgataaataggcatggctaaataaaacagtgataacgcgggaatttaaataaagcagtaatgcattaatttaaatcaaaataattttataaactgggattcaatatgctcaaggatgatgtgacttgccttgctcagagagaacggccttccgaacctttggcgacgaccgcgaaccacacttcgggaacctccggaacgacgaaagctacgcgaagcacacaagcaaagctacaagcctataaagaagcaataacaacacataaaaagaaagcaaacagttctttaggttataacaaacattaggagacttgaacgggtcgattcagagttcgtatgaccaagatatgttcatccgaagtttaatgcggttatatggagatttgcggattattataattaagctttgcaactataaaacatgtggaagcgct

SEQ ID NO: 38032 - DNA, 1716 bp, Oryza sativa
tagtaaattatttatggtttagccttacattctggtaggccggtgtgtatgagttcatataattcagaggagcttcctatttacctcgaagtggtagtttaggtgacctagcgtgtccaatacaacggtattgtgccacgtggtgggttcccgttgtatccgccaccacggcgttaagtttaaggcgtgggcccgccacttaacggttttaggtcatataacatgtatggcttaggatggagtaacacgtatcgtgctggtgtaaggttaaatcatgaattttgaaaaagctttattgcgggtaataaatcgggtacttatgtatcgcgtgccatgctcttgcatgattattattttgcatcatgtgggtaaagtgtacaaactatgcagagtaaaaactaatcgattagccgtgctcacggacaagagcgacgtgtggatatgtattgagtatagacttgtgtttattcttcttaatgctaaaatttaccttcaaattgtgatgagatttgagaatgatctccttgctgccatggaaggcaatgaggtgcatatttatacatgattaatgcctaccttgatgcccaatatgtcaagtactagcttgctgaaatttatttgaaagtaaacctgatttagaaatgttttatgcaaataaaacttgctttatgctaaaaagaaccatattatgccttccttgattatatgccttgcaagtagggtgttaggcttgtcttgatgcttgccagtacattatttctaataatgtactaactcttgctattgaattaatcttttgcttgcaggttttagacttagtctttgagtgatgcgggtaatcgactgcttcttctaggacttgaatttaatggggtaaatccctagtcggtgtgcttgtggattgggtagacaagcttccgctgttctatatatttatttggccagtcggccaatgtaactaaagtagatgtagtttataatcgctttcatcttatttgtgtttgctatgtataatcatgcttgagatgaaagtgtgaatctagtgcacatcctgggaactagattcacatgagtatgagttaagaatatttgagatgttgtagatctttagccatttttgtcaagtctcatgaatgtgtaacacatctggtcaccgccttcgagtggtttgacgggcacatctcaggctaaagttgactggcaggctaaaggcctagcaatgtctccaatattcttctctcgaggcgtcggatgtttcattatgtttgtttgatgacttgaattattcacttcatccctcaaatataatggaagctccggaaagcctacgacaaattcgggcgacgccgtggcctggccggggaagaggacagcattccggtgccgggagaggtggtggcgacgtcggccgacgcacaggagatgcggcagaggcggccggaggcggaacagtggcagcaacgccactgttgccggtggggatgcacttccggaggtctccgcgggaaatggacggcatgccggggaaggggaggtgactgcgacgccgggggaggcgacggcacggccggccggttagctgacgcggcggcaggggcggctggagtcggccgacgctggggagagagaaggaggtggctagagactcgggagggaccaaaacggatcgaggggaggtggaggacttcgttttatagggcaaggagggagtgctgg

SEQ ID NO: 38033 - DNA, 20070 bp, Oryza sativa
agaaaatgatttttatttcggcatgaatttatcatgggcgtgacattgatgctgatgattggattcgcaccatcgagcggaagctcactctcattcactgccccgacgccgagaagaccaacctggcagccgagcaactccaaggcgcagcaggtgattggtgggagaactttctcgccatgcaacccgccggccgtgtcgtcacttgggctcaatttcgggatgcttttcatgctgcccatgtgccgaagggtattatggacctcaaacaacgtgagttcctatctctcactcaaggcaacaagtccgtcatggagtatctccgcgagttcaaccacttaactcgctatgctccggatgatgtcaataccgacacctgcaagcaaaattggtttatgaatgggttgtcggcggagatgcaactcgagctcgttgcacactcttttctggactttcaggaccttgtcaacaggtccgtggtcattgaaagcaagatgaagaaccttgaagctgagtgcaagcgcaagagggctgcgcagatttcagccgcgggtggttcgcaaaaaccccatggttggcagccgccccctccgcgttttcaagcaccaccacctcctcgtccacaaggattcgtgccatgccctcctcagcagcgtgtcgcgcctcctgtgggcggaaatcagcaagctattcgcccacctgttcgctccaacaactgcttcaattgcgggcaagcgggccactacatcaaccaatgctcgtaccctcatcatgcacaactccaaggaccaagaccagcagcaccatgtcctaatccacctctcaggtcagcacctcagggtcagcaaactcagaagaggggtagagtgaaccatgtcacagccgaggaggcgaacgatgcattggatgttcttgtcggtacgctacttgtccattcatacccagctagtgtgttgtttgattctggagctacacattcttttgtcaccaaaggttttgcatcagaccataaaatcccaattagtatgttgcacccacctttaattgttacatcacccggttcagaaatgagagctgaatttattagtcgggacacaaagatagctatacaaggggtagaatttaccgctgaccttatcatcctccatacaaagggtttaggtgttatcctaggcatggattggctgcacaaaaatcatgggttatcgactgtggccatcgtctcattacactcaaaaataataccggcgaaccgatctttcttgcacttgatgatcattccccacaactccatgctctttcgggcgccaaaaccattgatatagctgctgtaccagtggtgtgtgattaccccgatgtcttcccagaggaattaccaggaatgccgccggatcgggatgttgaatttgtgatagatttgctgcccggaacagctccaatctctaaaagaccgtaccgtatgcctccaaatgagctagaagaattgaaaaagcaactcacggagctgcaagcaaaaggtttcattaagccaagctcctcaccttggggatgtccggctctctttgtaaaaaaggaccttagcttgcggatgtgtgttgattaccgtccgttgaatgaagtcgctgtcaagaacaagtacccattgccccgaattgatgatctctttgaccaactgacaggtgctcatgtgttctccaaaattgatttaaggttgggttaccatcaaatcaaaatcagaccagaagatataccaaaaatagccttctctacccgttttggtctatatgagtacaccgtcatgtcctttggtttgaccaatgcaccggcaaacttcatgagcttgattaattcggttttcatggagtatcttgatcagtttgtggtcatttttattgatgacatcctcatctactccaaatttgaagaagaacatgaaaagaacctctatcttgtattggaaaaattacgtgagcaccgcctatatgccaaatttagcaaatgtgagttttggttgaaagaagttggatttcttggtcatgttttatctgaaggtggagttgctgtagatccaagtaatgttcaaaaggtattagattggggacaacccaaaaatccatccgacatccggagttttcttggtctagctggctactaccgtcggtttattgagaatttctccaaaattgctaagcctatgacccaattattgaagaagaatgagaagtatgtatggtcagctgagtgtgagcaaagttttcaaaccttgaaagaaaagttaaccactgctcccgttcttatcctacccgatatacacaaaagcttcgatatctattgcgatgcctctcgtcaaggactcggttgtgttcttatgcaagaaggccgagttgtggcatatgcatctcgtcaattgagacctcatgaagtgaactatccaacccatgaccttgaattagcctctgttgttcatgcactaaaaatatggcggcactatcttatcggtaaccgttgtgaaatctacaccgaccacaagagtttgaaatatatcttatcccaatcagatctgaacctaaggcaaagaaggtggttagaactcatcaaagactatgacatgggtttacattatcacccgaggaaggctaatgttgttgctgatgcgttgagccgaaaaccgcaatgcaattgcttgtcggtaaaaccccgatcggagaccttatgttcagaaattcataaacttggtttagaaatggtaccacatggttcccttgctgccctagaagtgaaacctactttatatgatcagatcaaagaggcccaaaaagatgacaaaggtatggctcgaatccgagctaaaatggttttaccaagattcggatggtgttttatggttcgggaagcgcttggttgtgcctaaccatcgcaaactgaaacaactaatccttagtgaagcccacaactctcctttctcaatccatcgaggtagtactaagatgtaccaagacctaaagcaaaaattatggtggacccatatgaagcgggaagttgcacggtatgttgccgagtgcgacacttgccgaagggtgaaagccgaacatctaagaccagcgggcactctccaaccactcccaattcccatatggaagtgggaagacattggaatggattttatcaccggtctacccacctcctagaaaggcaacgactgcatttgggtaattgtcgaccgactcacaaaatcgactcattttctacccattcattccacatcaaaagttagtaatttggcggagttgtatctcgctcgcattgtatgccttcatggagtgccaacaaaaattatatcggatcgtggaccacaattcacctctcatttttggaagtgtctccacaaagctatgggaaccaaactctcttttagcaccgcataccacccacaaaccggaggccaaactgaaagagtaaatcaaatattggaagatatgttgagggcttgtgtcctcgattatggaataaagtgggaaaaatgcctcccgtatgccgaattctcctacaacaatagctaccaagctagatttcaaatgtctccttttgaagccttgtatggaagaagatgtaggacacctctcaactggtccgagtccggggagaggccattctttggtccagacttagtcaaggaagccgacgaacaagtacggttaattcgggagcgcttgcaaaccgctcaatctagggaaaagagctatgccgaccgtcgtcgacgtgagcttaccttcgatgttggtgactatgtgtacctcaaagtcactccattcaagtccacacaccggtttggagtgaaaggaaaattggcacctcaatccttggcgcgaagcgtcacagtacaccaggaagtccttgcgagtatccggtaagattgacactggtgaggaaaccagcttttctttgagagtttggaacgctttctcgcattgcgggctccacacaaatttttcttccttcttcagtgattggaagcaacccaagacagtcactcaaattcgcagctttttgggtttggccgggtactaccgaagattcatcgagaatttctccaaaattgccagacccatgacgcagttgctttataaaacctttttaactttgtttatttcttaacaattattatttgtgctctgaaaattccactaaaatttatttacgtattttaggcttttaggaaatatacaaaaatcctctaagcatcatttgacttttaactttgcacattttaattgttggaggctttcacatggattttaattattctaggcataatttagaggatatattttagggtcgttttgggacgtgacattgtaacgccccgattttcgattgggattaaaaatcattaaataatgtattttctagaaattaaataaaagttaaatcaatttaatcaagtgaaataataggagaattaaaattttcccttaaaaatcattggccgagaatattttgtaatattctttgtgccctaaaatactctctgaaatttcccacgaattttcggagcccaagaagtaacattatcaatacaaagttcatttaatcaattaaaataaaaagaaaaccaatttaaattcctcttctttcccttgggccggtttcggcccaagtctgctttgcctccccgcggcctgggcgccctccctctctctaaggccggccgccccctcccttctcccctccggcctctggcccagctcgcctccctctcgaagtctattttgcctcccccaaccgacctcctctctctccctctggccgacaggtgggacccgagaccccacctgtcaactcttcctactacctccagccaaccgccatggctgccgttgccgcccacgattgccgccgaatccgcccacctcctccactccgcacgcccgcacccggccgtgggactctgccgccccacgtcctcctcatttccccacctctcccgcaaaatccggctgccacttccccacgtctccaccacctccatccatcggccattgccgcccaaatccaactcaccccggctccatctcaccctcccgagcctatataaaccctccccgtgctcccctcattcgttttccctcctccccagagctttccatcgcctccctcgctctctccgcgtcgctcccgctcgccggcgaccctccagtcgcccgccaccgccgctaaagccacggccgcatgccgccgttggtcccaccggcttcgccacgctatgccgcacctcggcatccacttcattttcctcctccaccgccggaacaaccttcccaccgcgaggccaagccactaccgccactcaccgcctcaagctgcccgctactgccgccctagggacccaaagcactgctccactccatctccctcctccacccctgaagcactgctcccaccgtgaacccgagacgccactgccattagccacctccagctgccgcttgccgccgctccgagccatccccggccatcgcaccttcctcgatcagcttcgcagcgatgaggggaggtccggcgttcgcttctcgtcgtcgggaacccaccggagctccgtcctcctcacgcgccggtaagctccacctctcacctcctcctccggccggcgattcacgccgtctcgggccacctttccccatcctaacctctctaccaccctccctaggtcatcccgcgcctcggccgtccttttcgcaccgccggtcgtcgcccgaggtcgcccccgccgtctcccctagaaggcgtcgccgccgcccgttgcccctcaccgccatggcgctcgatgagctctccctccgtctcccctcctttttcccctcctccgctgcccccttgcccgcgtcgcgctaccgtcgccggaggtcgtccagcgtgtgccgccgccgccttgttgggttggccggcgagccagcctccccttttgtcgatgtgggtcgcgcccgtggaccacacccatggtctcggtccacggtgccgccccggccgcggtggaccgtgtccaccgtgcgccctcccgtagtcccgctgacatgtggggcccgcctgtcggcgcccttccccttgctgacgtcagcgcttatcatttcctttggaaaaatatttaataattgctcaataaattggtattaattatagaaattcattaaaatggctcaaaacttctaaaattcatatctaattcattcgaactccgaattgggccattcaacttgcaaaattcatctaaaattgagctctacatgtttgtttactttttatgtactctttgcttggtgtttattagagttttttttctcgttttgtgtgccagcgagtagattctgttgtttcagaagttcgcagtcacaaggatcagagttcagaagattgttgtgaagaagcaaggcaagtcacacattccccttgagcatgttgatcccaatttataaattttttatcgtttgcaaataaacatgcatgttttgctaattacatgggatcatggttttacctatctgcttggttgtgccatgtttacttgatatctgtcctttgtcaacattgggtaataaatcaactagctcatgttacttatgtgacatagctagaactatatgcttagccatgcttaattaccactagctcagttgatgggatgattgcagtattagacctttttagcaatagaacgagctgcgtgctcgagacacctggccatgtttcagtggtcgtaattatacaactaaaatgcgactgaatagtgggctgtgggtgcatggttttgctagtcgcaccctggaagaatttctcgtacttaccacaagccagcgtgggcaacgactgggcctgtagtgtagctttcctctagctgacgcatccaggcaagggtgggcatgatggagcggggcgggccctgcgacggcctctatcgcttccggattcacctaggcatgacaggggactgcccgttgcccgctggggacgggggtcaaacctgaggtgtggtgtgcttggctagagggggttatgcgaagggtcctgtcacggcctctttccggtatgtcgtggtggcatgtcggcgcatggaaacgtgtgatgtggctgtgtcttgtggttacagttgtacacctctgatcagagtaaaactattcgaatagtcgtgcccgcggttatgggcggtcgaccagattcaccgtgattagtctcacacttaataaatcgacgcaatgcactgtagttcaggtgggttggttgggcctgttcaacgtggtgtagcgttgatcagtggagatttaatgttactttaattacttaactgttttactgttttgtccaataaaatgctttacaaccgcctttatgcaaatagccacaaaccgtccttgtgttccccttgcacgtctgcatcgttggtgtggcttgctgagtacggtggttgtaatcagccttgctattattcccccttttcagaagtgtagtgcttctgagctgaagacgaggttagaataccaaggctcagacccctggtgagttttacctgtggagtggagctgaagccccgcaaggatcgccttttctgctgctgctgcttttatttcggtgtgaggactaagtgcctcttctgtaagtaatttatgctttatttacgtttggaactgtttattacttgtcgttttgtgtaccctggctggtcttggacagggatttaatacacaaaatagtctggaaatttggactaaatttctaggcgtgacaaacacctctggtgctgaaagggttgagacggtcccttcggccagccctcatcgggaagggaaggcccagcggttgagttgacagtgtctgacatgacacttacctccccgcactttgtctctgtggagtttgccacatggccagagaattcccccttcatcgatgggctgtgccagattgttgcgccgtcttttcactgagctcaacgagtttggtgaaagctgcgcagccgcggaaagcttgttcgtgcgggtgaggacttctctttttttttctttcgcctatctagctttttgtcctttttgctattgttgtgctaagagggctttggtttccttaacttagggtctcgcagcgcacttgagtgcgaagcggtccaccttggagtgactggacgagtaccatctcagccttcggaaggccgaggaggatcttcgccataaggaggatgagcgtcgggtcgtggcggacgccataaagaaatctagcgtcgagaacaagtccctcacgggggaaaacaagtctctccgcgtcgacctggacggagcgaacaagagggccgccgaacgggagcgccagctcgctgcggctttggaaaagattaaatcccttgaaacacagcttgtctcagccgaagctgctaccaaggcttgggcgccgccggcgacggagtcagccaagcaagcctgctacacccttaggctggctctcaacgaccttggtgcgcatgcgtagggcgctccgggtgacgacgagacgacattcgatttttctgagtggacgcaagatgcggccgactcagttgtcgaagtggctggcacgtacggcgattgctgtgcgcgagttgccgcaggcttcgtgcttagcctccttcacgaacatggttgtgaccatgttgaggattttcctcagatcgtaaagaagggctggcccgaaaatgaccaatctgccgcgtcggccgtgaagacctttcggaagagcttctgggagaatggcggcaaggatggcgcgaagacccagctccgcgaccagctggagaggatagcgagggccgaagacgccgctgccgccgatgctagtgaagatcccgagccgtcgggggcgcctgctggccgtgagggcgaaggcaacaaaagccaagaccaccctgaggtgtgaggcccttcgccccgcgttttttgctttttaagaccttaatggccgtggtttgctcgcatgtacatatatataggtgctttacgtgtttggctgggtgccgttatcatcttgtagccttcatggctttaagtttattaattaaaaattagtgtttcgccaatcgtatgtttttgctggaatgtgggattgattttgctagcatttctcccttgtgcactgttcctttgtgccttgcttgcagggttgtagctgaaaaatgtgcattcggcctccctccggggattggcgaaataagaacgagaagttcgtggcggtgaagggcttgccaaagaccaagtgtccttttcggcccgtttaccgcgagatgttaataaacggcaatagctacatggttataaaggttgcaggatggatgtgcgcacacccagcccgaactttagaggactatgaccgttatcatgtggcgtaccgcgaagatagcacaaatttttggcgaaactttaagaggtcgattcgccaagaggcgatcgcccgtcgccgttacagtttagtttgtgtttggcccccgttccttttaagggttgtgtacaatgttggtagtgatgacgaacctagttcgccggcttgtaacgtaaacgagggcggatgtgtaactgatggtataatctttctaatgaggttcgcttacgtaaatacaacagatttgttgtaattttgtttacttgatactttgtgaattcttgaacatatctttattctatcgttcgcatagtcactgtcgtgctttcgttaggtcgaaacgtgtcgacccctctgcgtactatggcaaaaagatatgtttatttctcatctctgctcttctgttttcggcttgtggcaggcgtgctaccaagcatcgtggcctgtgcgtaagctgagtacaaccgcgttttgacttgcattttcaaaattcgagctgtgacggtttcgacgttcggtgagctatgcttcgaccgattcgtttcgcccccctggcgcgttagctgatcaggagtttgccttgggatttttccacaaagacatcattcacagaaaaagaaaagcggaaaaacacaaagattttatactgtttcgggcctccaaggtggataataaccctacgcccaacttttttttcttttttcattttcctcttttttttttgctttttgtgccgaacggcttacataatacgaacatatttacaattggcgaatcgggtgccacccatattacacatagaagcgtctaagtgaagcgacgttctaggagtggtcgaactcttcgccctccaatgttgccagccgaaaagaacctgttcgagatctctgctttatcagatatggtccttcccacttagattccagcttcccgactgccatagggttcgccttctttgttagtacgagatggccgggccgaagctctgtcggtcgaacctttctgttataggttgccgaagtgccttccgcgtacttgcgcatgtgttctagtgcttcgactctcaccactttcacgagttcgagcgacacttcacgcccatttcgccaccagaaaacatcacccatggtgagttagtccctagttctgccggcgtcatcgccccatgcttcaattgcagatgtgcgacggaggcgaacttgatttgcaaatttagctcctcgcacatttctttgaatttttcagagtcgaactgcttgccgttgtcggtaatgaactccttcagtaccatgatatttttccaaacaaacttctgaatggctgctgcagttattgtgccaagtggttcggcctcaatccagcgagagaaacattcgatggctacaatggcgaacttgtaaccatttcgcgccaccgggaatgggccaatgatgtctaagccccatcttgcgaatggccaaattggtgcgattggctatagttcgtattgtggtgctatttggcttcgaccatgtcgctgacagctttcgcattttttgacctgttgaacacatacttttagtatggttggccaatatatgtcctggcgaaatacttctgatgtgacggttcttgctacttggtgtgctccgcacatcccttggtgtatttcttttaccatctcttctccttcggagaaggagacacagcgaagcatgggctgcaatattctggttcggtacagttgcctagagattaacttgtgcttcccggctctaagctgcagctacctcgacgttgcttcttcatccggtagccatccctctttgaggtgcttgacaaaagacgttcaccagtcgtctgggtcttcgccagttcagcttggtcaattaccatgatgtctgggctgtcttctggcacacttggtgtatacaaggcttcgaaaaggactcctggcgaaaaagcttggtcaattaccatgatgtttggtctgctgattttgctaacgcgtcagcttactcgttctggcctcggggcaagtgttcgaccattatgccggcgaaacttttgtccatagaccgaacggcctccaggtactttctcatcccttctttcgcgtcaaaagatttgtcaacttggctggcgacaagctttgagtccgtccggactagcgaacgccgaacaaccaaagctttcgctttccttaggcccattaacattgcttcatattctattgtgttgttggttgtgccgaactctagtcttactgcgtaacgaattggaatgcccccaggcgaagtcaggattgcagtgatgcccgcctccttgtgagaccacgaaccatcggagtgcatgacccatggttgtttgaccggttcgggctctgggacggacgcgagtgtccattcgggcatgaagtcagcgaggacttgggacttgatcgtggtgcgggcgacaaagtgtaggtcgaaaggtgacagcttagcggcccacttcgtccaaaggatactgcgaaggtaccacgattttgtgggcttggaaatagtgtttgagctttcttgaagccatcacgagggaataatcaagtttttccatttcaatgtatctaaccttcgcctcctggagagcttcggagacaaagtacactggcttctggcctgcttcggtttcttgtaccaaagctgcgctgacagcaatgggcgaagccggtagatagagccagagttcgttccctgccactgggctaactagagttggagggctttggagataccgcttaagctcatcgaaagctatttggcactcgggcgtccaacagaactttcctgcccctcgaagggtcttgaaaaaaggtaagcccctttcagccgcttttgacaggaatcgactaagtgccacaattcgccccgcgagcttttgtacttgtcgtacgctcgatggtggcttcatttgctgaatggcatcgattttctcggggatcgcttcgatcccccgttcggacacaaggaatcccaacaacttaccagcacgaacaccgaacacacatttctctagatttagtttcatgccagctgcgcggaggttgttgaatgtctcttgcaaatctgatgtgtggtcgaagcccttgctgcttttcatgacaatgacatcaacataggcttcgacatttcgccccaactgcgaccccaagactttgtacactagcctggcgaatgtagcccctgcattcctcagaccaaaaggcattcttagatggcagaaggtgccgaagggcgtgatgaaggctgtcttggggatgtctgccgggttcatgtaaatttggtgatatccggagtatgcatccaagaagctcatgagttcgcatcggcggtcgaatcgaccagctgatcgatccggggcaatgggaaatcatccttcgggcacatcttgttgaggtccgtgaagtcgacacacattcgccacttgccgttcgacttcttcaccagtaccggatttgctaaccactctgggtggtcactctcttgtatgaccccagctttcagcagcttgttcacctctgctttcgccgcctcttggcgatctgccgacattttcctcaacttttgcttcgtcggctttgcttcaagcttgactgtgagatggtgcatgataagatctggcgaaacaccccctacattgtctggcccccaagcgaagatatcaatgttcttcttaagtacaaccaggatgctgacaacctcttgttcgctcaggtctccaccaagcgatatgactttggcggggtcgaattcatctatatgccactggataaccttgccgtgggggcaggctttggtattggctttgttttttcttgtccttcgacctctagggtgtggacttccttgccgaaaggggtcctgtgacggccgaaggctgggaacccttgacagctatcacaccggctgggccaggcatcttgagcttgaggtagttgtgatgagagactgcttcgaacttggtcaaagtgcccctgctgaagattgcgttgtagttgtaggggatgttgacaatgtcgaagagtatctcttcttctcttttgttctcttgcgaggctgaaggctcggaggccgaaggctctgctccctcttcggctaccatctccccttcgcttccatcttccatccgcttgacaactctctccttgacgatcttcttcggtgacatcagtggtttcgctcggaggtccccacggtcagcgccagctgttgtcgaatagacaactgtgtcacgccgaaaggcgtggttctctcaacagtggttggaagtgaaaaacaattgtattgcttagtgaaaattgttttggatccccgtattacaagacactagagggctatttatagccctattataggttcccccgtttagggtttaggttttacaggggaatttatatggttacccttatgatagggacattattgatggcacactatgtcctttacatgtatgggcccttattgggctaaatggctcggcccaaccacttagcgaaaccttccttggcatggcggcccgttggtgtcgcgaccgagaaaattgccttttcccgaacgctagtgtattaatccccgtcccaggaaaagccggggtacaccaaacaaatatgatataaaattgcctttatgagtcggttaccaatctccataatgggagattacacaattcaaacaattaggaattcaactcaaagtaaaatagacgaagaaaaatcttggaattcaagaacaattactgattactagaatttttttgttagaatccaaaagttctttactaactagaaagaaaaacgaatacctactgcttattgcaaattattcctgattttaaaccagagtagattttcgtgatgtgatttctaactatagaaagaacttatatacaatatacaaaaaaatttcctaatcccttttttcttccttgaatcttttagttttagttagttcatgaaaaaatttatactattaatttcttcttatccataatggatttacctgggccaatacatgaaattcttgtgctatttgggggatttgttcttctactagggggtctaggggtggtattacttaccaacccaactttttctgctttttcgctaggattagttcttgtttgtatatccttattctatattttattgaattcctactttgtagctgtggcacaacttcttatttatgtgggagctataaatgtcttgatcatatttgccgtaatgttcgtaaatggctcagaatggtctaaagataagaatttttggactattggagatgggttcacttcactcgtttgtataactattcctttttcactaatgactactatcccagatacgtcatggtatggaattctttggactacaagatcaaaccaaatagtagaacagggtctcataaataacgttcaacaaattgggattcatttagcaaccgatttttatcttccatttgaactcatttccataattcttctagtttctttaataggtgcaattactatggctcggcaataagaaatacttagaatgagtcaaaattctaagaatttcaaatctaaaataaatcactaaagaaccacaattttgatttagtaaaacccatctactgccaacaaataccttcttttctcttttgttgtgtaattgttctattctaattaattcaatcggttcaattcttgtccccatattgaaatgaatcgagattgataaggagttagttaatgatgtttgagcatgtactttttttgagtgtctatttattttcgattggtatctatggattgatcacaagccgaaacatggttagagctctaatatgccttgaacttatactgaattcaattaatctaaatctcgtaacattttctgatctatttgatagccgccaattaaaaggaggcattttcgcaatttttgttatagcccttgcggctgctgaagcagctattggattatccattctttcttccatccatcgtaataggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaataaaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctgtgagtcgcttcctttttgcgtatggcacccccacccccattggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcagattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcaattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagtagtgatttgaaatccagaagttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccatcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttatttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatatagaaaagacagttcttttcaatttcgattatctatatattagtttgtttctatttctagatatctatttctatatattagtattagttagtagtactattctattagttagcgaacccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagtttgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaattttttccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgggaatggataagaggcttgtgggattgacgtgatagggtagggttggctatactgctggtggcgaactccaggctaataatctaaagcgcatggatacaagttatccttggaaggaaagacaattccgaatccgctttgtctacgaataaggaagctataagtaatgcaactat

SEQ ID NO: 38034 - DNA, 1256 bp, Oryza sativa
agaatcaatagactccttttcgggagcgattcatccttcccgaacgcagcatacaactctccgttgtactgcgctcttcaagtgtgcttcttccccttctcccccttaccatggcaagtccttgggaaataactccgatgggcagaaaaaggaaggcgttaagagaccctcctggcccaaccctagacactctaagatcctttttcaaacctgctctgctcccatttcgagtcaagagatagataaatagccacatcccattgcactgatcgagggcgctcgtagtgacttagggagtcgaagaccaagaagtggcttatttataccaagcattcctcttatggctagatccaacctcctggtccctgcggaaaggaaaaagaatttcacgttcttcctttcaggaagggaggattagggaagtcctattgattgctgctttctccagaccgccgggaaaaacatgaaaaaaaggctcgaatggtacgatccctccgtcaccccagaatgaaagggtgatctcgtagttcttggtctgtgaagatgcgttgttaggtgctccattttcccattgaggacgaacctcaacctgtgctcgagagatagctctccatacactgataagggatgtatggattctcgagaagagaggagccgtagtgcccccccccccggaccgcccggatcccacgagtgaatagaaagttagatctacatgggatctcacctgaatcgccccatctatcctcctgaggagaagtttgtttggtttcaaactccgattcaaacaggaggagtacgccatgctaatgtgccttggatgatccacatcttcgggtcaggcgctgatgagcacattgaactatccatttggctgagagccctcacagcccaggcacaacgacgcaattatcaggggcgcgctctaccactgagctaatagcccgtcgcgcgggcctccctttgggaggcctgctacgccaaaagcgagaaaaactccatccctttccttttgacatccccatgccgccacaccacacagggggggcatggggacgtcaaaaaggggatcctatcactatcaactaatttgttccgacctaggataataagctcatgagcttggtcttacttcaccctaaacgaaagaagacttccatatccaagtttagctcagacgtagctgccttctttttgggcgtgaagcagtgtcaaaccaaaatacccaataagcataagcattagctctccctgaa

SEQ ID NO: 38035 - DNA, 17204 bp, Oryza sativa
  unsure (1)..(17204): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcattgtaccatgaaccagccatggtgattgacctgttatgcattctttgagaatattataagaatttggtatatgcttgagtgttgagtgccttcaaaagctctacatatctatagattattacgaactaacactttcttgtgagtttcttttgcttgctaaccatgtcaggtacaagttccgatgaaccaacactggagaatctagcgcataaactgaagggcatggaaaattggtatgaagagttgatgcgtaatagtaaatcatacaaggaaagcacagataaacatttaaaaaccttaagtgaaaacctagtgaaagtagtggatcaaattgagcaaatgaatcaatcgcataaacaattaactgaaaacatccagaatatgaatattggacatgaaaatattgtgcgatgcattggtttacttgagactgcaggtgaagaaggtgcaggtgccactgctcatcgacaccaaagatatgacgatgaagacgaagagcaatctgttgctgacgatgaggaggaagacgagagtgttggaaatagaagacgacatcgagttagggacaaagatgatcctttatctaaggtaaaatttactatgctttcttttgatggtaagttcgagccttctgtttatctagactgggagctagctgttgagcaaaaattctcttgctatgattttactgataataagaaagttaaagctgccattagtgaacttacatcctttgcatctctatggtggaatgatatatgtggtagaggacttagacctagaacatgggattatatgaaacgtataatgaggtctagatttgtttcttcttactatgcttgtgacatgttaaataaactgcaacttttaagacaaggttccagttctgtagaaacatactatcaagagatgatgattgctttgtcacgatgtgatatgcaagaaactgaggatgctagaatttctaggttctatggaggtcttaatagagagatttgggatattcttgaatataaagaatacaataccatgaatagattattccattttgcttgcaaagctgaaagagaagtgcagggactcaacaagcataggagttcttttgcaggtgctacttccacacgacaattaacaccacgtcaatctactactgcctttcgtccacctacctccacgccatcccatgctcaagaaacaagcaaaaacgcttcagttcagactccagccaagagtgcaacttcagtagcttccactagacgtacccgtgaaattacatgtcataggtgccatgacattggacacattgctcgcgactgtccaaatcggcgagctctatttatgaatgatgatggtgagtatacttctgctagtgattgtgatgatgaatatgctttagctgccactgaccatgcaggaggacaagataacgatgtcatcaaggaagtccatttgcatccagagtcgctagatcagtatcctagcctaattgtcaagctagcacttagtgctaaagagaagtgtgaagagcaaaaccaacatcacaatttgttccaaagcaaagttcttgtgaaaggccataccatcaaaatgattattgataacgggagttgcaacaatttagcaagtgaagagatggtcaagaagcttggcttgactaccatccacatccacatccgtatcatattcagtggtttaatatatgtggtaagatgaaggtaacccgcttggttaaaatacctttttctataggctcctaccatgatcaaattgaatgtgatgttgtgcatatgcaagcttgttctgttattttggggcgaccatggcaatatgatagagaagttgtttttgatggtaggactaaaacatataaatttatgttcaatggtaaaagagttgttttgcattctatgactccagccgctgctttgaaagatgatcttgcaagacttgaatgtgaaaagaaagcgaaaagtgaaaatcagattattactaagaatcttgtttcacctagtacaacagaaccaagtgccacaaagaatgaaattaagttgacgggtgctttgttagcttctaaatataatatttgtgcactatatgagccagattcttgttgctatgctctattttgcaaagatcctatactcactttggctactgcttctagttccttatattctttgccacctgctattactaaccttttgcatggatatgagggtgtttttcatgatgagatacatccaaggatgacccctgaacgagagagtgaacatgatcacgaagatgagattgagtcgaggacaactccaattcaagaaggggaggatgatgaggacatcaattcatcggatacgctcataacttcacacgttcaaatgataatttcaagtccaagtccagttcggcctccggagacaacactgacttcaaacggatctagcgccttcatgccaactccgatttgggtgatcttggactttatggaaaacttatctgctaactttcaaacgcatccggtctcatgtccaaattcatctcgagtcaacggaaatcgccaaaacaagacagcgctgttgctgaaactgaatttgggccttgggccttgtaatagattaggcccatctcggaagtgtctcccttcacctccacgaattagcacttatccttagctttattttcctctataaatagctttgtacatcctcaaaaacatttgggttttgtttagttgaattttgccaagtgccattcaccttgtctctagtcttcgttcgattagtcggcgactattgattcagagcccccaatagttggtgtattgatttgccgggtcgattagacctaccacttcaatcgcaactatttctttgtgcttaatcacctattcgcaatatttagattgcatcttatcttgttcttgcagtgttctctcgtttgcattgcagggatcatcaaccgcgcgtcgcggttggtacggcatcgtttgtggtgtagcgattgcacggtgtcctggacttgttctggttggtagccacgtcgcaaatgtcgcactcgatcaaagcgagagttatcccctcaccagaagatcgggccacgagagagagtgtcatcaaaccgggagtaaaaagtgtttctctaccgtgtatggacataaaaaaattagtaggagaattttttaattatattaaaagcagtttattagagattatctatcatgctaatccttaatatagtttgatacaggttaatacctcttaatctgtgctaattatcatgaatcatgtcattaatgcggccaacttgagctcgttgtgaaacgctacgacacaatgatttctcgctaagcaaacacagcgacgttgaatctgctgggcttgactcaatccaatatagggaactaaatacagtaccgattaaaatttgaatttgtgataaccggttctactgttaaaaacaaagtgtgtcaagccttatgcagtaaagcacacacaagccttacaaactgtgtcgtggcaaagtttagcggtcaacaaattaaaccatccctatagagtggactagctagtgcaagaaaaaaaagagtcatattttcataatcgaataatggagcccctaccctgtcaacggacagcttgagaataaaatcaggtaaataccaattcaatcatggaggaagacttggtccctctctgaagcgtgcatatctagtaatgttcagccactagccagccgtacgtacgttcctccagctcacctgacgatgatatgtgtaacaagaggtgacgatgagtatattaattaagtacacagaataagaaaaccattgacgcatgtgattaattaattgggttttaattagtacaaatttataacattgatttatttgatattttatagcaacttcgttataaaaaactttagatgaaacataccatttgacattttaaaataaaacatatggtaacaaaaaccaaatataaaatatgctagatgcatctccccgtcggaaggttcattcaattcgcgggatgttgggttgtgccatgtgccttgatatacttcgccagttcgccgggtgtagtaacgacgactctcgtgtattttcaaagacgacgaacgcacgagatcgagggtgttctcgttggctctctgatatctcgactcgatcgatcgatcatgtcgagcttacgcgatcgccagccggccagtgtagtagcagcagcaaaggaaggagatgttgctcgcctatgcgagctgctcggtgtggatgttgctcgccgacgcgagctgctcggtgaggaaaccggctctccgacaggagttgacgatgtgggtgtggaaaccggcgatttggaagccggttgttcgacgggaagcaatgctacaccccacgaccacgagggcagagatcgcagctgctcgtgctttggcaggcgagtgttcactttccaatttctttctttttgattgatagtgcgtatatatacgtagctaggatgggcaagagtgatttttagtttaactaaatacactaatttaaagtttaattattttagttctttcttaaaaataaaagctcatttaaatatatgcacactcagtactataaacacatgcatacacatcctatcattatgagcataattctaaacggaaaggctaatgggcgggtgatcgctcccccacccgcccaccctctcccctctcccctatactactagatgtactcctccctcttctccccctttctcctctccttctcctctttctactgcagtagaccacacaaaattttttgaaaaacaaaagttagaaaaatttatgtatagaaattctatatataaaaaatttgaattcaaattcaaatttgaatcgggtatgtaaacttttgacttataaattttgggtctataaactttaggtgtataaactttagatgtatagaaatactatatatagaaaatatttgaattcaaattcaaatttgcatcagatataattcaaattcaaatttaaatcgggtatataaactttaggtttataaactttaggtgtataaactttaaatgtatagaaatactatatatgaaaaatatttcaattcaaattcaaatttgaatcggatatttgaattcaaattcaaatttgaaacgggtatataaacttttgacttctaaactttaggtctataaactttaggtgtataaactttagatgtacaaaaatactatatataaaaaaaatatttgaattcaaattcaaatttgaatcggatatataaacttttgacttataaacttttggtctctaaactttagatgtgtaaacttgagatatataaactttaggtgcataaatttactaaaatagaaaagtaatgcagtgccaaaaaaggaaactaggtggagagagggagggggagggggggggggaattgancnntncccncacccccaggcgagcgatcgcccattaggggtaccctattctagaggctagactaacatatgtcttattcttgacgagtatgtcgtctgccacacaattagcatttaatgcccatgccaagtttaggactttatcaaactctggaggttaaagctacatcaaaagaataactctagtgggccacaaatactactacaaattcattcaattaactctagtgggccacgaacacttctacaaaaaataacattagtgtcggttcgtaactaacatcagtaccgaaattagacacagcacaaaactttcagcactgatgacccccattcatgaatgtcgggttccgacctgacacagatgggcctggaagcacctaggtggaatctagatagactcatttgtgttatgtattctctagactgagtattgatatgagctcatctgtgacgggtattgtgtaccatctgtactcatgtatatacaaagccccaaccacaaatatctatttatacaagttgtatatgactcttcaaattgataggatttgaacttgagactctacctcacatgcacgtatctttaccaagtcatctacacatcaatcttgttagcaaatggatattttcccttttgagccttcctaactgagattttgaatcttgactttgagtatctgaatgaaaaatttgtcaactacaaaataatagattttagcgagagctaaaatttatatataaatttgtcacaatccgaattcgtatgataaagttaagttcatatatccaaaatttgcactaataaggttagggtcattcgtgccgggtcaatagaatacctagcaccgatgtgattagtataagtgccgggtattctaaagacctgtcactgattatcttctttagccaaaagtacggtcatctcgctccaaggggtaagatctgtcgcttatatgttactcatccgtgacggttaattagtggaaagacctggtactgatgtgtcaccgaacaataagtgtcggatgattataagatccagtactaatgtcttcttatcattgccgggtgaagcatatgtataactcaaacttttttttttcagaaaaccaccatcggtgttgggttttatcaaccgacactgatgaggaggcactgatgtgttgtcctgtgatagtgaaattatctgtggattggcctgcatccatccatccacatgtgcgtacttgtactagtataatttttattacacataagatgcgcacactactactatacacatactccctccttttcaaaatataaacatttttagaatagtgacaagttaaaccttttaacttcgactattaataatagcaaaaagataaaaaagatcaatcatgtaaaattgatgttactaagtttatcattaaataaattatcctaatatgtaactcttttttattttaaatatattactttcatagatattattggtcaaagacctgacctccccacctctgcacgttatctccaaatataccggctttcctttttttttttccaatttccccactttatctttacctttttttcacttttacttttttccttgtttactccataagggcctacgaccaaggcccattggcccgttcatttgtgcggtgggccggcccaccacgtcacctaactatttcttttttctgaaaaatagtataattaatcgattagcgaaaatagagtgactcgttagcgtataataattaattaagtattacttcctccgtttcatattataagactttctatcattacccacattcatatacatgttaataaatctagacacacacacacacatatatatatatatatatatgtatatatatatatatatatatatgtatatatatatatatatatatatatatatatgtatatatatatatatatatatatgtatatatatatatatatatagtaaatttgtttggtgctccatggtgcccgggcaccattgttgaaattgagtatatacccaattcaaatgagtatgaaactttttcaattacttagttattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttaaaaaatttgagtaattttgtgcattagataccatggtgccccatatgagtgtcctatatatatatatatatatatatatatatatatatatttcgaagattatgtcaaaatctaaaaatatttatattttacgaacggagggagtacaacacactcgcgcacctacaaagtacgccctaaattcaatatttacgagtatccgaatttgagtatgtgtggactctgtcatcggtgcttggtacgtgttcgtgcaactgcgcacccttgcaagtcatgaagactagaatacgtcaaatgcttcttcctatcaacgtctaattcaattttatgtttggattagaaactatcaagtgtttgtcaggagtagttatgcctaataaacagtagtattctactatactattattattcccattacaaataacgttaccttttcgttatgagttctactttcgataaaaaacacttgtactcccttttttttaaacatttatactcccttaattatcttgctagatatttttaatggaacaacgcatgcactactacatatccggacatcagtgatgggtcatccgtaatgggtcaacatgactttttagaaatgaattgtctctaacggaccgaaaaataactagtttaagatatgactaatgggaagggcccatcatagatgtgaggtcatctgtgacggatggtagttataacctgtcagatcacaactatggctcgtcacaaatatcatcataaatgagaccactcatctctgacgggtctttaacaccatatatcacagataacgggtgccaattatgacccatcactgataagggaaaattcaaaattttaaattttgcaaaaaaaaatctcggatttgggacatgccttgtataaaagttgttgctctcaatgatatatacaactttataactaacatcatttccattttaaatcattgaaatccctgtatatgcattacaagtgatgagatctacttataaaaaagaaattttgagttttttcaaatgacctgatggaaacatgccccacatcaaagtcattgagctcaactagatctacaaaactataattgacaatattttcatttgagatagtttaaggtgagatctattttgaaaaatgaaattttgaattattcaaatgacatcgaatggagatattctctatgcaatagttttataacacaatgagatctataattctttagttgataatgttttcatttgaagttatttagagtattaaatatatattaaatgattcgaacatgcatagacaaaataataatattgaatgagtaatcaatatgtgttgagtaggtgagttggtaaaggtgctctttggggaggtggaggtcttaagtttaaaactcataatacacatgcatgtatatattgcaaaaaaaaaagtggatttgtaggtagtgatatgtgaccatgtacaggatggctagtattcaaaatatgttactcatccagatctacaacactatatgcaagttgtcttaattgaatgcatcaattatacttttgcaggagtttgatgaattgttgttacagggataatgtttctattcaaatggatggatcaatccctccaaaaccaccgaggtatactgcttccttaggcacatgcaagccatgcaaccgcacggggcccctaatttttaggtggcccaaaattttatggttcaatataattaggatctctagattctttttttttttcaaatttcacttcttcagttccactgaaccagctagaacgagttatttttgggtaccatttcatatcttttagttaaaaatattagactagtaaaatataaataaaactaaagtttagactgaaaccaaatcaactttttatatatcagttatgtatttaaaagttattttgtcggaaagaaaatttggattctatatcaagtacaactctacatttcttaaatattacaactccacctcacttacgagttgctaattagtaattcaatatttcaggaaatattaatttaaaataaaatttgggctctagaactagtacgactcaatacttgttaatttcaagtttttcgaattattaaattatggaaaacttgacccaatacctattgagtttgtattcattgattccaaattttagaaataatatttaatcgatggaaaacttaaattaataatccatgacaattacaattttgtatatttattaatgtaacaaaatggtgttaattctatatatatgcgtgcaaatctcctactttggtatatactaaataattataactatgtatgtttataacccagttgccgccagcctcaaagggaaactcacaataactctgagaacacgggtgccactggtaacgatcaggctcaggatgagggttttctactccatgtcgtagcagccaatggggatggtgaaaactacaggaaatgcgcgacattgctctctgggatggataaaacacgtctcttcgcacgcaacagcgagaataagaccgctctagagtgtgcagcaaatgctgggtacaccaatatggtttttcatctccttgacatggagcgaaaacacaatttttgtggactgaacactaaaccaaatgagatcttgaagaagacaagtggacgctcagagacaccgttgcacgaggcagtgaggcagcgttgtgaacgtaagattgaagagttgaagggcaaggacagtggtttagcgcgtgtcccggacataaacggcatgtctccgctctacctcgccatccccttgggatacagagacatcgttgataagctaaccttaacctttggtgatgcgaatctgtcctacgatggaccaaatggacaaaatgtgctacatgctgcggctcttcagagtgcaggtaagggatgtataccctgcttaacgctggcgtggcattacacacgtataagttgtttttgttttctatataattatgcagagttggtttatatttagtcgattctgcctgatatctttcaaaacggttcaataagccagtggttttatgagaatgtctacaataatgcctgcacttgctttgcttcctctctgaaccctgcatcaacatttactttcgcatagccttcaggtggtgcttgtatttctcctgaatatcacattagtacttgcttgttatgctttcgcccttgactcattatacatagcacctttccccttggcatcatctggttgttgtcagatagtcaacaatgtgctttcataattgatcaaatcattgatcaacactatacattatttactgctttccttctcttgttacaaactcttttatgggcttgtgtgtgttttggttatgtgcatttatgcagaagccggaagttttcttagtatggttctattaacttgttgtaatcgtctgagattaataaaagctcctttatcaaaaaaaaaattataatcttgaggtagtctcctagcaacagtaaaaggctcacgtacgtgttaatggctgtgcatcctccagaatctttttgagtgcttattttggaatgaaagtttgatttgttctttgccatagaatttaggttgtacattctttgacacaattggtatcataactagctaggtactaattaacggaaatactcgatggcagaactctgaattgattctaggaaggagaggagatctcatgaataaagctgattggtctggaagtacacctcttcactttgcagcatcagtaggagttcagggcgtaacaactgcgctgcttgatggcatagaccaagatcgcagaacggactacacccaacggcccgacaacaatgggatgttccccatacacatagctgcttctgttggttcaatggacacaatcacctcattggtcaatgccgatcaagactgtgccactcttcgtgataatgttaaaggtagaacattgcttcatatcgccattgagaatcggaagtacaaagtagtcaaattggtgtgcaaagatccgaggttcaaggaaactctgaatttggaggacaacgacggtaatactgcattacatcttgctgtaaagaaaagagacgagtacatcttcacgtatctcctacagaataaggccgtggagctcaaccatgtcaacctagaaggctatacaccactcgatcttgcaaaagtgataaggatggaagactactttgcctctccccaggtatatgcataaaaccatcaaaattttggcataaattaaaatacatacaaaacagatctcctgacatttcaagtctccttccctgcagaacccaacagaatggatggtgagggtattggctcattctggagccgtcttcagtcctcgtaggcgtgatgaactgatccgtggtggtagctctcaagaacaagaaaagcacgggaaaaccctttcagagtcgactgaaagcgtgttggtcgcatcggcgcttatcgcgacactgactttcgctgcagcattcaccatgccagggtcctacagaacgacaggcccaaaggaaggcacgccagcactgggtgccctctacggtttcaaggttttcctcgtcgccgacatcttggctttcttctgttccgttgcggccaccttcagccttgccgagtacgggaaccgcgggacggtggatccccttgtccgctgtcggtactcacagcgtgccgtgtggctcttccatgtcgccctcaggagcatcatagtagccttcgcgttcggggtctcggtggtgatgtggaacatttctctcagtgccatcagcatcggtggtgtagccactatcgctgtcgtgttctacgggaacgttcctcttggtcaagatttcaggcttatgttgctgatgcaccgcaggtttggcttctcacgttcttggaacctgtatccttctacggcctctcatctcaactggacatcctggcagctcaaaagcttttccgcgacgctggtttggaatctgatgaatcttttttggacttatgtcctcatatttgcacttgctggcttcgctcaactgaagcagaaacattaacagatcacttcaaaattcgtcagggtgataattctgttgggattcacagggcatttaattattttgttttctgttttcttgcattccattcccaaattgatgtccacatgtcgtcctcaccagttagtcggagccatatgtatttccttttcttccattttatttgtattactaatgtataatgacatgtttaatgtttaattattgtgttccccgttgtagagattatgggtaccgggtacctcatggctgggctatccgactggttataggagatagatcatgtatatagaatatatgtataagaatagaactcatgtattacgtttacttgtgtatcatggaacggtctgtagtattggtctattaagatcgtagattagatataggaaacttaaaccatatggggataagtttttaccttgtaaggttgctcctttgcctatataaggagggtaggacgtccctttggaggcagatttacaactagatcgtcagatcaatactacatctggcggatacaaatccccaaacagaagtacagtattacctctcattgagagggcttgaacctgtctaaacccttgtctccgcatctatccacttttaggtctcgtgcgctaccccgtttatattgctgcatctatccactagcaagatgtttatctctccatgttactgaagctcatgaggataaaataatttggtagcaatatgcttagtgatgttgctcttaatataaccagtttccatctgaacaacacaagcagcattatcttcatagataatggtaggtgattccaatgaaccaataccacaagatgtcaatatgtggttaaccattctgcgaagccatacacattcacgtgatgcctcgtataatgcaattattttagaatgatttgtggaagtggctaccagagtctgtttagaagacttccatgaaatagcagttccaccttgtaaaaatacgaatcctgtttgtgatatagcattgtggggatcagatagatagccagcatcagtatacccaattaaagttgaatcctggttctttttaaagaaaagtccaagatctcttgtgccattaagatatcgaaaaacattcttaactccagtccaatggcgtttggtaggagcagcgttgtatcttgctaatagatttaccgagaaagcaatatctagcctcgtactatttgcaaggtacataagtgcgccaatagcactaagatatggaaaatcaggtccaagtacatcctcaccatcttcctttggtctaaatggatctttctccacgtctaaagatcgaaccaccataggggttttggaaggatatgacttgtccatattaaatttctccaaaattttttgggtatatgcactttggtgcacatggattccagaaggtaaatgctcaagttttagacctaagcaaaatttggtttgacctaaatccttcgtctcaaattccgtctttaaatgatgacgtgcttcattaatatcttgtgtattgccaatgatgttgagatcatcgacatataccgagataatacaaaatcctgtgggagacttttgataaagacgcacgggcaatcatcatttttagtgtatccctttagtgaaaggaattcacttaatcgattgtaccacatcctgcccgattgttttaagccataaagtgacttatgcaacttaacacaatacatgttatgatttaccttctgattcgggatgtcgattccatcaggaaccttcatgtaaatatcagaatcaagtgacccataaagatatgctgttactacgtctatcattacatattccataaacataatctatccactatatcttgtcgggtaaaccagtcgtgtgggtatatggtactgataatctttacagtagcccctgagaccttcacagtcgaaaagataatcttctctcagaccaaattaatccaaagccttgtgcttcaatcatcttcgccatagtctcccgagtgcttttaccaaaccataaggctatgaagggatgaaaataataataaagaatacatacccaggtgcatcgactagatgcacctaattaggtgtagcccccccactatgtggttagtttgaaaaaactaagcatgtagtcaaggaataaataatctaaccaaccgaatggttttggataattatagttaaccaagtgacttaatattaatatatagtatatacggtgtgaatccctgaataacatgatccaagtaatataccgactgcttgttaaaaaatataataagcataactaaaagccaactgcatgtttaaaaatcatatggtacatgactttaataaaatgtctttatgcagcaagtaaaggaattctctagagtgttgggttcacattgtgcgcatactgccaaaacaaaatatgctcaagtcccaataaaacatacaatatcaccacactcgagtaaaataacacttataaatggatttaccaaccacctgaaaatgatcaaaatatattatcagcctaaatccatatattggtcttttagaaaaatgcacacacatggccaaaagcaatgatatagtatccaatgaattgctttataaaaaacaaacagcgccttaacttatacaaaaatggtcattcttcaatgcggttgggtaagtgttgacggtcgttatcgatcagtttcgaccgtcaatattaccaaaataaaggagaactagtgatgcttggaatgcatatatatgttagaataataatattccacaagtattaggtatactaaccttttgcagagaataatcataaagtggaggagaatcgacatcaacacagacgataaatcaattggacgaggtcgagaaccagacttatgtatgaatggtccaagaactcagaattgacatgacaaactgggccaaaattgggctggattgggccggccctaagcggttcggccgaaccctccttaacaccatcaatccagggcttcgcttggacggtgtggattagcccccaatgacggttagagggtatttccgaccattccaaccatcgcaaccgtcattaggaggctataaaaggagttctcatcctcacttcacacacacacctcaagcaagagctctctcatttctctcaaatttagtttagtagtatctagctggtggaatagaaatagagtagaaatcaggagtccggaagccttcggaagagttcgggtatggctctagtagctttcctttcctcttttgtaagctttgtacttttattagaatactcttctatatacatttatggtattgaaataatttacattatgttcatgttatactgaatatacggctagcttatctgggagatgctttggtacgggtataatgtttgcatatgcaattactctatgtcatgacgatgatattagattagtatctagtagtttagatgtggtgtctagattacaggatatcattatttagggttatatgctgcggatgagaggtgggccgctgatggtgatagctcagtacgggtattcctccgtgcctgtatataatcctaagttaattccctggggagggtattcctccgtatttagccccggttgtatggtcatgacgggctgtcgtaaggaactcggcagtcaggggtggcttctcgaagtaccaagagggcatcggatagaggatattagctagtatatcggttaactagaatgtatgtatactatgtatattagaagtataggagtagattttctttctcttttctttccacttagctcagataatatatcatgagaatgagtaattaatgcttgtgtgtcactctacccttggattatcttaacccctacttagaatatgattatcacaagtaatatataaattattagttaagttctctccacatgatcttcccatgggataaaataaatatgatacccttagaatactctcggttgaaatgctacgatggtatatccgtgcgcttgcggatgaactctataaccataatataccagaagtatttctgtgccattgctgggaattatatttctagtaatatcgttaaga

SEQ ID NO: 38036 - DNA, 2965 bp, Oryza sativa
atacagtggcatatcgtccgttttctcgtttggtagagcttcaacttttaaatttaactttaggagttagatctgaagtggagttgtggaacagcttaacctagctccacctctctagttcattttgttagagtgctccacccagctccgccccattttcggtggagctgaaactgtttggctgagctccagctctaggagaggtggagctggaactggagatgtgccaaacaaggccaggtaatagtaatacgatgtgcaaatgcaagaactgaactctgcctgaactctgcacaaatgcaatgatttccataccaatcaaatgattcaaaagttgagtgcattgcccccttgcaacaaaatttataccacaaaaaactagagctctgacaattaacaattaacagaggttcattacatcacgtttcatgtaaaatgttgatgaaaatctcccaatagtagaacactactaaaaggaaccaggctaacggactgaagcttgctctcacatacagagcaacaatttattccaataactttcataatttcattcagtccacatatgagtcttcagttggtttcttgtatgattacaggtcagtcatgtggctgccatcgctgtcgcctgcaggggcgtctgatgcagatgtaccggtgcatcatcttcagatatcaggccatcttttaccggcatgggagtgttgtcgcatttctcgttggaccgaggaactgtcaaagctgcattgtcaagaaaataaaccaagacaaaccagtataaggttctgaatatgcaaacttctacgtatcaaattgtcttgactctttctcattccacaaaaaataaaaatcttagtccaacttggctaaatgtcaccattaagaaaatgtaaccacatatgtaccactatccaaattattttagaacactcaaagaattccaagtagttgtaatgttagggtcggaatcgtctccacgaagaaacgcaactacgcggatgtggcaaccgggccacgcagcgtcgaaggagatcacgcgagctgaaaactgacgtggcatgccggaatagggataatgatccgattgcttacatttagagaagagtttgttatccctttttattagctaattcaattcaattgtaagcctacttaagggccacgaaatcatgaataaaccaagcaagattcaatctatagtcccatctccaattctctactctctcatcccctgcttttgctttcgtcgccaatcatgggccggacgtcgaagaggctgccaaagcctcgacctccggtatttaattcatatcccattcggtcattagccggtgctcataacacgtattaagatagaaagagaatatcaaaattacccacaaggaaattatatgagcatatttgtcagctatatactatcctttttaacactgctggatgacaggtacttcctccgtttcacaatgtaagtcattctagcattttctatattcatattgatgtgaacctcatcttaataaatctagatagatatatatgtcttgatttattaatatcaatatgaatgtgggaaatgctagaatgacttacattgaaacggagggagtatatcgcaaagagagcggatataaaaaaacatcaaattcctttaaacaagagggcgcatgatctatttccttataatggtatattcaaataaagaagtgaacctcatcttgagatgattaaatcgggagaaaattatttgaagtaccatacctgccgcctcttcattaggcactggatgctcacttgttgaggtgtcccaagaggaggatgcaaatggcgctgagcttgatgcaaaggaagaaagatgagatgaaggcgatgagagctggtttcctggaatctgttgtaccatacctctagttgcacttgactacatcaagaaacaaggacatggacaattagttagtatgatattacaaaattttcgtgaaaacataaatctaggcaataaggagaatcccatttaaatttataacttgctggcctctagggagttttttaatagaaggaacactctagtattttctctatgaagtgttaagaactactgaaaaaagtatgattcatgttctggtacccaattagatcacctcattagaaaagggatcttcaattcgagcacaactatacaacaaagtttccgttcgtcatcattttcagttggtagtgagaaactggttcaaattggcatacaactttctcaatcaccagtaactcaaatctatcaaagataaattaagtattgacataaggaaatttcaaaggaaacactaagcaaattgtttttatttctttaataaaatgtaagtttacctcagtgacaacttcaggctcctcaattctatcctcatttaggtgtgagatggaggccaaatctttacttggattattccttaaaagttcaatctcagcaggttcctcataagtgatctctgaaatttcactgtttcttgatctgacctgctcagctttctccgaccgttggcaggactgggaacttctggtacttagagaaaaggattgtactatacaatcctgacacccagaaacatcaagctgaagatttttaaggttttgaagtgattcaggtagtgctttaagtccaagacattgtgacaaattcagagactctaaattattaagcttgtcaaagcacgatggcaaatattcaagcctagagcagttcgagagattcaaaaaccgaagagaggtaaggcattcaaagattccagcagtttaagatcagaacaatatgaaaggtttaggcttttcagatatgcaagttggccaaatgattgtggtaatacctcaagtttcaaacattttgacagatttaaatactgaagtgaatacatgtcgccaaaaagtcgggcaacatttggaattcaaaaccacttaagttaagatctaccaaagaaca

SEQ ID NO: 38037 - DNA, 1601 bp, Oryza sativa
cagaggctagcaaatgattccaaaaatctgataggtaatgctgaaagcttagaacatccagaaagattcaagaaacggagtttggtcagattttcaagagattcaggaaaactagtaacttcagggcagcatgacaagtttaggtaatgtagatcatgcaacaaatgaaggctattcaatcgttgaagtttctggcaaccttggagattcaaataattcagcccttttaagttgcttataaagggtggcaactctgtaagttcagtttctgaaagatccaacatttgtaacttatgaaagctactaatttgcagagggagtgctgtaatagataaagatgaaacgtcgaggtatctcagttgtttcagctgaaagataggagatggaatatcttgaacacagcatccactgagatccaaaacacgcaagtatttgttcactgaaagaacttcactgacatgctcaaagtctgcaccactattcttgaaaattagtgaccttgccttggaaggccatgccttgcgatcgattgactctaaactagaagcagacacctgtgcataacggtaatcacaatatctggcattgcgctcattctcagcatctaaaataacaaggatatcttcaccagcaactgatctagcaagatcatgcgccaagttatgcatgtgaagcatttcctcagaagcaccagatctttctgcatcattctgcggaggaaaacagtgttacttgtttgttgagatatccctatatggccattctatcatggtcaatcttcttacggaaacttgttgagaattcagaaataaaacaatggtataagctactatgcttaatggagatatttaaccacattctagttacataggatatgtacaggagaaggtaaaaaagaacccatgaacttacctgagacctctctaaaacttgaaggaaatagattgctttaagttcatcaatatatttctccgcagttacatcaagtggcaaggttccatgtttggactcaatgaaagaccaagaacagctatagaggggggggggggggtgaatatagcaattcaaatcttacccccgaaaatactcatcaagccggatttctcaaaatccttactagaaccgcagctattagagaagccggatctagaaaagaagagagaaaaagaagagagaaggaattcccgaaactagaggaggaagagaaaatgaattcccgaaactagaagagaggtgaggaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactcaaactaatcctaatacaaaagcctctcgggcaaacacactccaaactcaaactgaaactctctcaccgagcatctcaaaaggattgccaaagaagcaacctccacccttgcatccatctctctatttataggctaagacccataagacattgtctcaaata

SEQ ID NO: 38038 - DNA, 20713 bp, Oryza sativa
cccctagggcgaaaccctaactcagaatgatctggtccagccattcttccttagaaccgaaggaagcctcctggatgcttgccacgtcgttgatccaaactctccacgccgcactgatccgcgtgctccctctccaaaccagtgacgagccgccacgtcacgcctcagcatgcgagagcgcgcgctccaccgcgtggatcccacgctcacctgcgcgcatccagtccaaagcctccacgcgtcccgccgagctgctcccgcgcatgctcgcgaaatcgcgcgtgggtcccagtacaactcccgcctccgagccacttgaaacagcgtggaccccacgcccgcacgcgccgaattccttgccgccgcgtgtccactgcgcgcgcgtgcctcgcgcgatctcccgcgcttgcccgcgcatggtgccaatgccgtgggccgtcgtcttgtcttgggcctgctcggcctggcctccctgcctgctgatccatccatcatcttgagccacgaggaagggctggattggcttggcctccctgccaaccaatcacagctcacatgcaccaatgggctagcaagctcctcatgcacacatgcatgtcttgcccccgtgcatggcattcggccatgtgcacgcatgcacaaccgaagcaccactgtccatacttgcatatgcacatgccagtgcatgtatacaagctcctcttccattctccattctgttcgcgaacccggcacttgcacttgaccttgcgaagtccgttgcgaagacctcctcacacggtgttcgtccaccgtgtgcaaccttatgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaatctgaccaatgttagtccacgcacacacttcttgcacttccagtacttgtcaatttcccatcacaaaagaactataaccacacatggtttcacactcaatcatgtcaagtgcaatccattgctgaataagtttcttcttttctataacagttcctttagggaagattgaacaatatacaaagcataatcttagctcatggggcatattataatatattatcttgaatgatggaaatagtggtgaaattttgtcttggggataatcttcctctatcttccacatttcttcatcctttgcagcttgccaaatctcacgcctttgtcgttgagcattcaccacagaaccgagaaaattggctaccaagggtgtgccttcacaccttctaacgatttcttctccatattccctgaacaacgggtcacccggacctgtcattgccctttgagagaatatttttaaacaatcatcctcagataaagctgccagcttgtacagtggaacggtggaaatcagcttagctactttattgctatgagtggtcactatgatcttgctttctgtatgtctaccagtaagcaacatctgcttcaattcattcacttcttcatcctttccccaaaggctatctaatatgatcaagcaactatatttatttagcacacgctgaacagcattcttgattgactgcagctgcatatttccctcaattttttctgtagtttgtgaaactatatctcttccaattttttcaaggttgatattacccatggaaacatgaacccatatcctaaagctgaatacctctgttcctgtattattgaaaacgaactgtgctaggcttgtcttcccaaaacctacaggcccaactatggatataatggaaagctcttcagcgctgttttccattaaaatgtccatgagattatctaagtctgcatccctcccaacaattgcaatgtcagtatttctgtatgatgttgtttgcttctcctcaaaattcactgctgagttgatatgtgaaaggaaatgatactgattgggcaattgttgcctttgctgtaacatctccctcttggacttcatcttataaaccatgctacctttcagaagcattggattcgatagtgagcagaataatgacccctgtaaatttaccaacatatatacataaaagtagtctttatcatgaaatatattttatattttgataacgatgttgctggaagacaaaaaaggggacagctaaacaagagttggtgcatcaaggagccaaggaaggtaccagcccttacatagctgatagatacacaagtctttggtataaaccttgcattttctcatataatacgaaggacatttttttgcatgcctacaagtttctcatctctcactatctagtccccctcaagcaaatgtacagtctaaagataagttacgtgtaagtattcggcttatctcttactattaccaaataatttcttaacaaaaggaaggatgcttctaattatcgattgtgttgacttatataagctacgctagatgacaccctgtgcgttgctgcaggatgttggtgtgtaaagtgcaattgcaaaattgcaatatatggaactgacaaaatgattaatccaacaacccaaaaaagattgatgtaggctacaaagactgggctaatccaaacagttaccatcgaaggatgtcaaagataagatgatattgcttctttcagccccataggttgcccaaagaagaataagccaaagccaaaatttgaattttaaaacttaattttgaagttgatttttaagataagatattttcaacatattttttcagcattgacttttaaatcgctgagaacacatatataaaaattttacacaaattattatttggtcgctaataaaccattacagcttataatcagcttttgggcaacctatgagaccctttctttatacagcttataaaaaagaagaaaggaaaaattcccaattccgagctgattcgcagttaggcaacaagccattctagtggtgccacgtgcccctactaatacactccagatccaatcaccggctaattccgaaaattaaattgaaattgcagaaggaattcttctggactaaagaaagggaagagattggctttccgaagagcatccattaccttctgagcatagctgcccccatcgaactgctccttggaagagtagtacccatcaacgatatcttcgatgtcgtaagccagggacttgatctggccgagccagtgtcgcaggttggccctgtcgcttccgaaggagttgttctcggcgtttttcagaagggtttccaggtacaccaaggtatccttgatgccctccaaatcgtcgctgaaattgcagcacagcttcacctcgccctgcgcgacgccgacgatgccgttgatcttccgggcgacctggctcaccgccgcggccacaagcatctcggcgccaaccatgctgcaacggatgggggagctaggagtgaccggagggaagacaccaatgcagatatgggggaggtattgcaaaacggtgttgactagacgaatgaagggggaactgttgtctttgtagtcctcgcgtcgtttttacattattaaatttcatttcggatcaccgattgatgtttcagttgccaactttttgtgacaagtttacaaccacgatcacagcatcttacgccttgcgatgatcttagagtcgccaactacctcaatctagtaaaaactagaccaagatgggttttgataactaaaccgactagcgaagccgatttctagatagctacccgtcttgtgggcaaaacggaaggttttcaggacaaacctacaaagaggtgtcgcactctcgcagcggcggcggacaatttacagcgcaaaatgacaaagatggacaaactaagagaaaactaaaagcaatatgaaaaacgagtcgattgattgatagtagattggttagttataattgaaccggccatgtcccttatataggggttggtcttgccctttacaggccctcctccacgtccaactcgggatagaatccaaaggaaacccgaaacataccttcccaagcaaggaaacttcgagacccggtaaaacagacctggacttggacttgccggtcagaccgaccacacaccgccggtctgaccggccctcaaccggcggtctgaccggccaacacacggcggtcagaccagcctactcggaggaaatcggtagacttctaaactttggcaatttttcctattttaatcctaggtgccaaatttgggtgtaaacatatgcccccttgcctttttgatgaacaacgtgaatctaaaagcatagaacatgtttttggtcttagggcgataatccaattaccggccatagcacctcctaagcgtcttgccaaacgctcaggaagtatttcttcaagtatttctcgttgattgctcgctaaaaacgctccccttgaagtgtctccaaaaaatacacgttccctcgaacaatgccgcataatcgataaggaccttcccaactaggagaccacttaccgaactccctggatcgagtacccaaaggcaaaactgtcttccaaaccaagtctccaacttgaaacaacttcactttcacccttttgtggtacgccttggccaccctcttcttctctttctctatctcttccaaagccttcaagcgtttgtcgatgacttcatcaaggttgtctcccatcaatgtcttgtaatcttcacttgacaaatcatcttgcttgatataactaagagaaccaagatttacctcaaccggtaaaacggcttcttgaccataaaccaactcaaaaggagtgattttagtggcaccatgtatagatatcctatgcgctcacaatgcttcggaaagcacctcatgccacttctttgggtgttcttcaatattcttcttcactagcttcaacaacgtcttattactcgactcggcttgtccattagcctgagtatagtaaggagaagaactcaacaatttaacaccataagattcggcaaaactctttactttcttagacataaaagaagctctttgatccgtagttaatgtttgcggaataccgaatctatgagtaatatgcttcaaaataaagtcaattacctccatataagtcatattcttgagcagcacggctttggcccacttagtgaagtaatccgtagcaactagcacgaacctatgcctctttgatgacgaaggataaatttgaccaatgaaatccaaagcccaacctcggaacggcaatggtttgatgataaggttcaacacggcggcgggcgccaagtgaacattgccgaaccattgacaagcttcgcatcccctatagtattttaaacaatcttcaatcatcctcggccaatagaaccctgctctcctaagcaaccaattcatcttgtgggccgattgatgagttccacaaatttcttcatgcacctctcccatagccactttagattgatcttcatctaaacacttcaataagacaccatttttatttcggcgatataaatcttcatcaagcaatgtgtatttgaacgcttgccgccaaattttccgatcaaccttaagtgtaggatctttcaaatatctaataaaaggaattctccaatcttcttctgtatcttgggcacaaatgtccgaatttacaattaattcggcctttgaatcaattgtggcgtgccccccagtgctctgtccagaaccggtcagaccggccgtgcaaggccggtcagaccgcccggggtggccggtcagattggcggcatgtggctggtcagaccgcccctggtcaccggtcagaccgcctctggtctccagttttaccaattttgcacaaagacttaaaatcaagcatcgacacttctaataccagaaataatcccttcttcacattatagccagatgcttgttgtgccaaatcatttgctctagaattatcatgcctagcaatatatctaatagcaaaattatcaaaattggcaataatatccaagcatgagtcaagatacctatttagtgatccgtccaagcatttgtagactccggcaacttgttgcactatcaattccgaatcactaaacgcttccacgtgcttagctccaatcatctccatcacttgtaagccgaataataaagcatcatattcggcttgattatttgtacaataatattccaaacgaaccgatgcctcataacacatgccattaggtgaaaacaaaactacccctatgccttgaccttctttgcaagaagaaccatcaaaataaatcatccaaagtataacttcaactgagcaaacttttttctcataagcaatatctacatgatgatctactataaaatcacatacaatttggcctctcatagatttcaacggttcataagacaaatcatattcaatcaaagcatatgcccacttaccaattctcccacttaaaattgacctttgcaacatgtgtttaataacatcggcttgacacagccctgacaccggcgtcgtcccggccaacctccacctccacatccgcccgcgccaggttgaaggtggccacccccgcgagtcccgccgccaccatcatggcaagccgccggctttgccagccactcactccggcagcggcaaggcagagggaggttgtggagaggggtggcgccggtggctaggtttccacccccgtgtcgcctaagcgggagacgacgtggggtctttctatagcccctagctatttaggctttgcaacagacaaaggtataatgaggacggataaagtactcaattttgtacgaacaaaattatgtgctcaatttcttctttttttttaaactacgcctttggtgttttcggttcaccctatttagtgtaagcaacccttcaccaagatacttttggttttgggttaattggatccatgtcgctgtaaatgtggtaaataaaaaaaataccaccactattcatgttattggctgtgtgccactaaaattttctaaaattagaaccatgccacttctgtcattattttcgtcctcctctctcacttcgtcatcctactctctcatgtcggcacggggacaaggcgaggcggcgccggtgagcggcgaggatgaggcggcagggagcgggtgcggtcgtggccgccgccagcgaggacggtcgcggggaggttgcgaaggggcgtgcggagttcgccgaggggcgcggccgccgtcggtgaggatggtcacagaggggcgcggatcttgcggaagagctcatcaacgacggggaaggagatgccatggccactcgccgacgccgactcatcttctccccgtcctctcgacgctcgccgacgcctcctcgtcctctcgccgctcgccgaactactccccgctatatgctccccacgcctggcatcaaacgcaaacgcatcgggagctcctcagtcatcgacgacgacggcggatccacgcatctcgccgggagctcctcagacaccagcttcaacgttctctccgccgcatctcgcagaccgacgatgcctcaccgcgccccccggacgcggacctccgcccggtcagtggcaatggcgatggtccaagtgcgcggccgcatcgggaagcaggccacagccttgcttgcacggtgcacgtcggcgtctcgctggcgcggcggccgcgcccgctccccgccgccttatcctcgtcgctcgccggcgccgcttagccttgttctgtgccgacgtgagagagaaggactgaaataatgataggagtggcatggttccaattttagaaaattttagtgggacccaaccgataatgcgaatagtagtggtatttttctaatttggcatatttgcagtgacatgatccaattaaccctctgtttttttgtgttttgggagcatgttagccactaggccagcgcgacaataaattagacagggcaagcgagcagtctattcttgatgatgttgccaaattcattgtattctgtgcttaatttaatttaaatttttttaaaaaacttctatggccactagtgtctctcgcacaccttatttatttcaagcaaccaccaaacaagatgtttttcgttttttttctgagcatgttggccccttggccagctcgaccactatatcatcctcgcagtgcaacacctccagctgttgtttagagcaattttaataatatatttaataatatagtcaactactaactttaaaattacacacatcatcttaatgctacgttcgttacagcctgttcccaaccccaattcctcgttttccgtgtgtacgtttttcacattgctaaacgatacgtttttgcaaaaagtttctataccaaagttacttaaaaaatcaaattaatctatttttttaaaaaatagctaatatttagttaatcacgtgctaatggaccgctccgtttttcgtgcagaggagatatgccttaagttaacgtaatagcccaagcaaattatagttaactaaagatatatcctacacttttaaaattacacacatcatcttaagttaacttaataacccacatataatagttaactgtatatatatattacaccattaatacaaccccacatttatctcttatataatttattggaactcgtactacaactaacaatgaatctatagcctacttttttctatctcctctcctctcttctccacattaagcataaatctgtagcccacttttttctatctcctcttctcttctccacattaagcacaaatctgctgtgccaatttacacaacccgcttacatcactttacatatagtcccctatcgactgctgtagcatataggccctgacccacataattcagtggcagctactcatatccactatataatgccttgatatataaaagatgtacaggcctacatagactactccctgtcattttcatttttgtcaatatcaaactactctaaatttgattaagtttgtagataaatatagtaatatttacaacaccaaattagtttcattaaatcaataattaaatatattttcataatatttttatcttgggttaaaaatattactacttttttctacaaacttgatcaaacttgaagcagtttgactttgaccgaagtcaaaatgacttatagtctgaaacatagagtatatattcaaaatgacttatagttatacatgtattgtcttggtctctcttcttctccaagggagtcttatatttatacccacggatatccccttgtccaagtagaactagggaaataaatatgaatatgttcggagtagtcattatagtttccatatagtactctgcttctccttctttatccggaaaatcctccgtatataaggtatgattccgtataagactcgttaaatggtgggccttgccgagtttaacctaagactattaggtatgtcttatccataagttaaccgtgaaatttggtaaacccccaggtcatcatcggcctaaaatcaatatcggcttcagagttctggaatcggccgatgggagtcgtcaagtcgccagcagtcggattcttggaggactcggttaaatctattcaaggaagcttatctaaaagagaagagaccgagttcaaggaggatgcggcgtggcaagttatttattaattaggaatagtttgttagtttccttttatctttaggaaagtgtgtttagtgtcctataaggtttttatgtttttcttttatttttagaaaaatttctttcttgttcaataaggactagtatctatccatgggtataaatatgtacacccggggtcattctaaactatctctacgatcaatacaatttagtgtatcaccaccttttaccttttctactttttcgacgagtttctacttgtcatggttgtttgcatcggcggggctagggtttcgacactctgatcttgtgcatgtaagaacctatctatcgtatgtctctgttaatctagtcttaacatctcgatttagttctatcggttgtctctcgctttagggtttctaccgataaggtatcggttaaatcgtcttgctagattagattagtttagacatccaccaccctgaaaatcaatcaaaggcttgattgtctagatattatgtttcttttcatacttagtgctgcatcagtacattcgatctgctaagtcgtgcttagaactataatctctagcctgcttgtggattgccaataaggctttcatcggggtttcaactttcaaccgatgagttatctggacattccacaggcttataaggattgcatatataagttgaaataacacaacccttaggtgccatatgaaaccagaaaatgcccaacatagtccgtgggctgttgtgacggcgatactgtctccgttttataaaaaactaacctattatatccggtagtaggttgattttttatgggatggagggagtacaaccgtaggagtattagtgatctatgacctatgtcagccatgtataaaaaataaaattaaaaacatctttcgtgggttccccagtgcactcattcgctttgtttatgcgtacgatttttttttccctctcggtaaggagggctgagcgaaggcgttttcgtaattttctctctcgatggaatcttcctcccttctatcttatctaccctgctgaaatgcaaaaccagaagtccaaaaccattcttttcaaaaaacagaattccaaaactgccatgcccgtatggccacagccggtgccgccgtggaccggcttctacggcggctagccgcagatgctggtcgtttgaagctgccctcgagcatagacgaggatatggcgcaggtacggcggaccctggcaaggttgcaagatgtgctgctaagcgtggaggggaaatacttcaagatgagcatggaggcgcaggaatggatgaggaagatcaatcagatttcctatgacatccaagatctactagatgaatttgaggactgcagtgaggccggatctcaaaggggcagttcctggattgcaaaggttcgtcacaatcctttgaaaaggggtaacccccatagtggaatttcgttttcagattacgtcctgatttaagagattttaagtccttttaccttttttcctttagaaaaataactgtgtcaaatgttcactattaattatttcatccttcaacaaattattgtttattttctgtacaactggctgtgcaaattacaaaagttctactgctgatgacctgaaaaatgcaatatgacattgtttcagtattatagctgttcccatcgttcaagtgactaatactttacctgtaaaagtattgatgtctggagtatttcttatgctattactcctacagttctgcttcatccttctatggccatgcattgtttacttcttagctacgcagtgtcagtgttatattgctgtatccttttagcaagggttctttctatgaccacgcattatttacttctagctacggcagtgttagtgctattgtatacttttagcaagggctctcccctactgttccccaaaatgaatcctttgaaatatgattatcaattgaaattaactcactaaaactacgacttcaatgtataatttgcaggaaatattgttgtgttcctcaagtccttgtttctttaatagtagtagattgcaaagaataaggataatcaaaagaaagttagatctgtcaacagaagattctgttgtattgagtttaatgcagcacagtccatccaaccttaagcattgcaatgagccagtaatttttgatggatataaaatccttgggagggacaatgacagagaaaatgtaaagaatttgctcttccaaaatgatgctgataaattttccatcattcccattgtcggccttgcggggatagggaaaacagctctagcaaggttaattttccaagactatggagaagagtggaactttgatcaacgtatatggatctgtatcgacaggaaattagagcttaataaaattgccaatgatataatttcacaggttaacaaaaaagaagaaactatttcagagtttgtcctgaatgatcaaattcataacaacttgcagtttatgaagaatcgcctccaagaagttctttctgacaaaagcagtttgatagtcttggatggcttgattagcacagataaaaatcagctaattgaattgaaggagatgttgaggggtacagagaagtgcaccaagatcattgtgacgacttccagtgaagtatctgcagatctaataggcactgttccatcatacaagttgcaccctttatctgacgatgactgttggggaatattttgtcagagagcatttgataatggagccggaaacatggaccgtgctgaaattgggaggcaaattgtgaaaaggtgcgaaggcatacctatggcagcgtattctcttggttcaatgatgcgtaacaaggatgataatgcctggttatgggcaagggataaggaaatatgggaattgccaaaagtatttgctaatgggtttgagttacttgcaccattcagtgaaatatatcacagtatgccctcagctttaaaatcatgcttctcttacttgtcaatcttccccataggattcgtaatagatagagagaagctgattcaacagtggatagcacttgacatggttggttcaaagcacggggctttacctgcttatgtgcatggagagatgttcattcaggaactcttatcactattcttccttgaaatccaaaagataccctctgtaagtaacttttttttaagctaaagccttgtctatcttttgtgtaccagtacataaattacacgtgaataataatgatatttttcggtgattgttatcttactccttttcttttactttaatttcgtgtattagcacgtggaaaatctatatccttaaaaagtatacaacattacatttgttgatggttgttaaggtggtaaagcgtcctaagatgatcccgggctgccttatcgccatagcagtaaggcgcaaggtgaggcaacaccttagacactccatactaattaggtggcaaacaaaataatctaatctgatagcaaatcaaagttgtattttaagagcagtacaacacacgtatatataccttgttcttggcaaatcttgagcccactagatggttatagtaattacttaactagatatcaatttattaactaaaagaacaccatcctatgaatacacagagagaggcggcatgggggaagagcaaagcagggtaaatatgtgctgagtactactactaacagggagtcagggagcaaaacagagcagtagagggaggagtatagtagatgagatgtagaggagagggaggaaagaccacaacatagtagcaaatgagggagcagagtagataggatgtagaaaaggggggaggaaacaccaaaacagagcagcagaggaaggcgcaaagcaggatcacgtagaacagagaaagaaacagaggaaagtagaggtggagggaagaggagaaagaagagcatgcctgcttttagtttttgtgtcaatggtgaggaccaggatgatggcgcaggtgcagaggaccaggatgatggtgcaggcatagggtagctgcaggcgaatggatcgccacagcctcaggctccagcgaccctctttctgttgttttcacattgatttggtgggatttggcacgtggggaccttttcaccctaaaagttggcgcttgttagttctgtttcgcgtccaggacccatggcgccaattttttgggcccttgaactaatcggggcaaaaaccgtgtcctcgacttcctgtggcgtcacctttagctgttgtagcgccaaggacgcgatatagacgccataacggcgcattgggtataaggcggacaccataagcaatatggtaaggcgggctagacgcactgactcctggtagcgccttactgtcatagtgacgctttggcgacgccttgacaaccattttgttccaagagtaaaatgcatggaaggtcacttaacttgtttaggtgtgttaggtagatcactctacttttaaaatgcacatttagttcactaatgtgagttaagtgagtcatttacttatctaactatccaaatgagtataccttgtatacatggcatgcaacctacgattgaaaaaattgctttcggacatgtgcataaatcgcatgcgtattttttttccctttctcacaacactagcacttggaaatacacggaattagggaaaccaaatcatttcacttgtaattgttttgatgagttcttctagttctcagtactctctcacttgccatcaaactcgctggtggcaatgataagctatgaatataaacagtgacggaggcaaaatcctaggcggcaacgacgacaagcttaacagcaacggaggtgaaatcgtagggggcagcggctgcggatgcccaaacattttttccaatcctatgtggcacacgtgtacgaggtgtgctcatgtggatagttagatggctaaatgactcacttaactcacattagtaacccacatgtgcatctcaaaagcaaagtgacctatgtgacacacctaaacaagttggatgaccctccatgtattttactctttgttctaattttttatttgaacaaaatatgctgtcacatctagtaaaattactgtggcacagaagggtgggtacataaattatgttaggcatttctattcaatttaaatttcaaggcctatttgaagcttagatcacatgattttttggatgaaacagaagtctaaaattaagttcctacaagaattccatgttccaaagagaacctgatgtgtttaggaaatatttaaaccccttctgtcaggcagaatactaattacattggagtaaatttacagaggcagagacccctcgtgaaatacattacctattctgtacaaaaaaggggagatttatatttccaataaattgacatttagtaagcattaacatagttaaactttgcgatgttgctgatgcagtatggtatcctagttatcctgtcatttatgtttttcccattttatgtttgctcatggtgtgtggtcagaaagtaaggcactgcatgtaaattatgtgctaatttcctttaaaaataagacgttacagcatcatctatgggccttctgtaactgaaacatgtagctacgagtaaatcactctatctaactctgctcatttagtaatagtctttactatgaatgatgtgaatgtttttatatatacttctgtagtttgctaatgatgattgatgactatagcagttcacatggtaaacatgatagcagatcatgattttgttactatattttaatgtgattgcaaattggtagtacttgtctcaatgtgctgagaaacaaatattgctaatttttttcatagaaagaaacattttttttgggtgtttaaactaattacctttgatgtgctagctaaatgcggaagatattcaaacacgcagcttcctgtgcagaagcctgtctctgtcagtgcttactgctaagcatttcaacatttagtccaaattgaaccatgttgttttggagcaaattgtgagattgatatgtttgttttttaggccactggaatcagtcctaccaatcgtcgtacattactccaggtgaatagcttggtgcatgcttttgcaaaatatgttgctggtagtgacattgtaatttctgatggtagagagctatcaaggggcccttcagctgaaaaggtctcttccacttacgctgtgctgataaatcacacaggacactcaacccttcagaaagatgttctcaccggggccagggcaatatcattcaaaaactgtcttcttgcagatgcattcttaagattgaatcatctgcggatcttggatcttacctgttgttatgatctagaattgccagcatccattggctatttgaagcttctcaggtatcttgctggttttggcttaagaattcgtaaattaccaaaccagatgagtagcttacaaaaccttgaggctttggatttctcagaatcacaccttgaggagctgccatcattcattggatcttatcagaagctaacatatttgaaccttcagagatgtgagaaacttcggaacttgcccagaacacttggggatctcaagagactagaatatctcaacttatcatactgccccggagtcagtgaggatgctgactacttatgcagtctccatgcacttcgattcttagatctctctggctgctctgagcttcaacagttacctcatttgtttggtaacctaacaaatttggaggatctaaacctgtcaggttgctttaggctcgagagactgccactgccagattctattacaggactagtaaatttgcagtatctgaaactttcacatgtcatctctgagctgcctgagtcgctaagcaagctggaaaggctccatacgctagaccttactggttatcgtctaccgctatcatcaggcgtccctccaacattggcagacattatacggaagatgcctaatctcaatattatgttgagagatcgttatggtgttgaaatgtcttgttcctccatttctactggtggaaatgggagagggctgcctctcaatctcaaaaataaaaaaattgtggtgttgcaatttcagatttatgtacaccataatattcgatgctcaacagataatgcaaatctcgtgacggaggaaacatctgatgagagagttactctgcggaaaatacgaagcttacatgacctaggcgatctccacgatattcaccatttagaaagtcatgaaaaaatagaggagatgcaagaacaagcgcgtcaacttgttgcttccagtcgtcttgatgaggtaattaaactatcgaacgaatccctttcatttgttctttgatcaagcctgctgaagtgctgatacattttcatccctcaaggaagtcccctcgttttccatatcattcaaataatctttaaaagaaagtaaaaatgtagacaaaacataatgatatatcactccacagaaattagtttaaatcggcgtatacaacttttttaaaaagcaaatatgactgtgaatagcgcacatattcacaatcgtatttgtttatgctgtttcaacttgtataaattgaaaataaagttgtatatttataaaggaacatatcacattaatctatctcattattttttaatgattatttgaatgacaaatcaaatgtttttatgactatttaaatgatatataaagtggggtatatttgcaaggataaactatctcccatatactcggtaagtctctcgttctataaaaaaactcaagacgtgtcctatcacagaaacatttagggcgctcctagtggtattgtgtatactaaaatactatacggtaccccgcacgttgttgcgggatagctgcattcatatgaaaaggactttaaaaaaaattccgctatagaaaagaacaaattaaagcaaaacccaatttgtagttaaacatctgaattatgatttagggtgttagcttttcaattttctatgtatcaaaatcagtaaatggtgtcaactaaagaatcttttaagagaaacaacaaacccacataaacagacaaacatcaagtgcaaaatgcactatgcatatggtcgcaaaaaataaaatataataacataagcatcatatgaaaaccatgaaagtgtgtatatatagttatgggtgccatgcatcccaattcccggagaaatatatactatgataacaaatttaaactattccattaaacataaaattaattaaagactaatgtagatgagtaagtgctaaaattgctcttgttgatggatgggattttgaggctgaaatggttggctccttcaaccgtcttgcaattatcattcatccgtataatttcctacagaacaatcgacgaaacatgaataattccattgcacagaaaataatttttctccaaagccagctgacctgttaatggcatccctaaggctatgttcggttccttgggattaaacccccaaggggaacctatctagggagggattgagtggatccctcccatgtcacttaatccctgtgggatgaattcccttgattttcctaatccctgtcttcaaaacgtttgttcggttttggctttgtgcgcctgcttaaatcccgtgtcaaggcagcaataggcaacagcaacaacagaaggagtactggtgctttcctgcttcaacgttgcacgctgtccattgagtttagaatagcaaaattgattttcaggttggcagcttagaatagcaaaaaaatattgcaaaccgatatttttgtataagtgaaaagtgcaacatgatgaaattcacttcagtaaaaaaatattgcagtaacctcatcaattacgcgaaaatcacattgattaatcattaaaacaaaaatattgcagtatcatcaaggcctgtatccggtttaaggcaaggaggcatcacccaacaaagcttgaggtcacttgacaatacagagacaactaaatacagtcatagtagtgaaatttgacaataaaaaaagaaaaagatgaaactatgtcatgattcacttgagctataaaaataaatgtgagctgccacaccaggactcccagaccaaatggttacatcagcaatatacaatggttcagagatcaacatttgttgctcctgcaaaaagccatcatcttgtacatgtttgctcattcactctgtatctgaaccaccatcctctcagacttcctccaaaagcctgtagagaagaaagaagtttccttcagttttcagttgtaaaatgcaataatttaggcaatgcttttgcgcagtgagcaattgtctcaaatttcctgaaaccagccaactattgatccttggcaacatttttaccaagttttcagtttgacaagtgattgtttgtaagctgtattgtgtgctttgcccaatagctagcagtgctagaaacatggatatgcatatgagactaatgctagcagtgcttcagatatcaaaatgaaattaggacacatataagattgagcaagcaaaaaactgaattcaatagtagctatagtagaagcaaaaatcagtagtctgcagattaagcaagcaatagctgcaaaaatcatgttttacatccagaatttcttcattacatggttctacaagatctactaaaaatggaccaacctaggaaattattttttagaccatttgaaccatgtaccaaaatagttcagatttaagttgtattctgccgactgccaagagctttttacaggcctgaactaaagctgcacatgactcatttttcttactacttcaatttgaactttgtactttgttcagaaaatatggcatgtggaatggctcattgatctacttgtattatgggcactgtcaagtatgggtgagattacaagagcagacaacttgttggaatcacttctgatgaacaacatttgtctagtatttctgaaaaatgaacagcattcacttctgatgcctcaatattattacgcactgcatgtttttgtggcattactattacctgccaactaattttaagaataaaccattttcataacctttatgtacaaatttaaaacaactcacattgagaatcagaaaacgtggtctttcaactactcaactaccaggagaatcagcatattctcactagggcactacaaacagaggatcagatccaggaaggacatgatcagagcttcagactatgttaggaatattactcagaacaaatcaagggagaaagaagaataaatcaagaaaccttgtgaggaacaaagaacagatccatgccctcctgcttctccttgccgccgcaatagcacgaggtcacgagcgcaagaaaccctaacactggaagaggaggctaggggagatgggaagggaatgaactcaccggggagaaggtggccaccggaggagagagcgtgccgttgccgtcacgtcgtagtcgcgccgcgccgtgcagccgtccccgccgcagcgccccctctcattgcgtcgctgcgtcgagaggattttttcctcgccaccagagaagctgaatatttcccggccgatgacgaggggaaaacactggggtgggccgggataaaatctcgcctggacttaaccgaacgcctatacttgcatgggctggtatcctttccacgccgggattttccacggggattagaccccgatcccagccgggaacggcccaaccgaacaagccctaacggggaaacttaggctggctggccacagcatggacctcactcatctacagtaaaaatggtcggagacaaaaggaaatcaaccgaagctggccaatacaaacaatctattctcagggatgcatgcatggttgtgaagataactgagaatagaaggcaaaatatagaatctaacaactagcttgagttcatacggtgtgcttgaggtgaagtaaatacatgtttaaatgtcacaaataatttaagaagaatattaatggaaagaaacggcaacgtaatggagagaatacaaatcacggatagactttacaattgctcttacatgcatgaaggtatatttaaagttgaatgtgccataattgttggtgaaacggttggggctctaataatagcagcaattgg

SEQ ID NO: 38039 - DNA, 16424 bp, Oryza sativa
aaaattacaaaaggggctgtagcatagcggttacagtgctatgtagcacctctagtcctgggtttggctcccaagggagcaaaattttggcttaatcgaagaaaaaaaaataccgtgggatctccctcactttttcctgtaaaaaacattttagaaaattagtgcatacaacaaatgtagagcgaaatttagaaatttacataagaatcttttaaattaaaataatttagagaaaacgactagcgcgatccactaggtgcgttagcggatagctatttatggcccagacctataggcatctgcataactgcattccctcttaagaggttaggaaggtgcacaagaaaagaaataacaaaattacttaggggtgtttaaatccagtggtgtaaaattttggcgtgtcacatcggatatacatacacacatttaaagtattaaagatagactaataacaaaacaaattatatattccgcatgtaaactacgagatgaatttattaagcctaattaatctattattagcagcgccacattgttaaattatggactaattaggtttaaaaaattcctctcgcaatttacacgcaaattatgtaattagtttttttatctatgtttaatactccatacatgtgtccaaacgttcaatgtgatagggtgtaaaatttttttatggaaactattttaccttggggttgcaatgaatttgtcgtaattattttttatctctcttctcgtgcctggatcgcagcacatatgcacggtccaatgcgcattagccaaatatatatttttaaagaaaaagtctctataccccatttatctgaaatacaaagaacatatttatatgcattttatgtactatttatttggttttccttatgcttttttctcgttttgtgtgttatgttttgaaaccattgaattggaggacctagagtccttcatcggtgattcacaaccgttcgttgatggcaagtcacaaaatgcacttccttgatactgtttgtaactttatttgcaaacaattttttattttaagggttaagtctgaaattatagttagctagttactccaacatagtcttttctttaacaaggtaagagtggcttggctttaaaaaagctaaataaaaatgttgcttatttgtttatgcttaaacttcttagcttataaatcagtttatataagcctaaacaaagaggtgttattataatatgaaatggagggagtactatttaggagaacatttgttgaaactcttcaaactttaatgacaaatatttttttcaaatgcttagttgaaaagaggcatgcgtagatttgctttggtgaacactatcagaatattataaacctatatatattagaatttacagatttattttaatgtaaaattgatggtcaaagttttgaaagtttcacttttctaaatatcaattattcattaagagaggaagtatcggtatcttaccgctgctatgctcacctagggcgtatcggccagaatatatttgtgctcggacaatgcagatgagatttgctcgatccaagaaaaaatatctcgttggatgtaacaatgcacatcggaaacgatttagtaccgtgaggtaccagtacttcaacatacattttgctggaccagagcaaatctcggatggagatactgttgcaactgtctgattctttacagtttgtagcatttcaaaatatattctcaaagcgtgtttaccatggattgtgtttatgagctatttttcagaattgttttttaatagggtcaattgtgttattacccctactctcatgtgcaattgtgattgatccctgttttttagggtttgtgattttacccctgtttatttgaaatgaagctatggtttacccctgttatgttaagtcatccaaacggtgttaaatttgtcaaaaatgacatgtatgcccttgcaaaattgccccatgctctactgagaactttgcaattttactcttttttttttacatcaagaacagaagttaataggattcactggatggaaaaaattcaccaaaattattcatcaatacagtcatgcaccgggaaaaaaaatcatcgtgcaaattcctggcaaatagtactacagtactgagaccggaaaaagaaaaaaaaagaaaagaaaaacagaggcctcgctgttgttatttggttcaagggtataatggtccatccacacttttttcagtaatttaatctatttttttactctcttattttagggccaccaaacgtccatccaaagcaagggtaaacggaagcttcgtttcgaaaaagtagaggtaaaatcacaaaccctgaaaaacaagagtaaaattataattgtatatgaaagtaggggtaagaacacaattgcccctttttaatatagaatcattaaaatcttgtgaattttatggaacttgtgggaaaaaaattcagatcatcatccagatacatgatgaaaaagagaaatgtatgaagaagacgatgaaaaaggcgatgaaaaaggcggctagtgtcaccggtacgcacataccttcacaatatatatgctagtctgaaattgtagttgttcttccgtttttcttcgcgaacatcattccgttgattcgagaggtagcgttttgatgcaggcgtgcaatcggtgacgctgtgtggcggcaacaggaacctgctgatggtgatcggtgagggtgtggacaccaacaagctcctgaagaaactcagaaacaatgtaggcgccgctgatatcgtggagacgatgccggcggaggccgaagagttcgaggcagcagcagcagtctccggaagcaagaacttcatgaagatgatgccgcggtggccgaagagctggtcgtttgtgaaacaagaaagcttggtcgatcaacttaacttcccacgccacagtttaggcgtgtgctaaagttgtggcatggctagtcttatggtgaaaatagggttgttctttttaataatgaaaaactagcatggtagcccatacagattacgcggctagcattattatattttctcttatataatagcatatatgttttctcattatattattcaaatatattaaaatgacaacataattctaaattttgcaataactttacaaaactactaatgtgtaatattcatattgtattttatatacgtgttagttattaattatttttaatatcaaattttagttaattttctgtaaattgtatttctatatagactctatgctcttgtttcaatattatttatttttatttctgaatttttattatttctaattatatttctatgtggactctaaactcatctttcaatattctttaatttttaatttcgaatttcagttacttctaaattgtgttccttcatcgactttaaactcttcttcccatgtttttcttaattttgaattttagttatttgtaaattgtatttttatacggactctaaactctactttttaattttattatatttattccaaattttagttagttttaaattcctatatggactctatactctacttctaatattccttatttttaattccaaatttctattttttttcttaattgcatttctatatggtctatatactctacttctaatattccttattttaattccaaatttcagtcatttcctaattgtatttttatatggactctatactctacttctaatatttattattttaatttcaaattgctgttattttctaattgtatatctatatggactctatactctacttctaatattccttatttaattccgaatttcagttatttcctaattgtatttatatatggactctatactctacttctaatattccttatttttaattccaaatttcagttattttctaattgtatttctatatggattctactctcctcttctaatattccttattttttaattccgaatttcaactatttctaaattgtatatctatatggactctagtctcctcttctaatatttcttattttttaattccgaatttcagctatttttaaattgtatttctatatggactctgttttttctttttctctgattaatgtgagaatttttaggccatgagagcaaatgtggaggcttttttttctattcctttaataatataatagatagcattgtttggttgttagtaactttgtgttgtggcaaattgaactaggcggatgtctggattattgccactgaacttgccacaagctttagcaattgtggcgaatttttgtgttttgtagacaaactttgaatattgttaccctaatataacaaaagaggagagatcatctaaacccaacatgtattgcgaaaatactatgcaatagtgtcaatttgtaaaataatatattagcgatacaaataacgtaaaaccaaaaaaaagatgtaatactccttccgtattttaatgcacgacgctgttgatttttttatcaatatttgaccatttattttatttaaattttttttgcaaatataaaaatatctatgtcatgcttaaagaatatttgataataaatcaaatcatattaaaataaatgataattatatatatatttttaaataagatgaatagtaaaacgacgtcgtataataaaatacggagcgagtaatacatatgtatcctcaggacgagcgagcttagctcgtcgacagcggccgccctcaccccattgccggcttgccgcatctcctctccagtcgcacagccacccactccctgaatccggcgctgcctgcgctatatatatctccattcgtccagtggcttaattaactgctccggctgttacatctaccccgagtgtgagcctcccgcttccgtgctccgctcctctccactccgtcagctcagctcatccgtctgcccgacgtacggtgacgcccacctctgctaggctagggagcgacagcacgtaggaagaatcgacaagtcgaaggcgcggtacgtgttcttttctgccgagtagagctgctatgtcatgttggagttcaaattatatcttattactttagcctgtaaaacaatcaccttctctaattgcaaaatattaatcgatccactgacatgtttttaaagccattgaaattgattgctctggtcttcttcttttcttctcttcttcctcttttgcttcttcttttgcttctttcttcttcttgcgtgagatacctcacgaacccttagtagcgtcaaaattgatcggacgattagtttagggttttagggttagagagaattcgggttaaccttttgcttcttcttcctttttcttttatagtgacactcgtggttcgggggtttgtcttcaattaaaattcaaatatgttttgtacgataaaaaaatattttttatctcttagtttatttcttgttaggaaagaaaaaaaggtaggattttcccttctctaattttatcggcactaataaaccgataaatcaacctaacatgtcaacgccacgtctcttctcaactgagctgcgcgttctcaccacatcacatcattatattaggtaattgagggaaaatgaaatagatacattagttttctattcatgacccatacagtagcagaaaccattagaaggatatgataatagagctaaaatgtctcatagatgaacgatacgagtatatctgtgacgacaactcgagcctgatcttgcctaccagccccttctatgttcttcagcgcgtattgaaatttcctgctgcttcattcgcatgtactctatttgtgtgttttagccttagttattttttggccatgataattcggactggcattgttggaccacatagtgaatccgtacatacttggattggcctgagaaataaatatagttagttaatgagggtaggtattgttggtagtcttaagatcacagataagtacttaaccacaccgttatagcacttccccttagagtattctaagggtatcgaacacgaggaacgatctataatcagcattcaatccaaggacaacagtctagaataaattggctagagaggattactatgtcttttaattagttaattaagttaacagtaaaagaaaaaaaagtacgaattacccccatggagtattgaatgagtatgaattacaccctaaacctgaaaactagtcatttttcactctcaactatcgataccggatgaaaaagccctcgagcagctttgcaagcggttttggtctacgtgacagtccagttaacaattcttttcattttaaatcagtgggccccacatgtcagtctctcacactcttttaccctcacctctctatttctctccaaaatcctctctcttctccctcccttacctcgaggatgacaacgagcagagctcggggcgatgaagggggcagtagaactcgggacgatggcaggcggagtgggcggcggcgaagagggggcccacagccaccagcgcttgggacggcggtgagggcgaagtgggaggcggcgaagagggctcccgcagccacggcgctcaggacggtggtgagggcggagtgggcggcggcgaagagggcgctcacagccaccggcgctcaggacggcaatgagggcggagtgggcggcgacgaagagggctcccgcaaccactgttgcttgggacggcgttgagggctgagtggacggcggcgaagagggcgttgcaatcaccagcgctcgggacggcgattagggcggagtgggtggcggcaaagaggaggttcgttgccaccgacgctcgggacggcggtgagcggaacttagggacaagggggcagcggagctcgggggcagcggagagaacggcggaggatggagctcggggcggcgggaggagggggcggtggagctcggagcggcgggaggagggggcgacggagtacggaactccgagcggcggagggagcacccgtagccggcagcgcgtggcttgtcaaggcaacagaggggccacccacaaccagtgacgctcagggaagtggaggggggcggcggagcgagccgcgaggacagctgcggaggaggcacccgctgccgctgacgcgcgagccgcagcctccggcatctaacgagagagagagggggtgagagggaaagtgatagatagaagagatatctgataggtgggccctatcttttttaataaaaaaacttgctgactggcctgccacatagaccaaaaccgcttgcaaagttgcttggggtttttttatctggtatcggtagttgagggtggaaaattactagttttcgggtttacggggttaattcgtactcacccaatagtccggggggtaattcgtactttttccaaggtaaaactccatcgaatgcttcgggaaccgaccctcctctggtctgccaggctgagtccggccattgtcacaccctgaagttctccccctaagcctaaaattgaatttataaatcaccctaagaaaatgccggtgcaaatcaagagaaaaccctaagaaagtaatacaaataataatcgaatctgacatgtggaatttttcttgagttctacatgtcgaaattcactaacaggatttttagtggaattttcagagccctagaaataattttaaccaattaaaattgagcataagcaatatttaaatccctggaaattcctttcttcctttttcttttttctttttccttttcccttagtgggccgccggcccacttcccctcctctctccccgtgccttgctgggccggccggaggccacgccccagctcagcccgcgccccctcctctctcccggggtcaccgacaggtggggcccacctgtcggacccgtctcccacctcgcgccgcgctgccgcgcccgtaaccgccgccgcgcccacgcctccacctcctctgtcacgcccggaaattcactagtaatttccgaacttatttgtgcataaaatcctcgtctaggaatcaaccgaggtacacaaactgacaatttaatatacagattcatcaaactaactaaaacgataaatacttacttaagaggcacttagtcctcaccatgaagaaaactgcagcggaaaataaaatctagcgaagctccggctccactcccacaggcagctcaactggggtataagccaaacgtcttccccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcaggaattttaatcaacactgaacagcacacccatgctgcacaggcccaaccatcctgaacaaccatacccggctgaacagatctaactccaaatcaggagctaagcaaattattacccggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcaccccctcataaaacaaggcatggactccccagcgacccccgtgggcttatctccgccacttctcagtctggtgctccgaaatgaatcatgttatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtaagtcataagttatcccaatagtgtgccaatgtttctaagcatggctaagcaattatatctagtatctagttgaaccaatatatataaagctcaactagtccaattataatcacccaaggtatcaaggaataaagtaatcaagatcaaaagggccataacaaagaataggttaattccacccaatgacattcgaaaataaatgcacagttgaaataaatagagaatttaaatataggatcaacatgctcaaaggattgtgtttaggatctgtgtgacttaccttgcaataatcggtcttcaattaatcttctcgaatacttccggcgcactcgcgaaccttcgcaacgacggaaacgacaagctatcacgcaaaacgaggaaaaagactaataaaaaccaaataaacaatacatataaagtaaacaaacatgtaggtcatgattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatataatttttcaacttgaaccacattaaactgagttcaaatgaattagttatgaatttttaaagattaaatcggattaaaacacttatatggatttttattgaattatgacgcaataatgaattatttttgaaaaggaaaagaaagattattgcgtcagcggctagggtttgcggtggaccgagcgcacggcaacggttcacgggtacggacggccgagatcgatcctatccaaaacagacggccgagatcaaccggtccacgaccggctcacgggagagggcgacgatgacgtcaccaccggcggcggcggctcggcggctcgggcttgcatgctcgccggcgaacgacggcacggcggcgcgaacggaaggcaccaacgggtagagcgcaacgcggcgaactcaccggtgaccaaaacggcggcggaaaagcaacggacggcgccggcgacgaggaagaagcggcggcggagatcgggtcgacggcggcgacggtgctccggcggtcttcggcgggggcgaaacagtggacggggacggcggcgacttggcgatcccgacggtggccttcccgagtgacgacgacgaccgtagcgacggcggcgcacggcagaacgaacggcggcgacggcggcgcaaaagctcacgaggctagggcgctacacacgacggcgggcgaaggcgagagaggcggcgggtagcggagacaccgggggtgcttttaaaggggcaaggaggcggcggcggaggcccacggcgaccggcggcgggatggaaaggttgggaaaaacgaatccgaattaaactcgaatccgcctatttccaaagggaattgatcggagtttctataagagaaaaggaagaggagatcgaggagattatttcccctcaatcgatttcaccggagaaggaaagacgcggccaaattggaaagcggcggcggcgcggctcggctagggtttcgggcggcggcggccgaaggaggaagacggctccgacaggtggggcccacctgtcagcgacagagagaagagagcggcggctcggcggactgggccggactgggccgagggagagagaaagagaggttttgggccggctttcggcccaaagccaaaagagacttttaaaaacctttttcaatttaaattattcatgaaatgcaattccatttattaacaatacttccttagctcaaataagtcccagaaaaatctaggaattatagaattaagcaaagtatttaacaaaattttatctagcccaattttatattgagatttaacaaattaaaattatatcttttcttttaggcttttaaaatcatttctaataattccttttaaacaacaatttataatttacggatttttaaacaagaaaagctcctaacaattataattagatcattaatgatcaaataattactgaactgttctttgtatcatttaggaattgagctgtgaaaaatccgagaaaatttcagagagttgacttaatcatggagaatttaataaaaattaaatccatccatgctttatatttaggaaattttatttcccacatttaacttcacttgtaaattaaagaacatttaatataaattctattaataatttattaaataatttataaatcctaaaacgaaaatcaggatgtgacatcctctgggccacgttggccacgcccgcgcgtgcgccgcgtctcccacgcccacttccccctcgctgccgctcgcccgcgctcccgagacggtcgggattcgattttcgaatcccgcctctctctctcctctcccactcccccacattggccggcggaatctcgcccctaccggccacgtccgagactcccctcccctatttaagctctgccgtcgtcctctctctctttttccccatttcgccgaactcccttgtgctccccatcgctcccgcgccgtgcacccactcgccgccgcctttcccgccgctccggccgccgctagtcgccgctaggctcgccgccgcaccgcgccgttgccgccgtcgggttcgcaaggatgaactccaccccgtccgcctttcctccgtcaggattcgtcgccggaattcgcatcccctcgcgctacggtgagttctacctctaccgccgccttcggccatggatgccggccgccgtggttcatcttcctctctctaatctctctctcctccttccttagggcaccccgaagcccgtccgctggttgtcgtcgtcctcccgtggcttgccgtcgccgttcgccatcgtcttcctccgcgccggccaccctcggtgaggcgtcctctcccctctactcccctccctctccttcctagccaccgcttagcgccgccgccttcacgtcgcctttgcgccgccgcctccgccgccggttgccgtcgccggcaacgcgtgcgcgcgcgccgtcgccatcgtcgtggccggtcggccggccttgagccgagccaagccgggtcgccgccgcccgtccgatcaaccccgggggtgatctgggccgttggtcccgtggaccggcggtggaccacccgcgtggtcccggtccacggtggaccgcccccccttgagccgctgccgtgtggggcctgtgtgccggcgccccttttccctctctcccgagccgctgactagtgggccccgcatgtcggcgccgcgccccccttgatgacgtcagccctgggatttattgctcaataaatgatttaaggactttttgttatagtaataaacacagtgaatcttctaaaattcataactaattcatccgagctccgtttaagcccattcaagtctcagtaaatcaagaaaaatgtgtagaatccattaaaaatggttttgttccatgtttcagtagtcttatagcctatttgcaatgtttgccttgtatgtcgctagattccggttcttccgacgctccggtgtacttcgaaatagtcgccgaggttcctccagcagcagagcaaggcaagtcatggctgtcacttgaacatgttgatcctatattgcaaatgctctattgtttttcttcaaatattgcattgttttataatgttactatggggtgtttacctattggttacagccatgccattttgatatcatgctcctttgttagcttgggttataacatgaatagattttggactaggaattgcttagccatgcttagttccactagcacacaatggggaaagctcactaaaatatagcctttaggttcaattggtaaggttggtttagtaccaccgttttggtgttggttaattaaaatgaatcacatggtgggctgtgggtgcatggttttgctagtcgcacccatggcagttaaggatcggttcgcgtgatgccctggaagaacttatcgtacttaccacaagctagcgtgggcaacggctgggcttgtagtgtagcttttctctagctgacgcatccaggcaagggttgggcctgttgcaacgtgggatagcgttggacagcggatgatcaatattaattaattattgcaactgtttaattctttcaacttctgtttataaatgctcgcttcatgcaaatgaaccactctagctctcctttgataattccctgcatcatacccctattccagtatgacttgctgagtacagtgggtagtactcagtcttgctctatttttcccaaccccagagtgcgagtatgtgtccgatggcgggttctccgaggagtaggcttcgtccgtgctgtcgagggtgcctgtggagtggtgttcccgctgcagttcaagtccaggcttagccccagttatcttttgtttttccgctgcatttgtgtaagacttttatgatgtttgtaagacgtggatctgaatgtcaacattgtcgtttgtgtaccccggccggtcctggacgatgattttaatgcacattctgcttggaattctattcgggaatttttgggcgtgacagccatgagccctacgatgtacccgaacatggaggaatacgaaggacggacatggctgtcaccacctgtcgtctacctcacttttttggagcacagaacaaaccaagataatttttaacctagacacaacacctaagttattaattactagctactctagccttgcacaagaacttctttctttatctagagtcctaatactagggcactcatttgcacactaagcaaaaatctgtactgatgagaatatctcacttaaataaactaaacataaaggaactcaaacacttactttgataaaggaagcatccgccgaggtacaaagcgagagaagaaggccgacaattccggctttttctccagaactccattggaagaatgcagacactccgattgtaacaccctgaaaattcgaccgacaaaatcaaaactctaaaaatgcggattttcaaaaactttttaaattaattgcatcatgccgatcttattcgtctattttatctggatttgatctcgaagattattaatcatgagtaaagaatagttaattaggaataaaccttaaaaacaaattggtaaaataaatacaaattaaaataaagattaggtgtggatagaaataaataaaatattatcgcgaccatatttggatcaattaaatttaaatatgacggaataagaattaaccctaattaaaactcaaataaattatataaaaataaaatatgggtaatattaatctagggtgaattcattagttaagataacacaaatattgagtaaaatgcatatatgcaaaattaggaattgtggaatcaaatttatatggaaaatacactaaaatcgggataaataggaaaagtcactattcatcggccgccaggtgttcgacgtggtcccctaacccagctcctccttttcccccctctctctgtcgccaccgtcaccacgcgccgccgcctcgcgcccccagccgccgcgcgccgtcgccatcgtcgcctgccgccgcgccgccgtcaccactgccgcgccgtcgccgtcgccatcccgtcgccgcgtgcgcgttccatcgccgcctcgagccgtgccgctgccgcgccgcgcgccgtcccgtcgcctcgcgccgcgcgcccgctgcctcgcgccccgcgccgctgccacgtgccgcgccgccttgtgccccgagccgcgccgcgccgtcgtcatctccgcccgcgcgccgcgcgccgtcacatcgccgccgtcgcctcacccccctccaccgcccttcccttctcttccctctcccccttatcctctctttcccctataaaagcccaacattctcccctctccccactccatcccctcctcctctcccttttccctccccttctccacgcgtcgccgtcgtcgtgccgccgcgccgccgtcttcgagccgccgcgccgccgccacgaagccgccgtgtgtgccgcgccgtgcgccgtcgtcgtcgccgccgccgtcggtgagccgctaccttccccccctgtttgtcgctgtgccgccgggtagagagagagccgagagagagggaggaagggagaagccgagggagagaaagaaggaaggaggagagaaactgggagggagagagagaaggaaaaagaaaagaaaagggagagagagaaggaaaaagaaaataaaggagagagagaaagaaaaaaaaaagaaaagaaaaagaaaggaaggaaaaagaaaaagaagggaagaaaaagaaaagggaaataaataggaaattagagggagattagggaagtttagaaaatttaaaataattagaatttagttatagattagttatagtcgtagaattgtgaaatttaatataaattatggattattcttggtaatttctacaagaaatcaattcgcggtagtagtttaaatgtaattaagaactaaacgattagatgaattcttatagactgttatagattattttgggtaatctctataagtaattgattcacggtagaaattcagacttaatcactaggaattttagacgtatattatatttagtcgtttagtcctagactaaaattaaatcgtataatattataagataatttttggattccgtccgatatttagcttgcgatagaaatttccaacctattatatggatataacgatcgggtagattaaattaaaaacttatgataacaaaatatttatacccacaaaatagtttaggatatataaatcgaaattgggtttgccctagtacgcgaatagtaaagttaatataaaagaatcgaccttgagcccgagggagttgcagatccaagtgaaggccaagacccccaagaccttgagcaaggcaagtcatcactattccttgaacatgttgatcctaattgcgaaattattttgtttataaataaaattgcatgcaatgatgaacatcctacttgtgattatgccatgccttgattattgtttatccgttattccttcgtaaccatgtttacgtatgagtccctagtcaattatgacaattgcttagaaatgctattctaggatcatgcatactcatatttatcaaatgctaaatgcttgggcaattacctttgggaaggtaattgagatgcggcatgtggagacatgagcgccacattgccatgaaattgataacatgatttgtgaaaggaaaataaagcgaaaacaactgttttcgactggggcggacggatgatttgggtggtatctgggaaaggctagtaccgtccccggtcaattaaggaccgagccatgaagttaagcatgaaacgacccccgtacaacc

SEQ ID NO: 38040 - DNA, 5597 bp, Oryza sativa
ataaaattaatcagaagcgggagatgaagcttcggaggatccctatgcctactaccaggagggagatgaagacgatgacgctcagtaggtcttagtacggtcgttgcctgtggcaatggcatgccgctgcctgaattccgctgccttatctatttctgcttttggatgtattccggaccgctcggtccgatgatttaagacaatgcctacgggcttatgatgtaataattagcactagactctcgtgtatgtgcttttggtatttcagctatgaactcgtgtgtaccagactacttgatccagggaaatggtattgtttacacgaatgattcctgttataaaaacaggggtccacagagctggcatcagagccatacgactgtaggaaaagaccaaaaggcgccccaccccttttctaatttggccaagggagaaattcccatttagtaatactttcaaaaataaaaacgctatgtttacaaaactcggtacgattttcatcttactcttaactattttctttacaaaacaagttttactctcaactgactttgggtttttcttaaaattagatggcagatccggattcacccgctacctgggagttgagcttacctcaatcagaggggtatgtcattgagctgcatcggatgttgaggcgtctgcgatactctgggttcccgtcataccgagtgagacagtgtggctcagtttgggaggctcgggtcgaggttcacccctgagtcccttccgagttggactacagctttcagacacgtcaccaccgagacctgccagagaccgcgatgcaggatgcagcccgggaggccttcctccgactcagctctatccaccgagctgagttagcgagtaccgagtttgctcatcacccgttccgggaggagagcaactcagtttgcacagttcaggacacgccctgctgctacaacccgatggtgactcggttgtcacgatgggctgaggcagtaggtgactactacgaggaggctctgttggagattgacgaccaccagagacgtatgggagagctggagactgagttgactgacctctcagtgcagcagcttcagttggaggaggagcaccaggcttggggcagtgagatagactcactgaagacacagctccaggtccacggcgaccagttccagcagttatttgaccagtacaacgatcgccgcgggatgatggatactcttgaggaacagctgagagagagtcaggagcacgtcagccagctggaggagcagcttcgagcagccaagatcagcaccacaggggcttctacttccacagcagtaggccgtgaccgctacttcttcctcacctcgccgtacccaccggcgttccacgctcttctgggagaggctagtatgctagctaccgagtcagcaccttacctagtggtcccgacagcgacaaagccacctgtcccggagatggtgcacactccactgatccctacaccttctccgcagctgggttccagtttggagactccgatccaggttgactccgagacagaggggaccgacaccgagccagagatcgagccagacatcactgatccttcagaggctgagacccctgttccccgcatcaccttcctcggaggccctcgcaccctcagcactgctcgcaagagcacacgacctccgggcaagaggcccaagccagatccagaggccactacttctgagccgtggggactcaggtttgcgcgtgctagcgaccaccctctacctgccccaggatcctgcggatggctggaggactagactgacagactccttgcagcttcgatctcgtatcagatggtttttggatagcatgcgagacacacccccctcttacctagattgacgagtagattgatgattagtttgatgtatcttttggatgaaccttatttggactgcgtatgtatgcagtcgattgcatcatgatttatgtaccatttgtgaaactctgtgatgttatttatgatatctattgttgttgtgttatgacggagcgtggggctcctcaccgggagaccgcgcaggcccccctttgccggttcggtcgggggcgctaagtgaggttcttcgccctcgatctgaggaacgtcagcgagagatgaagcgcacaagacacgggtgacgtagacaggttcgggccgctgagaagcgtaacaccctactcctgtgttctggtggatctgtttgtgaaggaatacagagagctcgagagcgagagagagttcaggctctagaacccattcgccagagtcccaaccccccttcccctaggcctgggcctcctttttatctggtcaggggtcaccacatgggcctctagctgcctaagaaaggaaacatgctttttacaatcagggctagtctacagcaggaagtgacctctgacaagcagagcacacgcctcctgccccgctcgccagcttttccggtggacgcccatttcaaccttcattcaatggccagcgacttccttgccatgcttgcgctgaagcctggaatggatttgaccgggactgacataccaactccaggagttagcacgccggctccggctagggacgagagccaggaagctctcatcattccgacgggacggggcgaggcgtgtgacaggccgcctgttgccacctaacccgagatctgaccggtctgtgaccggtcacacaccacgaccggtcacagaccggataagcgtgcgctgcgccgcattaaatgcggtgtggcgcgctcgtccaacccgctataaatgcggttaggtgagtcccgctgtgctcacctaacccacacacgtggcgccaaaaccacagggggtcggggcgccccagcccccggggccgaaacgggggcgcccgagccctcggggccgaaacgggagcggcccgacccctcggggagacagagggaggggtggccacgtcaccctcgggcccgaccccccccgagggggtcaggccacgtgggcgaccgcggctacccaatcctctagtcacgatacccccggccccatgtcaccgacagtaacccccggcgttacgccagggcgatcgcccccctcgagggaagcgctcgggcgtgacgccactccttaggcctggtgacaggtggggccggtccctacaggcgggcagaaacccagcggtcgcaaatcgcgcgcattggcaagggaaaaccgaccgacaataatgagcggcctctttaagaccgctacatcactcgagcagcgcgcgaatcgggacgagccggttcgtttcgcctggagacatgatgatggcgcttttcgcggttggcgagcgtagttaatgcgcgcacaatctgccccatctcaaccgccacggccgcacatctgccgcgtgcgccgcaaacgggcgagtggggttagtggaggcgtgggcgcgagaaacgagggggcgaggtagtgggcacgggaagcgaggagccgggcacagcgttggcaagggtgtaaagatgccgaggaagggattcgtttccttcctctcgccactcttccccttgccttcgccatttgtgctctaactcttcgtttcctgtgccctacccttgccgcactcgctcgctctcaagctcctcctccgccggcgtcatggcacggggctccgcaccgctcgacggtagcgtgcttccgccttcccgcatcgtgagcgagaggcaggccgggctgccgcgccgattcatgccggaatctgccaccggccggggctggtcccgccattctctattttcttcttcctctctattttatgatctccagatggcgcacctcacccccaatgcgataatgacgttggccatcttcgcgcacctgtgcgagatgtttataggggtgcgtccatctctccggctgttccggtggttcttcaccgtacagccggtgtcgccgccgacggtagtcggtgactgttacttccagccgcgggggcaggtgctgaactgctacattccctgcgtcctccgcaaaaagtgggacgactggaagagcgattggttctacacccccctcgccgacgaagcgcgcctccgacttccgagctagcccccggcgcaggcctccagctggcgggcggcggtagatctgggagacggctacgacgccgttcttgaccgcctagcgggtctgcgatcccaggggctcacgggggccatggtgttcagcgactaccttcgtctccggatcgcgccgctccagcggcgcgcccggggcgcctgggagtacaccgggcccgaggactacatgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaacatcctgaccatcatgcaggaggtcggggcgtcgggggagcgggccccccgaggccacgatggcacgggcgggagccgcaggggggaacaatctaccccgggaaggggtcgtgcttctgggccccgcgatgggggcccgggaggcagccgccctgccgacgcccggggaagaggaagcaggagggtacccctcccccatctcctccccgagggggcggggcggtgcgtgccaacagcaggcgcccggagggcgccgtgccgacgccgcagcccaagggggagcgaaagaagaaacggctccgcaagatggggggaccaagccatgccgggggaacctcatctcgccctcgaggtggttgtttagccgacctccccgcaggttcgtccccgcgcccaccgcggccgtattcattctcccatcccccaaggcgagttttcactcacccgtttctttttgtcttctggtttttcttctgcctcagcgagatcccgtcgcgcccctcccgccattccaagtccggccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggccagactccgccgggccggggagcctgtccgagaggcagaggcggcgcgcgcacgccaggcggcctgccaagcccccgacccgactccgccggaggcgacgacgacttccgaggccacccacgacgaggccgcgggcgcgccgctcgggcccgacccctcgggcgacgcttgggacgagccagcttcgggggacgcccccaagtccggcacgtcgatcggcgggccgagccgcgcagcacccacctccgggaagccgaggaggctgcccaggaggccgtccgggttcgcaggctgaggaggccgctcgggaggaggccagactccgccgggccggggagtccgtccgggaggcagaggcggcgtgcgcacgccaggcggcctgccaagtccccgacccgactccgcccgaggcgacgacgacttccgaggccacccacgacgaggccgcgggcgtgccgctcgggcccgacccctcgggcaacgcttggga

SEQ ID NO: 38041 - DNA, 20880 bp, Oryza sativa
agcacggtgctagacaggttaagtgcccagatggaggccctgcaggcggagcgggcggagctcgacgcggcgtgggcgcgcgtcgaggaggggcggcgctcggtggaggccatggtggaggcgggccgcaaggcacaccgccggcacgcctcacagctcgaggcccgtcgtagggacctggcggagatcgccagggaggtggaggaggagtgggagactgccctcatcgccaccgccgtgctcgacgaggcgcgggacgacctccgcctccaatacgggagccgggcggcggagctagaggagaagctcgacgccgcccggggagtccttgacgccgccgctgcccgggaacggcgggcggcggagaacgaggcggcgtcccggcagcgcgaagaggcccttgaggctcgcgccacggcgctggaggagcgtgcccgcgccctggacgcgaaggagagagacctggcggaccgcgaggccgctgtcgccacccgggaggcaacactggcggcgcacgaggccgcctgcgccgaagaggagtccgcactccgcctccgcgaggacgagctcaccgagcgggggcgagctctcgaggaggccgaggccgcggcgcagcggctggcggacagcctgttcctccgcgaggcagcgcggggggagcgggcgcgccgcaatctggaaggcgcccgcgccgagagggccgcactggatcagcgggccgcagagcttgaggcgcgggcgaaggagctggacgcgagagcgcacagcggcggggcggccgcgggcgacggcgacctagccgcctgcctcgcagctgccgaacacaccatcgccgagctgcagggcgcgctggactcgtccgccggggaggtcgaggccctccgcttggcgagcgaggtagggcctggcatgcttcgggatgccgtctcccgtctagaccgcgccgggcggcaggcgggcctctggggcgggcggtacgcgaagtacgccgccaaccaggggggcatcgcccagcgcctctcagagatggccgggaccctcaagcggctccccgaggagctcgaggagacgatcaagtcatcctcgagggacctcgcccggggggcggtggagctcgtactggcaagttaccaggccagggaccctgacttctccccgtgggcagcgctggaagagttccctcccggaaccgaggacggcgcgcgcgcgcaggtctgggacgccgttgaccacattgtccacagcttcgagggtacggcccctcggctcgcgttcgcccttgactccgacgaggagggcggtgatgacggtgcggacggcagcgatgacgaggccggtgacccaggcgcgttggagtgagcccccaggcccccgccaatattaataacttttccttcttcttccgaggccttcgggcccccttcttgtatagactgatttattctgcaatcaagtaaagaggaaatttctgcgtcagttctgtttgttgtgtgtatgagacgaggatggtctgtgccgcggtccttctgtgtcttggcttgaacaagggctcgtgcccaggccccagcctcaaacggcgcgggtcggggctagttgtcacgtcctgataaattcatcccgaaataaaaatcattttctaaaaggaataatagaattaattaaaattcgaaaagaaattgacaaacactaaaatacgtaccagaaaaattcgaatgtggcccggagaatttttgttaaattctccttggtctaaaaggagccctcaaattttacttgaattttcagagcaccggaaataattattaagcaacaaagacaattatcaaagtttaataaaaagaaaacctaaaaataaccctctccttccctttggaccaagtctggcccaaggttcctctctctctctcggcccgcggccaaagtctccctctcctccctctctttccctcctctcccgggcctctcctccttctcccggcccactctacctctcggcccactccctcctcctccctctccctcccgggccgcctctccctcctctcctcctgggccgcctcggcttcgcccggcccaagccgagccgcgcctccctcccgtgccgtgcacgtgtgcgtgcgtgcgcgccgttgccgcgcgctgacgacgcgcgcctgaccggtgggtcccacccgcccggtcgtctccttcctcccgcccggcctcctcctctctcctccgtgaaccctagccatttcctccctcaaatccgcttgattcatttggctaattccaaaattgattagggggttttaatccccattgattcctcttcaattccccccaatttcccccttgaatggcgcccccaatcgtcgggaacagacgcgtctttcccggccgccttccatggccgccggctgtgtttcccgtcgtcgttccgccctctcccatgcccggcttgcttccctctgctataaaatggaaccccctccgtgcgttctctcgttttagccccttcccgagctcccccgtggccgcaccacctctccccgccttctccttctctctctccggtgccggccggcctccagccgcctctccctcctcgcccgagcgccgtccggccgtgccgtcgcctcctccagcgtcgcagccgcctcctctcccacggcctgccctccgtttcgcgcggtgaccaccggaggcgcgttcctgccgtcgcccttctctttcctccgcgccggccgcctccagccgcctctcccgcctcgcccgcgcgccgttcggccgtgccgtcgcctccctcggctctgcaacaccgtccccttcaccggtctcaccgtttcctcgccggaaactcgccgtaacggtgcccccgccggcaaccagtggcattggtgccactgtactccctccagccggctactgtccctcatcggtgcggcagccgtcgtcgtcaccatcctccctcgaatcaccgcgccatcctcttccccggccaagccacggcgtcgcccgtatttcgccggaacgccgtcgcccgcgccgcgtctccctcggtctcgtcggcacccactccggcagcccctttcgccgtgccagtgcgccggcggacgtcgccgtctccacctccggcatcgcagcggcaaggtcgccctcggcctcgcctcagcttcgaccgaaccccgccggtgttcgtcgtcgtcgtcatcgttcctcctcgccggctcgtcgtctcgcggcgccgcctccatcgtgggcatcgctgcggcgtgtcccacgccgtcctcacctccgtgcagctgctgccggctgccctcgtcgcctcctcaccggccccagtcgtcgtcgtcgtcgtcctctcgtcgttccaggtcgttgtggcgttcgtccctccgtcgagccgtcctcgtccgtcctcggtgtttcgtcaaggtcgctgcagcccccgtcgtcgtcttcgtcctcggctccgcgtcgtcaagcctcgtgccagccgcgtctcgccttcatccaaggatcgccgccgaagtcgttccctcgccatccgtctccgccgcgcccgttcgtcgttgtcgttccctcgcctcgtcgcgtggtggtaaggatctctcctctcgctgccccgtcctcgtcctttcggtgtcgcccgtgcccgttgtgcggttgttgaccccggtacctgtgtaccggtgtcggtagtcgttcgcttgtgcgggtggtgaccctgttagtgtgccgctcggtggccgcgtggtttcacatgtgcagcccgcgtggtgtctagtggggtccgtttgtcggccactcgcctcggttgacacacggggtccgcttccgtcgacccgtggaccgtctctgtgtactaggtctaccgcagtcctttaggttggcatgtggggtccgcatgtcaacggcgcagccttcctgtcttttccaggctagcgcttccacatgttttatagttgcaaagcttaattataataatccgcaaatctccatgtaaacagcattaaacttcagatgatcatatcttggtcatacgagctccgaatcgatctgttcaagtctcctaatgtttgttataacctaaagaaccctgtgctttctttttatgtattgttattgcttctttataggcttgtagctttgcttgtgtgcttcgcgtagcttctgtcgttccggaggttctcgaagcgtggtttgcggtcgtcgccgaaggttcggaaggccgttctctctgagtaaggcaagtcacatcatccttgaacatattgaatcctagtttataaaattattttgatttaaattattgcattatcgctttatttaaatttccgcgttatcactgttttatctagccatgcctatttacttttgttatgaccttattattgctattgttattattatcttgttcaccctaggaaaataaaaccccaactagtgggtactctattcatggttccactagtatgaatttaggtagatgcttcgctgattaataggacaacattaggtggtttttataactttagactttgggaatattcatatctcttggatactatggaatgggtggcttatggtggaattggacatacccctctcttcctctttcaaagcccctaaaacctgtttttcgatggggtttgggtgcatgccagttgtgggaagtagcaccccgaccaatataaggactaagctcgggcctctgttgcaaagcactatcgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttctggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctggattggcttgggacgagctgggacccagggtcgggttgccagttcggtctgaatcatcgtaggccttgggttaaggcaggttcgtgagggttcatggccttgattaataacactgtgtaactctaggatcgtctttataaaatggctttaggcaactaagtgacttttaaatgctgtttactgcaaaacttaacccctatattattatccccttgtactcccttgcattaattatgcatcttcggtgtggcttgctgagtactatggttgtactcattcttgctcaatctttcccccccttcagtaagagaagctttggagaagaagtcttaggtggagtcctggcttataccccagttgagcgcctgtgaagatggagccgtaggcccgctagtccgctgctgtttattttttattgtcgggctttaagtgcctttgtaataatgtaaatattatcgatataataaagatgtgtcttttatatcatgtttgtgtggtgtaccccggcttttcctgggacggggattaatacactagcgttcgggaaaatgtatttttctcggtcgcgacaagctggtatcagagccatctcgactgtaggatgagccaagtggataaaacctaaggacatattttataaataaaactatttgcgaaagttcctttttttttctccttcccctaatgctatttgaaaaaggtttactcccttcttccttcttcagatttcaactagtactagttggtcagctttgtgaagaagcaaatgtcgtcaattgtctgccgaagctccagaaggctgcaggattcgctagcgaagtggaggaagcagtgaagccagctgtgaagccgaagctaagatcttggagaacccgccgcagaacctaagccaccctctagggtagagtcgttagtcgcgtgtttccttgcttgtgtgtgtagcgcgtggtttgcatcagtggggtgtgatgtaaccatgctaggttgtttgcttaatcaacttgcagaataagtaaaacaaacaacacatcaacaagaagagttagttcctttaaggtcctgtctctagttctggtctattctttcctggcttgtttcctctctcacctcaatccctgtcacagatgtttaacagagaaaaaggaaagaatgtcagcgggtatgcctcaagaaactcaagttttcaactcaatccaccactggcctcaagagagttagcaagggcacacccttggtccattccaagcatgctgcttagttcacagctaccattggttggaagtcaagaccaaaatcagtatgtgtttgatcgagcatttgccacccaggtcaatgagcttccaatgccagaagagcatgtccccttttgtcatgattgtagagagcaaggacactatgccctgaattgtccatgggtatatgccaaagaagccccttcctttggtttaacagggcagacatcgctaaaccagcctcctcgcaccaagtcaagcttgcagcctagtgtacaaagtagagagcccaatggagagaatccattgaatcccgggaaatgctttcctcctagcctttcgtaccacgtggggtcacgtactaagcaagccaaaggcaagaagagtaagaatcataagagaaaagcgccgatgcgaactgaagaagaagtacgtaagatgactattaccagcaccgaatggcctccagcagggataactattcctagacgtcaaagaggaaataccttccgaggtgcacgacggttgacccagcacctcctaagccatggtggcagagtgtctgatagtgaagggtcagatcaagtctcctcggatgatgaagatgagtctccccgacatctcggcgaggaagagatggaatcaaaggcatgcacccgttgtggagaaattggacacagtgctagcaggtgtctcacactctgccctcattgtgaagaagaccatccaccaagggagtgtcccacccgcaaggtgacatgttttctgtgcgaaggtacaaaccatgtgcccaaggattgccaactcaatgtgttgttgaccaagaccgcagaaatccaacgaacaaccctacgattgtctcatcagctagtcagctccaacaacaacatcgacgatatcatccacagcaccaatgctcctcctgctgcacctgactctgcaataaatcatagcaataataccttcagcaccaaccattctctgcaccgacagcctcagcaaagaattgtcgtcgatggaagaagttgtgtctctccccgacctactccaggccgagcaaagggcaatcaatctcaggagggcgatagcaagcagaagaccattctctgcttcaaatagcaatcagaaggaagcttctcctgtgaatgatagcaatatgcagtcctaacacatcatcacagaaccaatcaaggatgcagtcactagaacaatgccagctatatctctccagaatcaaaatgagcagccacgtttgtggttttcagttcgctacttatcattgtgtaatcgcaagtttgcagcaatcatgtaataaataaatatatttatgtctataaacagtgagcttgctatgtttatggacgattcatgttgaggatacaatgtaccgatgttaagcaccttccctttttgtttaaggcagtgcctcgtattcatgtaatatgggagaaatgggtaataaaaacaagttctatgaggaatctttcagaagatgctgatatgggattatgtgtataattgtttactgtcaaaggagacctagggtctcatttcagaggaactatgttctaaccttgagttaataaccaacctgatgacggaaaagaaaatcaagtgattaaccaaagagacatttgtttggactaagagtttcagatgtgtctttttcggatcaaaggcaacgacagttagtatagcttttggcgaaacacttcaaggtttcactgaaaggcagcaagccaaaggacctcatcgtcaccagaagcatccacaactctcggagtgaacagtacttggttgacaaagttcaaaaggttattgatagaagataccagcaaaggtgtttattaccgggcaaagaagtaggtcgaaaggtgattgataagagaaatctgaaaagaacacatcaaggttgaatgtgtaaaggaatactttgaatgctaaatgatgacaacatgaagagaatagtggaaagtaaactgaacataaagaaagtgaatccgagttgcttgttcgtgggagctattcccagttatgaaccaagtgatatgttcgaggatagtctacagaggtcagattaaaatcacatctaacaacgaagcttcaaatttggcaggataacgatcagacaataagaagtccagtagtaaagccatttgggaagacgtcaaagcatgtcaagtgggataagttggttctgttgagaaacataattcaaaggcaaagttatcgacccttgcatcaaatagcagaaatagctagcacccggagaccaggaaagctaatatgaggcagttggtggcaagttagaagtaaatgacaagcatgatattcttatgatgacaaacatggtatcctagtaatgacaagctagtgttgacgcatgacatgaagtggtaacttgtatgaggttgactccaagatatgagttataagaagttctggaactgaagccccatcttccaatgtcgcagcccagtcgaagtcagctagaggtgcaaccagggaaaagtcatgtgaagagaagattccatctataacaggagatcgagccaagcagtccagagtggagaagttttgctaggcaagtttgttatagaagacgcgacggaagaagtcagacaagaagagaagaccgcccaacctatcttcttgctagcctcctcgaatctcggggatgagattcttgtaagggggtggatttgtcacgtcctgataaattcatcccgaaataaaaatcattccctaaaaggaataatagaattaattagaattcgaaaagaatttggcaagcactaaaatgcgtacaagaaaaattcgaatgtggcccggagaatttttgttaaattctccttggtctaaaaggagccctcaaattttacttgaattttcagagcaccggaaataattattaagcaacaaaaacaattatcaaagtttaataaaaagaaaatctaaaaataatcctccttttcttttgggccaaatttggcccaaagtcctccctctctctctcccggcccgcggccaaagtctccccctcctccctctctttccctcctctcccgggcctcccctcatcctcccggcccactccctcctccctttccctcccgggctgcctctccctcctctcctcctgggccggccgcccggcccaagccgcgccccccctccaggccgagccgcgcctccttcccgtgccgcgcacatgcgcgcgctgacgacgcacgcctgaccggtgggtcccacccgcccggtcgtctccttcctcccgcccggctcctctctctcccgtgaaatcctagctcgctccctcctccaaatccgcctcattcaaaccggggattccaaaattaagtggggggttttaatccccattgattcctcttcaattcccccttaattcccccttgaatggcacccccaatcgtcgggaacggacgcgtcttctccggccaccttccatggccgccggccgtgtttcccgtcgccgttccgccctctcccgtgcccggctccctcccccatcctataaaacggaatcccctcgctccgttctatcgttttagccccctcccgcgatctcccgtggtccctagccacctccccgccgtcgtcccctctctcccgtgccgccggccgtcttcagccgcccctgccgccgcgttagcacgccggccggccgtgccgttgcctcctccagcgtcgccgccacctcctcttcgccggcctgccctccatttcgcgcggtgaccgccggaggcgcgtccccgccgtcgtccagtggcgttgccgccactgtaccacctccagccgcccctgccgcgccgttcaggtgcgggccggctgcgccgtctcctccttcgtcgtcgccgcgtcgacctccaccccggcctgctctctgattcgtccggagaccgccgtcgccgcgccggcttctccatcctcttcatcgccggcgtcctttcggccgccccttcctcctccccagctcgtcggcttgctgcaccaccaccacccccggcattgcagcggcaaggtcgccctcgccctcgccctcgcccccccttcacccgaacgccgccggtgtccgtcgtcgtcttcaccgttcattctcgccggctcgtcgtctcgcggtgccgcctccgtcgtcggcatcgcagcggcgaggtccgcgccgtcctcgtctccgtgcagccgctgccggctgccctcgtcacctcctcgccggtcccggtcgtcgtcgtcgtcgtcgtcctctcgtcgttcccggtcgttgtggcgttcgtccctccgtcaagccgttcttgtccgtcgtccgcgtccatcaagtgtgccgctgcagccccgtcgtcgtcttcgtcctcgcctccgcgtcgccaagcgttgcgccggccacgtctcgccttcgtccaaggatcgccgccgaagtcgtcccctcgccgttcgtctccgtagttcccggccgcctccgccgtgctcgttgtgcggttgtcggccccggtacccgtgtaccggtgtcggtagtcgttcgcttgtgcgtgtggtgaccgtgttaatgtgcccgctcggtagcagcgtggtttctacgggtgcagcccgtgtggtgtctagtggagtccgtttgttggccactcgcctcggttgacacacgggatctgcttccgtcgacccgtggaccgtctctgtgtactcggtctaccgcggtcctttaggttgacatgtggggtccgcatgtcaacggcgcagccctcctgtcttttccaggctagcgcttacacatgttttataattacaaagcttaattataataatccgcaaatctccatataacagcattaaacttcagatgatcatatcttggtcatacgagctccgaatcgacccgttcaagtctcttaatgtttgttataacctaaagaactgtgtgctttctttttatgtgttgttattacttctttataggcttgtagctttgcttgtgtgcttcgcgtagctttcatcgttccggaggttcccgaagcgtggttcgtggtcgtcgccgaaggttcggaaggccgttctctctgagcaaggcaagtcacatcatccttgagcatattgaatcccagtttataaaattattttaatttaaattaatgcattaccgctttatttaaattcccgcgttatcactgttttatttagccatgcctatttacctttgttaagacattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggacactatggaatggttggcttatgttggaattgggcacaaacctccccctctattcaaaacccccaaaatggttttaggctgggctcgaggtgcgtggttgggttttgttagtcgtacctcgggtactataaggattaagctcgggcctctattgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttctggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctggattggcttgggacgagctaggacccagggtcgggttgccagttcggtctgaatcatcgtaggccttgggttaaggcaggttcgtgtgggttcatggccttgattaataacactgtgtaactctaggatcgtctttataaaatggctttaggcaactaagtgacttttaaatgctgtttactgcaaaacttaaatgcttgggcaattacctttgggaaggtaattgagatgcggcatgtggagacatgagcgccacattgccatgaaattgataacatgatttgtgaaaggaaaataaagcgaaaacaactgttttcgactggggcggacggatgatttgggtggtatctgggaaaggctagtaccatccccggtcaattaaggaccgagccatgaagttaagcatgaaacgacccccgtacaaccgtacttctcgaatgggtatagacctagcggattagatagccgagcggagacattatccctacatagatggttcacccctgagtgagacaggtgcgctacgatgggacagccgttgaggtagagccgagaggcgtgccctacattggtgtcgccattggtaggactgccatgagtgtgtgagagagagaacttaacttgaaccataatttaatatgtgtgagacttctctttcccgggagcgccagaactcctcacactgctagaaacatggacgcctagagtgcatgaggatttaagttcatggagcggatactgccaatgcgaggttatcgaaaagctttgccgtgacgcgcctcatgtgttgagacgaggctcatgtgttgggcagtcgcggagtgcgagtaaagtgtacatccactgcagtgtgagtgaaccaaatctattcgaatagccgtgctcgcggttattgagcaccgggacatgtattacacttggctagtctctaaattcttaacttgtgtgggatgcgttgttgcatgacgaatttttatgctgttggagccacttcctgagaagggggaaggtgggcgtccttagaaaaccattactcaatggcgggaagctatccttaggatcacaatggatggtggacagaaccgtcgttgtttaaatacaaacactggtactaaaatttgatcagtcaatgctaggttttaggtttgtgaaaagaattacaaaactggcttagcgcaaaagagccatagccatcctttgaaatacctctttcatatgcattgttgctgtggtgacttgctgagtacggttagtactcacccttgcaaatataaaattaatcagaagcgggagatgaagcttcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgatgatttaagacaatgcctacgggcttatgatgtaataattagcactagactctcgtgtatgtgcttttggtatttcagctatgaactcgtgtgtactagactacttgatccagggaaatggtactgtttacacgaatgataatttttggaggaactctgatatttcggagcacttcttccggagcttccgctcactctctaccaagctaacatactaaatattaaactacaagtgagttctctacttgagctcaaagttgtgtgttcttccaagtgagtgaggacctccttttatagtgtgtcaataacgtttgtaggcggctgtaaatgttggtaacaccccttaatcgtcattgagaaccaatggggacttgccacgtgcaaggtgggagccgagggtgccaaggttggttcggccgaaccagggcagcctcccctggccaccgcctttctccagtctctgacaggtgggcccctatggtgattgaggatggtttggtctcatattaagtcggtctcgactgacttctgggccctccaatccttgtactcgcgcatgattggccggaggttcattttcgtcgcatgtcgggtgtattttctccttaaataacctgcatacatatatttaccaaaactagtggaagtgattagtagtaagctcctaccactaaattttgatagtacatttgatatcttttatgcagaacttgacggttaaagtttgccattaacgatcatcaacaacatacccacacttatcctttattggttcctgagtaaagctcatgaatccactagagcaatgacttctacttaatgaaatggcataccaaatatgtcaaaacatacctaagtctatgaaccttgatgtgtctactatgccatcttgagcgattgaagaatgtaatggtcctcgaatcaagttccctttactcctcatgatgaattaccttgggattttctttgatgctcttaaaaacataaattttactatactcctcatttgattcttttgaatcactcaaattgttttatttctcaccaaggcattgatgttgccttttcttatcctacctttctaataaggcttatgtggagcttagggtagggaataagaatgacatacttgcatcagatatattgtaaagtccaatgtaagatccaagaagataactaatcatataaccatgaccaagcttgtgcacctaagtttataagtgaaaatgagatggtgggaaaataaaaaaaaatagaatgatgactcatttttttccatatgatcctcctcgcactttattttagagaacatggcaatactttttttttcatcatgctcgagaacattttgatcattctctttcgagcataatctctttttttttagctcatgtctcatttggcatagatcattggagaagagaccacatatttttggagtctttatttggtggatgcatgacttttggtgtagaagcttagcatatggaaatgaatggaaaaattttggataatcctacagcgtatagaaagagcaatattttttgtggctaaatgcacatgactttgttcatgagaatatgaaaagaatctaacaagaatcacaaccacttggcaaaattcaaaatgatagcaaaccaacatatgtataaggtttcatcattgagatcgatatatggctttggtaggaagggaacatcatgaggagtatgtaaaattatttcattttgtttttataaaatttccaagggttcaacatcaagagcaaggttcatatcatcagactatctctcattaatcaataacttagataacatgtggtcctaagaatatgattcacaagcaacaggtgtgtgcaggaaataaaaggtatgtaagtcattttaccagaaaagtcagaaattctagttgatcatgtcaatacttattttaaatcttgagttaattatactggccattttattctaaaaggtttgtcactgtcacgaccggaaataacccaacgggagttccttacgtgcgtgcattattccttgtcccaggaggcaagatacaccaaagttgatacaattcagagtttaacaagcggaagcgtaattaattaatttattacatgggcggcgaagacccagcacacacaaagacaaacgggaaacagcggaagactagggcgacgaccacaggcgcttgacgacaggcacgagctagacaccaaagccttcatcttccaggaactcctcttctgggtttgggaaaaattgagcaagactgagtacaacaaccgtactcaacaagacacacccacaagtgcagaataaatgtaagggagtacaagggggttataatataagggttagggtttgcagtaaacagcattaaaagacacttagttgctcaaagctattttgtgaacatggtcctagagctatacaatattattaaccaaggccgtaaacccacacgaacctgccttaacccaaggcctacgatgattcagaccgaactggcaacccgaccctgggtcccagctcgtcccaagccaacccaggccaaccattccatattttagttgttaagcaggttttaagaattaaaacactaacttgggtacattgctcggcttgcccataaccgagggcgcgcctattcgaatagattatactctgatcagaggtgtacatctttacccacaagacacatcttcctcacgtgtaaccacgtgccacataccaccacggtatacggacggaagacatgacatagtttccaacccatcctagccataaacaagagtaccgacccaaccccacctacggccggaacccccgggaaggtaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacagtagtgctttgcaacagagtcccgaagaccggtccttataaggccgaggtgctactgtcaaaaccatgcaccccgagcccagcccaaaaccattttgagggttttgaatagagggggaggtgtgaatccaattccacaataatccaaccattccatagtgtccaggtgataagagtattcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataacaaggtcataacaaaggtaaataggcatggctagataaaacagtgataacgcgggaatttaaataaagcgataatgcaataatttaaatcaaaataattttataaactggaattcaatatgttcaaggatgatgtgacttgccttgctcgctttcccaaacgtcggcttcaacctccacgaagagcagatcttccgaagctgcagtgtctacatgaccaacagaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcattttaaaatttaatttaaaaagggtttattgcgtcagctgaggggagggggcgcgcggactgggtccacgggagtggggcccacgcggcagcctcacggtccacggtggaccgggtgcacctgggctcacaccggtcggcgccgtgggtcccacgcgtcagctgcacccgagggcgcgggcggctgacggccgggccccacgcggcagccattcggcgcgcccgagggcggccacgccggcgcggtcggcgggaggcggcgcgcccgcgccccgatggtcgccgccggtgacgaccggcgcggcggagcggcgccgagagaggggagggaagggggaaaggaggcgacggtccacggctcaccccggggcgacggcggcgacggagaaggcggccggagcggagggaggcggcggcgcggctcgggtcgacggggtcgacggcgttccggcggtcggcgaccgacacggagaggtggacgaggttggcgaggatgcggcgaacccgaaggaggcggcgccgaggtgggaggtggtccggggcgacgacggcggcggaccggagctcggcagcgacggtggagagagagagcaacgtcgcgagctcgaatctggcgaggaggaagggcggcgagaggcggaaacggacggacgaggtgcggggagggtttaaatagggttggaagggggagagagcggccggaggggaaggaaaccggcgcgggaggtccagccaccatcaatggcgccggcgagatttgcgggggcaaatccacccgtttgaacgcgagagagagagggaaaaatggggggaaagggagaggggatcacggggagtaattccccctactttattgcacgcggggatggcgggaggcggcgggattcgcggcggcggcggcgctagggcgcgggggaggcggcgggagaggcgggatgaaggggatgacgggtgggccccacccgtcagcggcgcgcgcgcggggagaggccggatgggctgcggggagaggagagagagagaggggggaggagagatgggccgggccggcccaagggagggaaaggggactttttagggtttttctttttataaaatcattttaactttgtttatttcttaacaattattatttgtgctctgaaaattccactaaaatttatttacgcattttaagcttttaggaaatatacaaaaatcctctaagccttatttgacttttaactttgcacattttaattgttagaggctttcacacggattttaattattctaggcataatttagaggatatattttagggtcgttttggaacgtgacaggcactgtttcacatttttaccaataatgatattggtttagtgctgtcacattattgcttctaagtctcaatttttatatgtgcaaaattttatccaaaaccattggcttagcgatgtatatggtattttgcattggcggttggtaaatcatttgagcattagtactcagaattttacaccatgtatgccatatatttttcaggtgcggcctaacacgtgccttaaggacttgagcgtatttgtttttggcaatatgcgcgcgcttaagtgcccaatacctttaaaatcctttatttagctgttaaaatattttttaggagatggtacaatgcaatttaaaacgtggcaaacagtgaagctttatacatagctatagtattaactttttattatgagcttttcttaagtgtggtcggcataaagctgcataaaggtaggcgctaccaatgagggatcgccacctgtcagctgagtaaataatggggttaatttattcgaggggtatgacggtcatttggacaccagcgtaaactctaatcgttagtttactcaagtcgtgattccataccgaaggaacgtatgcagtgttagagttggccgaagaggacaaaggaatccccggaaagctaagaggcgagtggaaagttcaattacgttctagtttttatggtttacacagtgttagagtttgccggagaggacaaagtaatccccgaaaagctaagaggcgagtgcaaagaaaaattacgtcctagtttttatggtttacgctctatatcgcgccactactgtagatcgcgtttagagaaagccattgtatcggcacacataaataatggtacaaatgatttgatgtagaagatcctagctaaaaccaagcgattgggttacatccggtttacgttggtctacaaatagaaaatacaaagtacatagccacataagatcgatagcactcctctggtatacgctgagaatgaaaaaaatttatggtgggccaggcccacctaaatttagcaggtaatcctctcaaccatgtacggaatagcgataggagtaaatcccaatgtcagtccattatgaagcccattttggcagaaactgttttatataatagtcctttatattttaactattatgagccaaacacagcatcaattgttagccccttattattatccaaaatattgaaaatgtgatatatatatatatatatatatatataattttgtaaaggtcttgtcctcggggcaccaccgtcctcggattgcggacataaacacatcgattctactcatacgttcgacgtgcctgtttatgtgcgctatcccattgtgtgcgtaaaccatccacgtgctccgtgaacgcctagcgtacagtggtttgcgagttgcgttaaagcattattggcacgggcaggggtgaaccttgtaggcacctagcaatctccgcgtacgcgtagagcatgcacgactcacgaaatagcatatcagccatcacatacgcataaaccgtgttgtaggcggtacgctctatgtacgtgtttacatccgaaatctcgacttaggcgtaatgcacacacctcgatcgggcatagtgctggtgtacgcgcgagacgtgcgtgaaggtttatgtgcacgcgggggatcatatcgcgagttgcctacatatggtccacgcttgcccgtggatcgtggacgtaaactcatccttcgtgcgcgtaaatttacgtcccaagggaaaattaataaaattttgatgtggaatggtacgttgtgcaaattaaaacgcggttaacgaacctttagacctaaggggatttttgacgtgaaccttta

SEQ ID NO: 38042 - DNA, 1903 bp, Oryza sativa
gccacgtggtgaccaccccgaggggtcggggcgacccgaccccctgtgttaggtatgggtggcctccacttgtccatgggcacgacccctcggggtgaaccctgcgtggatcccgagggcagctccatccctttaagcacggtactcctggtacccccgggcctatatcacctacagtagcccccagcgttacatctggcacaagatcagctttgccgtgacgacctcaactatcttgaagagcgaagaagacacgaggcccttcgggccgctcattaccaacagagcctgcggcgttatcatcagcgccatgtccggacacgatcactacaagtcaacgatctcatcttgcgccgcatacaacgacaccgtgagcgtaggatggatatggtttccccatgtaggcgtaattggtggtgcgtaacccattcacctgtacgcgtacacctttcgatcgtaaatggtgtacgcgggggatcatatcgcgagttgcctaatggttcacgcctgcccgcatgtagggcacctcacgatgcccacgtacacttaaactgcgcacggcttacgtcgaatcgacgagccggcccttagtcgtaccatacgtatgagtgcgactgcaccctcctcgcggcctcatttcctgcttcctgggcctggcttgcacgctgggcctaatgggctgatgggttgggggaggtgtcgatacatccaacatgcaaagtagaagtacttaacaccagaaatataactgctggttcaactatataaactataatatacttgcattttttctgcttcttcctcggtggcaggtctccagatgaaccgtcgtcctcgtcctcgtcttcgtcgtcgtcattgtcatcatcatatgatgcgagcagaggatccttctcgtcggcgtcccagtcgtccgatcgatatgtttacaaaaatagttgcagtccttcgattagcgacaacggagtgctgcgacgcctcaggcacgtacgtcgtgtctcgcgtgcaacgacaccgtgagcgtaggatggatatggtttcctcacgtaggcgtaattgatatgtaacccattcacctgtacgcgtagactacctttcgaccgtaaatggcgtaattgagcataaatggtgtacgcggaggatcatatcgcgagttgcctacatatggttcacgcctgcctgtggatcatggacgtaaactcatccttcgtgtgcgtaaattagcctttcgagcgtagcatggatgtgtttacgcgttgggcacctcgcgatgcccgcgtacgcatacaagccttggaatctgaccttttgcagcgtaaactctcatcttcttggcgtagacagcaactggtggtgtatgggctgattccctgcttggcataacccttgtcgtcctcgacatataatccatcttttttggtgtatgggctgattcccagcttgttgtcctacttggcgtaatccaatttttaaatgttccaaggatgataaatagtagttgtggaagatcctatgagagtaagtgagtaaccacatgatgatttacgcaattacctttgagaaattcaaacgtaattacctatcaatctatggggtatcaaataaaatatctaacagtagttaataaattctaaaaatattaaggtgctaaatggaatacatatgtaagaacttgagcataattatgaaaacgtaagggttttagtagtaaaatagtatagcgcaaatgggctattttcatgtacttctgttagggcatccgctatgaattgcaatgtcttttcagtattttattttaaaaaaatacgatgtttacaaaccatgttgtggggctagcccacaacataacattattatttaacagaacatagtccattcatttagtccggatctgttgtggctg

SEQ ID NO: 38043 - DNA, 3194 bp, Oryza sativa
cgtccgttttctcctaccaaacagaccctaatataccatatgagcttttactaagctacagtatccggcccattttactcatttcaggccgtagcccactcccccctgaatccagttggcatgtgggcccagtctgagcaatcctgctggattcgacgtgcttcctccaatcgaccaatcctcgtcccttcccgtggtttcgtgttcctccgttcaactccatgattggtccgagcaagaaaagcctctctttttccttaggcccttccatttcagagccagtcgccacctgagccgagctctgattcttccatttctctctggttagatcttgcacttacctctccattatattgtgtcctcttacttcaaagctctttttttggggtaatttcgatgcaagattgcttcttgttgtagccgggtgcatcaatctgctttctgggtctgaaagattgatgtagcaaagatttgggttttgttcctgtttcagtgaccgagggaatcatctaccagattcggtttcttgatgggaagcagtaatcgtgaacccgtgcctgcgcggggattcggtagcctcgtgcagataccggataagattcagaactctctcaaggttgtttttttttcttcagaagtgaggattttttttttttagaggagttcgaattagctgggaaggtttgagttcgtttggttggatcttgctacaggtgcattttgggcgtttcttgaagaagaatggctttggtggtggttcagaggccgaaatgctgccgatgcaaatgcagggaacttgtactactgttgctcctgaggttaggttggacaagcagctccaagcttggaagaacaatcctatttggtctgatgaacctccagaaatcaaggtgtttgtagttctttcagtgttagaaatgattgtaggtcatatacaaatcgattgaagttgggctctttcagaaaatgaaatggtggttaactgattgtctgagaacaacagttatataatatatttaccagaaccgctaactttcttctcattgtaaacccccgaatattttcttcaacctcaatttgatgtattcagtaattttggaaaaaaaaacacttatagttgttcatcattttgtgggagatttcaggaatgagcaatgtaggcgactactgtcttgttgaaatgctaatgctaaccttatatgatcaaatctttacaggtgactgtgccacaaggctctctttgcaacctgaatctgaaatttaaggcaggattacctccagacgcagtttacaacattataattgatccagagaacaaaagagttttcaaaaacatcaaggtatgtataagcaagttcctgaatagggtaacaggaaacatgaaggctcattcatcatgatattgtggcacttgcttgatttccctgatttggttactgataccaaatgagcagaggaattgctctagtatcttaaccggccaagtactcgtgagaaagttcttgttccaattttcaggaagtaatatcacggaaagtcgtgcttgatgaaggacaaaggcaaatagttgaagtggagcaggcagcaatatggagatttctctggtggtctggtgtcttgtcagttcatgtttttgtcgaccagaacagaacaaatcacactgtaaagacttgaaacattgctactagtctttgagaaacagctaagatacattctctgatatgtggcttcatgcaacaactattggcaggtaaagttcaagcaaggaagaacaggttttatgaagaaatttgaaggttgctggaaaatagagcctctatttgttgacaaggaagcatgccatcctttagacccatgcacattagaaaagtatgattcctgcaccaatggcacaggaagagttggatcttcaattaccttggatcagcttattgaacctgctatggtacccccgcctccgttttcatggtatctgagagggattaccacgaggacaactgagatgctggtcaatgatctgatagcggaaactgctcggctgcgaggtttggcaaataatgctattgacaagcaatatgttgagggaaagtgtgatactagtagagatcatctaacagaagagtgcaatgatattaaggaaagatggcgtcagagaagaaaaacaggacggcatggaaactcccttagattaactgctcaaggataaactaggcattttcgcttctggacaggatgcattttagggccaatttacctgtactccaatggtaggtggttttcattgtagaatttgatgaattgcagggtattcatattgatattttgtagatggctaataacatcatgtgactagtttgtggactgtttcacacgactctttcgtacagtaataatgtaaaatggatgttcagctgtgtacaattgatgaggtgaataattgcccagttaaaatgtctgctactgaacactgctcttccatttctaccatttatctgaagcacagttttttttaacgaaccggccagcgccaatttgttcaaaagaaaaaatatatgtgcatcagactgaagcaaaattgaacttacttgaacctcacgacagttcaaacatgataagtatgcctgacacaacatttttatatgtgacaatatgaaatcacaattttggtacctcttttcacgaaaaaacatatgctaaatcggtgactgaaaactgaagctagatagaacaacagataccatttcctgagcctgaagtcctgaaccaaactgacggcaaactcaagttcagttgacaacacaaaccagttcatcctttctccaaagctgcaagccaagaaaagccccaaattccttacctttcttgacatgctcaaggcaacagcaaacaccttccttgcattgcatgagacttatgaacctaaaactctacatagcttcatggacagttcaaacaccttcgatcactcgatcgagctcgtcgaccccagccatgtccggccagcctccgccgccgccgtcaccggcgatgccgtcgcagccgcagccgtttcgcttctggctcccgtataggagcaatgtggcgtcatcctctcggcagcaaccgcggccatcgtcagggacggcgccggcgccgccgccaccaactccggcagatcgtccgccgagagcgtcaccggcgccggcgcgggcaat

SEQ ID NO: 38044 - DNA, 4407 bp, Oryza sativa
  unsure (1)..(4407): unsure at all n locations
ccgccgagggcgaggcggtgcctgcgcgcgctgatgatggagagcgggagcgacacggaggcggcaccgaagccgaagacgaagccaaagccgaagccgagctcgtgccggttccagtgcgtcgcggatcacaagccgccgccgccgccgccggcgacgaccagcaacggcggcggcggcggcggtggtggcgacgggaggagcggagaagaaggcgggaaagagaacacgaggtaaaaattgaaatgcgtgcgtaatttacgaaattgaagacagtgtgtgctttgatttgtaatggttttgtgtaaatttgaaatgaattcttctgggacaacgaaatgaaatcgcattaataataagctggtttgagatcagaagagcgagaaattaagctgcattcgttttgtaaaatgctgctatatcaatgattcaacagcaatggttatctcaatgtctgacaggctaacagcactaagatcaaatgatcattgatcaatggtaccttgtctatttcatatcagaaagtgagatacatttctgaataaatataagtatgtatcaacttttgagcgcttctttttcgaacatggagatattctcctattcctgcaacaattaaactgtaaaatatgaaattcatgtgaaaattcatcgaaatttctagatttcaaacaaatgccttagcattcaggtgagagcaggaatatgggagagaacagaaatacagaagatcgagaaaagaatcaaaagaaaatatgcgtggagatatcctccagccgaggcctttcagtcgttcaaaaggcatatcccagaataaatttgttcggaagggacaattgcattttgtgcctccctgaaggccacaaaaacatgctacgcgaagcatcaaggatcttctctacagacttggcctaggctcatgtgtgtgcttttgttaaagagacggagtagcatgccggtattgcacatttgctgatttgcacagttgctgtggttcatgagatgaaaagaaaagataactgaactgctctaacttacctacacatctatatttttaattgaattcggttggtaagaacttccagcttaaaaataatatgaacgcggtcaatctcgattgaaacatgcaagttcacttcctccgcctgatcacccggcgccatcgcccgacctcgccagcgcatgaaaaaggccaagagtgtcagcaaggcccaccataccccccctcctccgccttcttagctgtcctccttaagtcaacaacgctacccccatctcgtcgtcttccttgtcttcggcaactccctctcctcctaaccactctttttactttgccctcaccgctaatacaggtccaccgtttgccgcacatcacgcgtggaggcggatctgtagggtggttcgggtggtccctggatcataaaaaaaatcacaaccaacccctctactatatataatttcagaaaaaaaagaagaaaagaaaccaaaacaaagtgccgctacgtttaggtaattgcggcatcggcacatcgtgttggattggatgccacgtcttccgcgccccgcccgtgattccgcaccgcatcaaccaacaagtcgacccgtcgccgagtccgagactccgatcgccacctctcgccgtcgctgatttgacacgcaaccatgccagagtgggcgaataccatgctcctctctcttctcatgtgaggttgcaactcatgaactcagcaaagaggcggttgatctcttggcaccgatttctatctccgcggtgagcactaggtgcaaggccgaagcagtgctggcagcacctacaagtctccaaatctgcaggtacaagctcccgtgttctctctctctttctctttttcatatctcctttctacaatctgcattgttcttgcctgaaatccatgtgctctgctgtaatatatgcttctactgtgcaatagtaatacaacaccgaccagaactaatgccaaagagatcatagattcaaagttgatctcatgtcgctgctaggtaattcggttctgttttattaacgtgtgtgtactgattcggtgaaacaaccaccgagttgatctactgaaatgtagtgcttgttgatctgctgcagtgcagtgctaattgatctcacccttaaaatgaaattaattggtgtcgaaaaaaagaaattaattgtttatatgtacttctatacattttgtgagtcggaccacctataccctaaattttagatacatcactaatcacgttgcttcgatgacacctccttcttgttccgccgcctaacttccccctcttcctcctcccccaaccccccttcccccctaaccccaacctaagatgctaaccgatcggtttgccaccatcatgccgaaatccccattatctcatcggagctaaagccaaaatccccactattcatcttcctttgatctggtttagttcctaaaattttttttctcaaaaatatcacatcgaatctttggacacatgcatggagcattaaatatagataaaaacaaaaactaaattgcacagttcgcatggaaatcacaagacgaatattttgagcctaattagtccatgattaaccataagtgctacagtaacccacatgtgctaatgacggcttaattaagctcaaaagattcgtctcgcggtttccaagcgagttatgaaattatatttttcattctatccaaaaaccatttccaacatccagtcaaatatgcgatgtaacacacaaaaattttcttttcgcgaattaaatacacatttctttttttttttcaaaaaagaacatgaagaaaaggcacaatgatgacaacagacagtttcccacagaagatccaagacgcctgccactctaaactaggcaaaacacctccgaagtctcagctcagcttctcccctcctcaaccaagcagaaatggcggcttcttgcgcgctcaccctcccctccgccatctccgtctctgtctccgtctcctccaattcacctcgacggttcaggtactaatctctgtgcccctgacctgtactggttcaagtcgatctcctgtgcgtgcgaaggattgatccctggtggtggtgtctgtgttttttggggggcgttcttggatggatgcaggcgctctaggagggtggtggccatggccagcgtggggcagaggtgtacgcgcccggcgtggcggtctccgagggcaatggcgggctgccaaagatcgacctcaagtccccgcatgggaggtaattctaggtttggttgatttggggtttctttttattttaaggtgaaatatttggggtggataacttgtgtgagattcttggagggattgtggtagtttggtttgtgagtaggaatgttagatgtatggtgccaaaggtggaggaacttggttgtgtttgtttgcttgttttttttttttttttttgtagagatgggataaatatttgtactgcattgaactgggtaatgcagcatgagtagcagaagaactgattcggagaataatttaccattcggttgcttttagtttctggatatttctctggccagtactcaaaaactggaaaagaaatgaatttttagaatggtgattttgtatggtttggtcttcttattttctacaacgtacttgattgttggactgtgaagattacggaagtggtttcacaaggctggaatggaaggttcattgttcagaatttggcgctgtgagatggaactgtgcactacataatataatcatacagttgctatgatactgaaaagctttgagatatactgagagaacaaaatggtttcagtgaaaaatgaagcaggagcatttgccacgtgttttcaaaaacacacagatgtcacaatgatttattgtgcaacttgccattcaagtccaatcttttccattgtgctgtgtgattagtcagctagtacaaaataacactacgagccatgaattgctagagttggataatcttgaaataatattgaatggtccagatttgtataatttgggatcttgggtacctcctaacttacccttcaaagtttcaagttactatcggtttctttcaattgacacaacaaaggtgtgttatcaggttttgtactttttttcaatttgttaattatgtgctcattttatgcatgaagtgaggctgaaatttatctatttggagcctgcgtaacatcttggaaagtccccagtggaaaagacctcctatttgtcagaccagatgcggtgttcaacggccagaaacccatcaggttggcgctgaagtttaggataaattatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38045 - DNA, 7794 bp, Oryza sativa
  unsure (1)..(7794): unsure at all n locations
nnnnnnnnnnnnnnnnnnnnnnnnnnnnnnnnnnnnnnnnnnnnnnnnnnnctttctagggtttagtgttacaggggattttacatggttgcccttatgaaagggacatttacatgggtatgcagtgtcatttgcacatataggcctttaatgggctgataggctgggcctggtctatggcaaacgggcttaaaaggccaggggcggcctgttgggcctccttgatgccgaactcgtcatggcgaagtctttgtagttcgccgaagatgccttcacccgagatgcctttactttcagaataccgacgcggctttccagccttcgccatcttcgcttatggctttcgccatagggcttcgcctgaatggccttgacatctttggcttgaatccttgctggtactatagtttcggcaggtccggtcgaagggcttcatggcatgcctccaacactaaacaacctagaatcacaattaatttgggatagaggtagtatgtgttaaattgttctaggctctcgcgtcacccacgcctaggcgactcagggacaaaaccctagcccccactgccgcaccttccccatccccccacctcgctgccgccggagcgtgtcgtcggagaaccgggcgatgagccaggatggcggtggaggggccttatcgtagaggcgccctgtctcgagcgtgggagaggcagcgtgacgagttgtgaaccggagacctggaggtggcagcggcacatcctccccggcgagggaggtggcagatccggcacttccgcgaccaaatctgatgctcctacggctggatctagtgcctccgcgtcggatctagctggggtcgagcagcggggggcgaaggcaatgagaggcacgatggtagctgctgggagggagaggctgggcacggatggcggtagcgggcgggcagtagcggtgcgggccatgcgtatagccaccaggagggagaggccggcgggaggacggagcagctagctgcagtggacggcagtgtgcgtgaggccgcgcgcgtgggtatcagtgggaggccgggggtgacggtgagctggaccctatggtggcggcacaaaattggcaacgacgatgggtctcccctctttgcctggcatgccccttcttcccctagtgctccccctcctttagccgttctgtctccagatacggtcgtggagagctctagcgtagagatggtggtggtgcctagcactggaggtgttctactcgcctccctcgttgcttcatgttgtagaattgggacggtcggcgtgcggaggagccgatgagggtcgtcggtgcagtggtgctcccggtgcgacgatggccagtcgacggaggggcatcagtgtggtagagagcacatgctagcagaggtctgacggtggcaggacgtcggtgtcataacaggaggaggagatcggctataggcgaaagccttgcttgacaccttgtctgggcaaacaacgacaatgtcttcaacgtttcaatccctcctaagggcgttgttgagaggcctacctctccctctagcaggacctcgggtgaaaaccaagtcctcttctggatgggcggctctgttgcctatccaacattcgatctttcagtcttcgacaacattcttggatgttgccatccggtttgctcgtgggaggagtggatcttcttctctctcgccctctcctttggcaacccttctacgtggcgatggctcagagcctatggggggatcttttggttggagttggcttaggaaggtcgtttgtgaccccttcgtggggctagcggcatccaatcatgcatagcggaggccggcttgatgctagatcctttccggggagtgtgtgcaggtgcagttggcatgtgttggtattgctttggtgttttttcccttttcctgattattgcctcccaaattggtaatcttgttaatataaaacttgcatcgtccggtgcaattcgttcaaaaaaaatatattaaattgttcttagacagctaaactagttctaatagttttttcttatactacttattcaacatctccggtgcaattaatcaaacaacatcctaaacatatgagtgagtttatagtctatgagaaggtaccgaaaaatatcatattttctactgtaaaatttggacctctcggtattaggaggtactaaatttacactaaatttttttatacctttcacggctataaaatttctttaaacatatacagacttaccatagctaaacaaccaaacaagtcacaattgtattctcacatctggttgatgctagcctgggcatttcttcttttgacccggtcttaccactatcaagcgaccaaacactcccaaaagaagggtaaataatttaggcatgcaagtatggattaaatctgctagaaatgcaggcaatcgatcgctattagatatgacttaatttaaattacctacaggtgaacaatgtcggcttcttcttcctaaaaccagcggtgaacgtgacaccggaggagctctccagtgtgatggcgggcaacctggagtcatgcttccacctaagccagctggtgcaccctctcctcaaggcctccggcaagggcaacatcgtcaatatctctggcatatcgactgttaccggattcccaactctccccatctgtgtcttctcaactgcaaaaggtaattaaagaataaaagatcactgagtatattcactctgcgtaccaacacaaatttagggttgaaacttttatacgtaggtgcttgatagtgtgcaattattattattattattttgttactttttgtaaagttggtggccacggcgattagcatttgaaatttgtctgaataggataggttgccattcataaatgcctttaagtgtaattccaaaataagtaggaaggtagcccgcgcaatgcgcgggcatgtatagcatgttgtgttttggaaacctatataagtggaatataaccagatgatacctgccatgcttcaaaagtacaatttcttcaaaaaatttcttcattagcatcgctcggtaatttttttccaaactatttggtaacttgaaattatttagtatttaattcatgcctataagaaatcatttgtaatctttctttctagctaggaaaaaggttggcatcttattttttattgatgaaaagaataataaaataaatcaacttgccatattcattgtagagtattatatattatcttataataaaaaaacatctataccgtctcaaaaatactagatcataagagtgtctcctaaatttaaaataaaaatcacttttctattgtcacctcttctcatgacaattgtattgttttagtggatacttattatcattatcattgattttgaaagttgagagtatatttaatagatcaaactacatcataccattacaataagattaatacattattagttaactaaaaaatcatctatgttatttagatgagtgtccatgtctcacttctttccaaatctatgtataaatattctaacaatacctcttctatcaattaataggataacaacgttaaattagataagaatattcgtgtagtgggtgaagttgaccgcgggcgccaaggctttcttccctgctgccgtgagatatgggtttctcatagccgtgcctctctagaccagcgtggagcataattttaatgcctaattaattataggtgccctcatagagaattgtctcctgggtaggaagttgagctctattgccaaaggtatcctctcattgagactatctcagcccactatatgtatgtcccagctatacttatgattgcatagcatgctctattatcatgcatgatgcccttcaaaaaaggacaaagagaagatgaaggtgatgaaaataaattgttttttatattctgagttgttttagggtatagtgtagacatagtttgtttatattgttaattaatattactcaaattttaatagtatagatacaatattctttttcgaaaatgagcgaggttaataattggatattgctggaaaatatagctaaagagaaataccgcactaataatctccaagattaacccctggtttgtttttaacacttattgttcaagacaaatttactaatttcaaaaatttgtttattttcccaaacgtatttgctgtaacttattcattggagtgcacttacagccacgttaatggggtgtataacatccatccatcaacaatgccctacatatgggaatttctcaactattagaaaatatattatgagtactttaatgtcaatgttacttgattgttcatttgttgccaacactattttggcaaatgaaacaaatttacatatacgaccataattattgtgatgttctaaggggtagtattatagtagctagaaacatttttgatattatttttcgtatctacaagaatgtatgcttctggattgtgaccatgtatgcttccgacttcatatctacaccagtcaaatagttttgaaaaattaaaaagctttcaaaattaaattagatctacttctaaaaagatgactaaattctattgtttttattttacatatgtagattcatattagtgtgtatacttgttaggtgatattttacaccataaaatatgatgtgaaattatttaaaagttattatgacaataattattatatgtcgacaccatgtgttatgatgtatttagcactacaaataactgttataatccgttaatagttcatttgatgataaaaaacttgacgatatataatttcaagtaacgacattaatttaatggccattaatttgatattttatctttgatgtagtttaactagtataattaatctttgatgtagtttagctgtgtttgattacggactaatgttatcttcaaatcatagaaaatcccagttttaaataccatttacttttccaaataatgctaagtgtgcacgtatcgtttttcgcatcgaatgtatatttgtttagtttatttctgtctaactctccatatatacatggggagttggatatttaatggcctaaaataccgtgtttaccactttaatgtttgtgaagtactcgttctggtttttaatggtttttaatgtatgacgtcattaaattttgatatgacatttcacaatttgcattaaaagaaacatataaatgatatttgttttatcatgacttgttttatcataaaaaaatctataatctcaatttataattttacatatttatatatttttaataagaagaatggtcaaatgttatagaaaaaaaaagaggaagtgatatattttagctttctctgagatgaaaaaaatactgttgaattttattttccaatcatactacgaaaaatatgtagcaacatggacaaatctaatgcgtttatttttggatccaatggtagttttaaggtttccactatgtatgtggtttatgtggtttgtaatatatatttttccatcatactataggtacgtaggtgggtttttttgctttggcctgtatagttttttctcccggtgaactctacctacgtggcgaactttatgtacatatgtattttctcacgtacatttttttctcgtgaactttacgaacgtaagcattttctgtcgtacttagacgaggataattaggatggaaagattacatttttaaaatggtgaactttacgaacttacgcattttctctcgtacgtggacggggattatgatggaaagattacatttttattttttcaaagtaagatctaatataatggtctaaaataatgggcccatcaatttaagtaaaaataaagactacattcattttttctgtgaatatctatgattttctctaattcgttagagtgtcacgtggtgcgtcacgtggtgacatagaagagtttgtagagtagcacgtgttgccttaggagtgttggtaggaagtttaatatagtttagtatgtaatactccctatgagttgataatacttgtcgttttgaacaagggcacggtctttaaaaaacaactttgaccattattttttattataatatgtataaaattgttagcaaatatatgatcttattaaagtactttttaagaataatctatacatgtagtcaccatatttgaaagacaaatattttaaaaatgattcataatcaaagattctaaagtttgacttcacccttatccaaaacgacaagtattatcagctcggagggagtagaaatctatggtttataatgtttgattttattttctatttcattgtctaaaagaaatttaatcttaaattttgagggggtggacggatagacggacgtaagtacgtacatacatacgtatatacgtggtggggagaggaggcccaggaggtggtggggtagggtggggtgggacttatggatgggtttttagattttgtttaaatatagatctgatggtgaaaaataatgggtctaccgtattaaatgagaataagggtgggatgttttgcttttttttcacaatttctttgatttctctaatttattagagcgccaagtgacgatctagtagcgtttgtaggaattttaatggacttttattatataatagatagattattatataatagatagatagattttatctatgtagtttttttgcttagttagaaatgtcttgtctagttagttagaaatattaatcgccagataatgctcttactaatctcaggagcaatgaatcaaattaccaagagcctagctgttgaatgggcaagcgacaagatccgtgtgaactgcatcgcgccgggcatcatcgatacaccccttggtgatgatgtacgtttaattctccacacatatgtacaccaatttattgcgaaggctggtgcttttgttaaattacatatatttgttccccggttttagattttattttcacatcaaagttctgagttattaattgaccctctacttttattatggatatatatttatttgtttcactcaagaacaattgttgatgctctcaaccacaggtcaagagcggcaataatcctcaccttcagggtgttagcgggacggacttcatacaagacgacatcgcacgaacgccgatgcggcgtgtaggcaagccggaggaggtctcatcgctggtggcgttcctctgcatgccagcggcggcatacatcaccggccaaatcatttgcgtcgacggtggccgcaccctatcttagcagagtatgtttaattgccctaaagccctaaaccatataaagaattagttcctacctcacgcgttgctacggaacaatcgtgttaattgaaggatataatttcagagctagcattgtgtatactctggctaaaacaaaattaaagagcatcatatatattgacgtgtcctttacaatttacgttattattatatactaaaagtctattaaattaagcttcctataaacgctcacgtggcactcctagaaacactcctaggccatcacaaggcattatctaatcttaccatcaattttcacttaaattagtggactcgttattttacatcattggattaaatctattattaaaaaataataactttctccttttatacgatacaagcgctattactgttgttatgtacgtacaagtttatacggtacaaactatgtccttctcccgtacgtatttacgtacatgaaaacaaaacaatagctttacataaaacgccggaataaaaagaaaaaaccatacgcatatacataaaaaagagagcaaaaa

SEQ ID NO: 38046 - DNA, 8322 bp, Oryza sativa
cctgcaccccaaaaaagagagcggaaaaaattacatccaaaaaaattgacaatctttaaaatatgacaataccttaccttctgttcgccggaaagaaaagaagaaaccatacgaatgtacataaaaaagatagcaacaaaattacatccataaaaatcgacgatctttaaaatatgattttctaaaatatattacatcacaaatataaatatatatagttaaactaagatctataataataatattaaatatccaatcaatgttctttgaaccatcttttaaataatttttaaattatatatctaatttgtgattccatggtattcctttaattaaattataaaagttgtgttgcgatcctaaatatatcacaacacatgaggccgtcatataatagttagttgtttaatattttttaaaaaagttcagatcatattttggggtgtgaaatatcacttcacaaatatacaacaccattttaaatctacatatataaaaaattaaaaaaaagacaatttagttgtgttttttcaagtagatctgatttaattgtaatttgtttgagattaagattctcaaacttttttttgacattttcagaattattttattggtatttgagaagtgagcagcatacatagtacatagatatgaaaagaaatatcaaaaatagttccactcaatgatctttgctatgattcaaccccttaaatcatcatgtgatttatggtcatattttttctttgccaaatagttttgacacaaatgaacaatgaagtaacatgcacaataaactactcatgatatattttcttgtacttaaggaatttcaatatattagacataattgatggatatttatcataaactccactgacatgactgtaagtgtactccaataaattatttattgtaaataagtttagaaaaataaatatagtcttcaaattagtaaaagtgcctcgtgattatgaacaataggtgttgaaacaaactacgcgctaaactatagatatttgtcaaaatattaaaaataatattgtgctgcggaaattatcgtggtagtatgtctctttagcaataattcttttaaataatgttgaatgattaacctctctcattttcaaaagcgagttttctgtctttatcataaaattttgagtagtattgatcaacgccataaacaaactatgtctaaaaaaactattttgatcacttccatcttctctttgttcttccctaaagggcaacaaactgaaaactccaaaaatatgatattctaaatatttaaaacaaaacacacatagtataaatggaagatttttcactgcaacaaactccatagttatgacacaatattttgcacgattccaattttcagtttagaaattatgtgttgcaataattggaagaaaatcataaccaactttcgaagcaatcctaaacaagtttagaatatcgctacagaaaattgggaaagtcactcacacacaaagtttcataatagaaattcaaccattgttaaataatggtttgtttgggagatttatggagtatcaaccgaattattcgtaacacgcttcaaaattataatttgtgtaaaatactttcttaatcggtattgcttaagtaaccttttttaagctatttgttagtcgtatgctatactatgtaatgcacttcataatcaattatctatgttccacttcatcatctaaaagaaaagtagacatactttgttttgaaaatagataattgtaaattaaaagtaggttctttcgctttttaatggaatggccagggtctctagatctccttttcaaataatctcaaaactatattattgataatttatgttttacatcaagttagagcgctctctaattggttcggattgacataacttcaaacatacttgcatgtgaaattaaaaatacataggagcgacaaatatatatcgaccctactttatatgatgtgttggacccatattatttttttaagaaaaaaacatagacaacatcaagtttaatatgacgaatttttaaccaattatgtattgctacattagtgacttacatatataagacgtggattaaaacatatgccacttcatataatatagggaaaccattagcatctaagcacttaaaaatgatgcaatgtttatgataattggtgttccaattttggtgaaaaggaagaaccaaatttttatgagactactataagattttctttctaattggttcactttgctccccattggcattttctattttatattatacgttataaaagtgttacactgatagtgtaaaacaatgatagagtgttacaccaatgctccatgtgcgtgtgataatgaattaggcattaaaattatgctcctagctggtcttgaggggcaaggctatatcgctgcgggacccatgtttcaagacaatagagaaggaaattattggtgcctactatcggcttcacccattagactagcattcgtgttaactttaatggtgttatcctattaatggatagaagtggtggtatttttgtagtatttatacgtggatttagaaataagtgagacgaaaccaaagtacactacaagaaaagaaggaattctcaagagccaatccctgttgggactgatgctgttctcgttgggaatgttattttcaaggggatactcttgtaattggtgccttgggattaatggcctagctaatactatcatttgctaggaccccgttgagaatagcttctgcaagagctaaattcaagagctttccttggaaataatccgtcttggttgttgcatagaacactgacaatctcaagggttgctcgttgcaaataccttttcaattcagtttattaaaaaatctaattatttttatattattagttaattctcctatacaaagaaatacccttgggattgttttgatttatcatttttttattaattctaattaaccaggaatgatatttttaattattgttctttttatgcagtacgtagcaaataacatctgcattggatactgcatcacatgatgcaacaattatatttgctctgacagaaaagcgtcaaaggatttttaatgatcaatataaacagtagacaatatatttgcatttaatctaagacaggtctgtagacaataacacataaataaaatagtctcagaaggtaagttgatcaaactgattaatctagcaactataataggtctgataacatgatcctagattcctaatctctaatgcttgcaattcgacattagcacatcctagaaacgccagaggtcatcattctcacaagttcttccacaatgaccagcttgtggcgcttcttcagtagtgttcatcccattctgaaataaaattacaaaataagctacaaagttactgaaaaactataagggtaggtctaagtttgaacttatgaatgatacatagcagtccatttctaaattgaactcactaactggtatcgcaactaaagccataccattggcagaacatttttaaattgatctattgttgtccaagaaccaaatttttcataatgtttgttcaagagaataaataataaggatgtacagtagtaaaaagattgaagtcagtatataccatgagaagtgcatgaaggaactcagggacaacagaagaagatggtccatttgcatcctgtgatttgaaaaataataccagttagtatgttctttctaggtaacaaaaatagctttaatttatacttacatgggaatgagtttctgccttatccttatccactgtctgctctagcctttctatccttgatgctagttcttgatgagcattgttcacagcattagtgactgcctgctgaacaatgtcttgcacttgctgctgtgtgtatagtggctgtgtctccatgctaccagatggtgcacttgctgaattaccaacatggtttctatctataattcctgaaagaccataataccttccacgttttctacctttagtgagctgcacccaaacatgttgtttgttgacttgattgttttctccttccttgacacgatcattatacaccacctaattaagatatgtagtggcaccattgcatggttttagatgatttcactttttttgattgccaaacttgaaactagaaactagaataagcagaacacataccgctaactattcagctttcttgttggcatactgtcccttgccctttgcatgtcgatgtgtgcgttcaaagacatcaatatcatcaacatccgtccctgcattctcaattatctatccaaaagtacatatcatagtgagaagtcaaagtagtataaatcataataggaaaatcatttaactttggtaccatggcttgtttatgcatagcaacacttcgtgaaccacaagtatgatgaacaccacctccttccatccgatttttgctgttttgagctgacaccttctttacattttcatcagaccacaagtcacacaacatatcccaccacttttgctcaatccaataaggagggaatgccttccaaagttgaggttcatcaacatcaaaatcatcatgagaaggggcatctccatcctgttgtaactcagtcgcacgcatattttcgatatgcttctccaaagaacgttttgcttcagatttctcatgtgacaaagcttggctaaaacgttcaacagctttgcgataaaataatctagcacaatcctcttctctaccatcagcaaacttaaaacacagctgtaaaaggataaggtaggacgtcaatccattaaaagaacctaaatattctatgtgaatgctaacactgtaactcaccaaaaattccttcagaatagttatccttgtatgagcagaaaagttgtgataatgagcaatgacaactgcttcatcctcaggcacctgtttgccatgtttatccaaaggtctatatgtgccagggtagtgagcttttataagacatgtgatggtagatgaaacattcttcttcataggattcgtaatccaagcactagaaacaacatgccatttaccaagttaggtaatattagtgtaaaacaatgaaagtgataaaaaaatatgttcagccatcataatattggatttataggaactatgcatctgtatttcttaaaatttaacatggagtttacaacaagattttcaattattaacaacaatgatatacatattatatggagtgtgtgtttgtgtgtgtgatagacagtgtgtgttttaatataagcagaaatttagagtgtcaacttactctttattgagtggagttatcactgccctatctttctctggaactggtgccatcaaaacatttggaccacgaccacccttactttcttttgttgaagtaaccaaagaatttgaaggttcatcttgtgttgaatcctcaaaatggtcttcaacttcaggatccggataatgtcgatggcgtcttgacatagtacttaactagtaaaaacaagggttattttgcaagcaaatgtagtcattgaagaatagataacatagtaaatttgtaataatgccactgctcatgagaaaatgaaataataatatcacacacacacacacacacacatatatatatcaattgtttagtcactagaatcactatcattgtctgagtcattatctgattctattggcccttcatcttcactgctgcaatcactgtccatggcaacataactctctatgttctcatggctatttggtctatttaaaaaatccatatcttctggatcaacttgctcaacaatatttgattcatgaagcaagctttcatcaccaagctcctgtgaaatgtcagctccaagctgctctccctcttgataatattcagaaactacaggaggaagcgaatcatcaacttcatcgtccactgcaggaacgggtaaagtaccaattggatttgttttgaatgcaacccaccaatcttttctttcacgtggtggcgatggatatggtgtataatatacttggtccacttggtatgcaagcacaaaaggctcatattgttccaatcttgatgtatggttaacttcaactaggcctagtgctttgtcatacttcactcctttcttaggatcaaaccagacacacttaaatagagccacctttagatcactatcactgacatattccaactctattatctcctgaatagtgccatagtagtcaggcccttggttatcaaaccaatttgctgacacacaaactccactatttgtcattgtcctcgatgatttcttttgttcatatggttgtgtacgaaaacgaaacccctgaacatcacatcccttataacacttaaccatgtatcggggcccaatggaaagagcccttacttgttcttcaactgtttcatcttttccagcctgtagaatcaattttcatgaatcatgcattaaaataaataataatccatcagatattacatcatgtattcttaccaactcacgaacccaggttggaaaatctttctcatgcatctcttgtaattgagttgtagtgatgttcctgttttgttgtttcatccccctatcaaatttcctgacatttattgcaataacataaatgtaatatgtcatattcacaaaaatagagcccaagtaataaaataggaaaacagaataatatatacttacaagacatatttgtcaacttctgcacaattgagtaatgcatataccctagcagcctgccattcttctcttgataagttacatgatgtgctctttccaagagtgcgatatgggatagagaatatagacagccagtcagtaggtgctctgaaaccaccatcatcatgtctagggacgcgagtgtgctttgttcgcacatgatcagcaaagtacatagaaataaaattagagacctcctgtactctatacccctctacaattgaaccttcgacacgtgctttgtttcgaaccttcttgcgagcctcatgtaactccctatgaattgagcagaaaacataattatgaaattaatatacaaattcacactttagtacttaaccaaagaaacatacctttcaaatacatacatccagcggtaagctacaggccctccaattaaagcttcataagctagatgcaccaccaagtgttccatacaatcaaaaaatccaggaggaaaaatctgttcaagtttacacacaatgactggcacttccttttgtaggtgcttcatttgttctatatccacctcttttgcacatagttgcctaaagaagtagctcagttctgctaaacacttccagatgtgcttggggaggaaatcacgaaatgccacaggtagcaacctttccatgaagacatggcaatcatgactcttcattcctatgatcttgcctcgattaatatcaacaccctgtgctaaatttgatgcataaccatcagggaatttaagattcttaacccattgcagtaccaatttcttctgtgccttatctagactataacaagcttttggtttcacccatcgacctatagatttttgttgcatatgaagttctttgcgattgcatatattggctaaatcaaattgagccttgacattatctttagtcttctttgggatatccatcaaagtattccatatattgtcaaacacattcttttcaatgtgcatcacatcaaggttgtgccgtactaacaactcacgccagtaaggcaactcccaaaagatagatctttttacccaattatgctcctttccaaaaccctcaatctcttgatttcctgccttggtaccaaatgtaatttgagggagagatttaacacaatcatacacttctgaagatgatcgatgaataggtgggccatctttctcctccttattctggatgaacttgtcttttgcatgtctaaaagggtgtccctttggtaggaaacgcctatgacaatcaaaccaacatggcttgcctccaacttttagccaaaatgactttgtgtcttccatgcaaattggacaagctaattaaccgtgtgtgctccagccgcacaacatcccatatgcaggaaagtcacttactgtccccataagggcagctcgcatgacaaagttctggttttttgagcgatcatatgtcacaactccttctctccaaagttgcaaaagttcatcaattagtggatggaagaatacatctatgttctttccagggtgcgtaggccctggtataaccatggtaaggaaaatattatgtgccttcatgcataatgctgggggcaagttatatgggacaacaaaaacaggccaacaggagt

SEQ ID NO: 38047 - DNA, 4608 bp, Oryza sativa
ttaactttttctttctgctttcattgttgcacctctctgattcaagcccatccttgtggtatgtcatgtgtgttgcagtgcctcgtgacatgtagagcctctgtaggcgtggaatgattgggaggtagcgagcaccttctgtggagtgcccttcttattctcagggagttctaacccttcaatataacgaggctcattacatgttatacatttccttttgttagcatgctccttatagtataacatgcaatcattcttacaaacatcaatcttttggacaggcatacctaaagcttcgacgactttcttgcatttgtaaaaactacctggcaaatttgcatctggaggcaacatttctttcataaccttgaccagctcatcaaagcaagctacagacatattatggtctgattttattgtcaacaaccgagagactgcagataattgagagtgttttccacacttctcccacaatggcttgtctgctgcatctaacatatcaaaaaatgaagctgcttcagcatttggaggctcttcaatattttgacaaaaattaggccctgcggcatccaacaccatctcatctatatgatctgactctccataggcattacctcctttattcatctcattgtcaatactgccttctggtgtctcactggtatcagctccactttcaccatgtctactccacacatggtaattttcagtaaatcctttattgcaaaggtgcatttgaactattcttttgtcatgcagctgcccattcttgcacttcgtacaagggcatctaacccttttctctgcctgaccttgtaactttgatacagcgtgtgacataaacctcttaactcctttcaaatactcatctgaaatgtatccattcactacccttttatacatccaactacggtcctcagccattaatctcacactaaacaagctattctgacatgcaaataatggctagccctacacttgaaattatatggtaaggatgcatattttgaaagattatgtaaaggaagtttatcaaaataagaagaggaaagattagatgtagactaatagcaaatcttcttttaaatacaaaaaataattgctcccagataaatcattattagtgataacttgaacatattaagtagtacatatttctctataatttgtttactctgtctacacttcaatacaccaaaagaataaacaacatgtgtcttagcttgtttaatttactgaatttttgcacacatgccaatggtttgctatcagattgcacaattattaacactcaaattccatcgtactttcagaagacctgaattttctaaccacttaaagcaatcctgagattgcacaattattaacattcaaattccaccgtactttcaggagacctgaattttctaaccacttaaaacaatcctgagatcagtaccaatcataaattaaactatgttaataattcctacctgtatattctaatccgaagaactgatgatagaatatatatctactagagatactcgtaatttttgggcaataaaaatatctagtagcgagcaactaaagaattagaaacacaagcatcgtcaggaacttgagtcatacatgtgcaagttagagagcaaattttagtgtgtattacttaaaccataaacaaattaatccaatatccaacatcctggagcaaggagagtagaagaaaccaaaaggatgatgaacattctttcaaaatcattagttgagatgctcatgggatacaatcacaaaagatgaaaatcacaggacatgacaaaattcttacaggggaattccatcgagcagctggtaggcacacattaatcaagatgttacctgaggaggaaggatcggggcacggcagagcggcacactccgacgaggtaggagtgctgggcctgggtgtcaggcaccgggctacaggaggtgccgcacctgatggctcggagtgcgacgggggtgccaacctgcgtcgaggcaagcgcgcggcaggggattgttagcgatcatgcgaggaagaaaacaaatgaagaaaattgggtgctacaaactcacggaggggcaaataaatctctccaatcagatgaggaaatcacaattagaccggcaaacatggggagtgggagagatgggataatgggggtcgatgattttggggggaatgccagaaaatcgcgggaaggaaaaagatggattgggacttgggggtttttttcatgagagctagagagcccttctttttctttttttttttgagttgacggggtttttctagagggctggcaggttttttttttaagtacgggaaaacatcctttttttcagggagtgggatgtggctgggtcaaaacaaactccagatattccctcattaaaaaactaactcaggataaaatattgcatcaaaaatttatacatggtaatattatttataaaatatatgaaatctcgtgttttctattatacaaaaattatgtaattattttcaaagttacatgagcataagagtaaaatataccgtctttaaatatagattttgcatcctttatttctagataatcaatctagaatttttttaattttttcaatttttataacgatcgttgctacgggagtagagccaccagtaataacataagtgtggtaggcgtgtacaataataccttcgattaagtggcggtcatggagcttgacgacgaagatagaacagtggcaacgctactcaacctgtcaaccatggagacagtgtatataagacctcggcaacgacaacagtggttataataatgtattaattagagggttggcgtgatggcgacaacaagtagtagctactagagtgttaggtagtagtgacaagcatgctagcatgggaaaatatccctttagagtagaggtgccaatgtactgataaatttttatacggcagatacaacggtgggcgccttctctcgtttgcatgacacttgttacatatggctaaaaaaatatatcatggcgttacaccattttattaatgtaatatttaaataaaacctatactaaaatataaccttagatgtgactcggtatctctactattaaaatattcgtgttattaaaagatcatgataattaatttatgtttttctattaatggaagacaaacagttatgcatgtcacacgcacatgccctgtttttatcatttgcaggcccttccgaatagttcatttatatttttttttatagtactggtaatgaggtcgcgtggtcgacattttatattaacacgtttcatacaatttttatcggttagctatactttaattagcaaactaaaacttagtaaatgtaaaagaagtttttgacagtacaggcacaatttcatttgcaattctttaattttgttttttatttagctatttatagagtttttttcacagaaatcaattaaatatatttttatttttagataatgtttaatctatttataaataaaaacaagctcacaagatccatgcatggctagcgtaatactagcaattaactaactgtataatttatattatgtaatttatattacaaagagatgctttatttcatacaatcccaaggaccatcgcatatgccttggggatgacgacattctacaagggtacgttcatgacccttgcaaataaacattattagcaaggaactagagtgatggtagcagataaggatcttctgcaaggctatactattgcaaggggaaatagtcttgacaataattacatttcttatagtggtagtggatatttttagtgtatcaatgatgtattaggcttattttattggtacatatgcaattcactcaacttttaaaacgtaataagtaatagtgagaatagtataatttatatgttactcgttcaaagtgttttttttaattttagagatattcttatcatttaatatcatttgaatagaaatggtgagatacgacttttttatcattgtttttataaaacaatcaataagacgcccgtgcatctgcgcaggctttgttcctagttgatatcaataattcaatattttatgacaacaaagaaaaagaagaaaattacacatcaaattattggtcgaataaaaggggatccacttgggtaatctggtccaacacgcaggacactatttacatgattaaaagggctataagatgtgattgttctaaatgtgatatcttttaacaacaaagataaaatgtggatacatagctgctaattgtatatgctgataacaatgaccatagtcttaaaaagtaactgtgaaaacatgaagcaggtaactattattcagaaaacgtgttcacattaatcacattatgtgtgaaatggaagaattatacagacaacattctgtgatctgcagtctaaataccatggagattttggcatgcacctttttgagaagctggtgatggtcaaatccgagagtaactgatccctcaatcctgttgatagtttgatatggtacgcaaacagagcaacagtagaagctgttacatttatatgctttggcatttatatgaaacttggtcataaacaaactcaaatcaaactatgat

SEQ ID NO: 38048 - DNA, 21929 bp, Oryza sativa
caacaaatttttggggccatgcatgtatgatgtatggcagcagcaaggcacgtgcatttacccttgatcgctggagtttgttcatagacggtcccacatttgtgcaacaaatcgcatcgggactgtgaaattcaaggcggtacatatactggaaaagatgaacagctacaggagttccatagagaaaataaagtaaaagaactaaaaagacaacacaaaaaggttacttcgtaccactgttatttgacatcgccataacagtgaagcattctctaaatagccaagggcatccacaatataagctactcctaaagtgtcctcactaactaaggacacacgtaggaaaactcaactcgcaatggaggacacccctgaatgggctcctcaaaatcccaacctataaagccacaagtattgttttcctcttctacccctctcttcaaactaaggaatttgaagacatgaagcattcagaatacacgaatatattcaacacagtaattttcaatcaagagtaacctatatattataatctaattaagcaatagaatactagtattttctatcacactctcaagtactacttcaccacatcatctgtactactctatcttatcctcttcgttcatagccattcaccgcatcatctgtactactctatctcatctttttccccaatcttccatcgagagcagcaaaccgatgccaagatcggtggatggcatagcgagctcgcatacgcggccgagctgggtaccgggcggagcaagcaaggcggcagtcggctgacgagctcactcgcgcggccgagctgggtaccgggcgaagcaagcgaggcggagcaatcgaagcggacgcacggcaggagcgagctgccaccatggtcagcacaagctcaagctgcgtggtttgcgactttgccccaccgcgccgccgtctactccgccacacagcgccgcccgtgagctcccttcagctcgagctcgaggggaacgggagagagaggggagaggggtggaaggagaatatggaggtggagcacccgttgcccgaggcacccgtcgccgcagcgcgtgcctcgagcccatcccctggccgaaaaggaggagccgcatcgcccagacgggagtcgcgtggcgtcgttgggggacggtgcgaacgaaaaagtaaacggagatggacggaaggagctagggacacgcccctgaggctacccattgctgatggcctaaacatccataattttttaaaaagtaaaaaattcacgccagcagaatgccaaaacatagagaaggaagttaacttttcaggaaacaaatatcaggcgatgtccaacgtggaagagggaagacctccacgtacgattggatataactactggaaactaatctttgctcggtcgccccaaaaccacaatagtcccggttacaaaaagaaccgggactaaagatgatctttagtcctggtttaaaaccccacagccattctacgatctttagtccctaaagatcatctttagtcccagttcatccctatcagtcccttgtcagaggggcggggatctttagtccctgttggtgtcacaaaccgggcttaaagatcacctagatcaccactttagtccagactaaagatctcctctttactccctataacaaacggaactaacatcacgcgtagtatataatccctattccctatcctctccaccacaaccggcctcaatctcctcaacaaccggcctctcctctcctcagatccatctccctctcctcccatcctagccctctcctcccctcctcccttcctatccgatgcccagcgagggccgcctcctccccctcctgccttcccgtgcccagcgcctcctccccctcctcccttaccgtgccaagtggggccgcacgcggcaggtggccggcgaggccgcatgcagcaggcggctgagcacaggccgagtagcgagcgggcggcgctaccggcatccattctttattttttttacaatttgtgattcactgagatgtataattttgtgatttgttgtatagatttgagatgtataatatgtgatgtatttggtttgtgtgtaatttttttaggatttgtgatgtatttgatttgtgtgtacaagtaacttaagatttgtgatgtgaatgttttggaatattactttgatttcggaatatgcatccaactcgatttgggagaaaatacaggattaaactctggctaaaaaacaatgaaaaaaaaagaaaaagagacctaattggactgccactaccctctctttagtctcagttgatatcacaccaaccgggactaaaatccatctttagttcgggttatttcaatcgggactaaagatgcgccggattgctagtcccggttgaaaaacgccggattgctagtcccggttggaaaaccgccggttgaaaaaccgggactaaatgggttaccaaccgggagtataaatggtttctggttgctgagccgccatcaaacctaggcgagatgaaccatatatatataatatccgatggagttgatgaatcggccggcaaatcacatgatgcattgatacattaatgcatttatatttaatgaagatgaaaataaattaggacattggcagtttatattaagaagatgaatagctatggcgtttcaagcagcagctttcaagttttgctttattgttggactgcaaacatgaatagtcaaggatcctagggggcaccgcccacatcgagctgagccatccaatgggcttgtctaagattttctgcaaatttgagcttcacatgaatgaaagcaaattcatctcagtgccgcggccgcacccgcgctgtccaccacgcctaagccgaggccggggccgcgccgtgcgcacgcacgatgcgccgttccgcgcatccgccgcactgcgtcgtgccaccacggagatgatgccctgccgcgccgcgtgcttgtcaccgggccgaccaccacgcacgaagaacaaagaaaggaagaagaacaagaaaagaaaaatgaaaaaaaaaagagggtgcgccatcggccgtcgccccggcgccgacagcattggcgcccgaccgccgaccgcgcctgcagcaccgccgccgcacggccacgcctgtggcgtccggccgttccccgttacccggcatccgcatatggcaaggaacaatcgggggagaaaaatgaaagaacgaaaaaaaaggggaaaaggcgacgaacagcaccagatggccgagccgccgtcgccggccgcccaccacaaatagcacgccatgccacgccacccttcggctcgccgcgccgcccccctggccgctgcaaccacgcatgaacgaggtcgacgccgctgccgtgcccgcgccggcctaatccggccgcgtcgccttgcccggccacgaccgccgcgacgggcgtgctcgcggcgccggtcgcccgcccgcacccgcgccgccgcttacgtatggccgcgctgtcgccgacctagccgcgccgcgccacgctgcatccgcatggccgctccaccgttccccggccgccgccccgcgccgcccccgccggtcgccgaccgagtcacgccatcggccgcccccacatggaaaggaaccatcggtggaaaggaaaagaaggaaagaagaagaaagggaaagagaagtggaaaggaccgatgctcatgtgattttgcaaatggacccttgcattttttggaaattaagtgcatattcctctgcaaaggaaatttaccttttaaatcctaatgttttaagaaaacacacaaataacctctgcatttgggatatttgtttgaaaagcatttgaaatttgcaaatatcactaaaatcatattcacgcataaaaagggtccatcggacattgcatttcgaccttgactttgtatttaaggtatcttttattgctgatgtttatgattatgaaatttatttatcgcatatatgattattgattatttatgatgcttttattacttttaattgatatcattgcagtaaatatatagaatagcatataatatattgaaattatttgcggcaattttgtgtaccatcgcattgcaacatttgtgtatttgttaacgaccaaatttggtaatatcagcatcggaaaaggagattagatcaaggtggagttgaaggcggagattgatcctagaacagagcaagaatcggctgaagtccagatcggctacgattaggatcggctgggtctgagtcggactaggtgagccgattcagccgattctgatagtataatttggtgtatgacattgggttgaatcgaggtgcttcaagatgattgccgcacattgatagagtcctgagaaggcaattgtatctattaattacgatgttttatgtaactttcttagagatatgtttgggcaaaagtctgccgcaaagacttatggtatcttagagcttgttagagatagtggtcgtgtccggtatggacatatcttgtaattctcgggtataaatagacctcgagccctatgtaattggtaacacacacgttcaatacaatttcggcgcatcgccacttttttgctttagttttgtttcgacgagttcttgctttcgggttgagctgcattggtttcgatcttcaacaagaggtaaaacttgttatgacgacttgcgttctcgagattagtgcttccatctttatgacactctaatcttgtctatataattcgtcaagttatcatatatcctacataatctttggcaatatcgtcatctaacctacaatcggctaatatctgttaatagaaggcagccgattaggttaaatagcgacgttgtcctagattatataagatatctaccactttatgaaacacccagcggcttgattgtctagatattgttcttcttttcatacttaatgctgcatcagttgagtttgatctattaagtcgtgcttagaatatcaatctctagcctgtcctctggttgccgattagggtagcatcggagtttcagccgatattatctgatttaaccatattcaatctatatgcttcaatgacatgttaaatctgccatttatgtcaggatcttattgcatttaagtatattaagcttttgtttggtatattatatttgttttgatatctttatataaagtagtatcggagtattagcggatacatgctagatctatctgattggctatgctataaacatatataatcctgttattaatatatatttcgatcgaagtgatttattctgtctcggcatggtggccgatctaccccaatcacttgatttaagtatatattaatataagaactatatatcgttaatatatacagccgatcgaatagatttagtttcttactatctatttataaccgccgatcgattcacatatgacatcggctcaaagataaatgatgtcatcggcacctagccaatcggctatcatttatagatttaaccacgaattctttgtctctatttcttgttgattacaggatcaaatcaactggcacgctcatacattcgaaggcgagctttggacctgcactggagttaagcagatctcccaggcctcatgttttctatcaacacgcttttggcacgcccggtgggacaaattagaagtcagcaagcaattcttcctcatggccgagaagccaccgctatcgccatcctcggctagcccaagcactgttaaataaaagatccagaagttggggttgactcgtgcccatcgatccagagaaattcacacctgagcagaagaaggattttgaagcaatgttgcagcaagcccaggatcaggtcttgaactcattcatgcagccccgcaagggaacattggttcagaagtataaagtaaaggtagttgcggatgaccctgggaccagttcttccaaaggtgaagacgggaaataagctccaaatggctcggctcaactgagtgacaaaggtgctaccgacggttctctaggaagtcaaggtgacaactctcaaggggtgcatggagttcaaggtgatggtgctcaggggttacaagagggaaatcttaatcagaatagtgatgcggcacaagatttttttaataatttccaagaccgggtcgactatgttgtgcaccatgctttgatcaatcagtctggggtgttagtcaataccttatcaaacatgacgaagtcaatagcagatggatcaatagctgagcatcaggctgcaagcaattcttcctcatggccgagaagccaccgcagtcgccatcctcggctagcccaagcactgttaaataaaagatccagaagttggggttgactgatgtcaatgaaggaaacgtcgtgcccatcaatccagagaaattcacacctgagcagaaggattttgaagcagtgttgtagcaagcccgggatcaggtcttgaactcattcatgcagacccgcaagggaacattggttcagaagtataaagtaaaggtagttgccgatgaccctgggaccagttcttccaaaggtgaagacgggaaacaagctccaaatggcttggctcaactgagtgacaaagctgctaccgacggttctctaggaagtcaagctgacaactctcaaggggtgcatggagttcaaggtgatggtgctcaggggttgcaacgtggaaatcttaatcagaatagtgatgcggcacaagattttttcaataatttccaagaccgggtcgactatgttgtgcaccatgctttgatcaatcagtctggggtgttagtcaataccttatcaaacatgacgaagtcaatagccgatggatcaatagctgagcatcaggctgcaggcccagtttatttgcaaggaggtgtctttccaaattatcggcctttgattactgatgcccaaccatctatttaggcagttccccccgtcgcaccatcagctcagccgacggcgacggcatcgactcccttacctgctccgtcagcattggcaccaggccagctggtgaaccctcagttgttaatgagagagcagccacaacatagtgggcaggttgtgaatcggccgacgcaagatcaggttgctgccatgtttctgccgcctcaacctgctgttgatccaatacagcattagccgattcaacagacactcccgagtcagcaggttgtacaaccaatccagcaacaagttgtgtaaccagtccagcaaacgccaccaaggcaacagcctccgcggccgattcagcgaacgccattaagatagcaaatcattcagccgattcagcaccaaggctcaatgagcgcatcggccaggtttgtgacgcctggtggacaacctgtacaacaatttttaaatcaagtcgtcccagaacacttgtttcaccccgtgcagccggatggcacagtaatgcctcaagttgttcccgagcatttggcacgtaatattcagccgaaccttcataattaccagggggcagcttgaattatcaatatcagcctccttccccgcaagcccaatatcagtcagggggactggctcaacctcagtttgcgtctcaatacggtcagttcgagcccatgcaacaatagtcacagggagcagctcagcaacgaccgtgggccgatgtgattgctgatgtaatgagggaacagtttgggcttaaaccaaaagagactggaagcttgtatcggctgccttaccctgagtggtttgagagagttcctctcaacattcagttcaaagttccggacttctccaaatttttgggacaagatggtgtgtcaacttatgagcacattagccgatttttagctcagtgcggtaaagcatcggttgtggacgctctgagggttaggttgttccagttatctttgtttggatcggcttttacttggttttcttctttgccatatgggttcatcaatagttgggccgatttggagaagcaattccacagctatttctacagtggggttcatgagatgaagttatccgacttaacggcgattaagcagcggcatgatgactctgagatagctgcagccgaatgggtgaggagtaaaaaggtcataccgtgccaatgggtgaatagttctagaaaggaagagaagtatgattttgatattactaaagctgacaagatttttgatctgctactccgagagaagcaaattcaactccctgctggtcaaacgattccatcggctgaggaattaagtaaaaagagatattgcaaatggtataattctgggtctcattctactatcgattgcaaggtgtttagacaacagattcaggtggccattgagggaggcaagattaagtttgatgattccaaaaagccgatgagggtcgatggtaacccatttcccgttaacatggtacacacagctagccgaacaactgatacggggcgcatgaggggttatcaagtaagttcggctagaattataaacaaatatcaaaggaaatacgacaagcaacaggaaaagcatcatgaagaagataatggtagctctgatcctcattggggctgtgagttcttcaggttctgttggaatgaaggtatgaggttaccatctatcgaggattgtcctggatgcagtgatgttgcagggggttcaagccgattgtacgatggaggcaattggccaaaacagacaagagtacttgttcatcagagattgggcccagtaaaccaacgtggtgattcgaaagatgatgaaaataagaagactgaatggtgtcctcttagtatttttacgaagaatcagaaaagaagggttcaaagattgaggagtagggaatgcttccagcaggtcgaacaagaaattaatcatcggctgaagaaagcaaaatcgaggcaggagtggtgtgttaagaatcaggctcctgtagccgatgatgttgcagctgatgaggcaaagaggttggcaaaaggaaagagtgttgtgacggcaccagttaacatggtttttaccttgccagccgaattcgggatcgatcaagccgatgtcgacgaggtggaagaggaatcggctaagttggttctatcaccagaacaggcggtgttcgagaagcctgaggggacagagaatcgacatcttaaaccattgtatataaatggctatgtcaatgggaagccgatgtcgaaaatttgatgccttatgctacgttcaggaagttgggtagaaatgccgaggatcttatcaagacaaatatagtgctcaaggactttggtggcaatccatcggaaaccaaaggtgttctaaatgtggagctgacagtcggcagtaagactattcctaccacgtttttttgtcatcgatgggaagggttcttacagcttgttgcttggaagggattggattcacgccaattgttgtattccttcaactatgcatcaatgcttgattcaatggcaaggcgacaaaatagagatcgtactagccgacaggtcagttaatgttgccagtgccgatttagctctttgggagatggatggccttgattgtttatctggaaaagtttggaatggagattttctaaaagtgtccgattctgatatacagccagttgaagttggagaacccaagctattattttgagggcgttgtggagggttcaagtgtctacactaaggatacggtagatgatctcgatgacaagcaaggtgaaggttttatgtcagccgatgatttggaagaaatagatataggtccaggtgatcggccaaggccgacatttattagtaagaatttgtctctagaatttagaaccaagctgatagagctcttaaaagagtttagagattgcttcgcttgggagtattatgagatgcctggactcagccaatcaattgtagaacatcggctacctatcaaaccaggggttaggccgcaccagcagcctccgaggagatgtaaagccaatatgcttgaacctatcaaagctgagattaagagtttatatgatgctggttttattcgtccttgccaatatgctgagtgggtttctagcatagttcctgtcatcaagaagaacggcaaggtgagggtatgcattgattttagagatctgaataaagctacaccgaaagatgaatatccaatgccagtagccgatcagctggttgatgccgtgttagggaacaaaattttgagttttatggatggaaacgcagggtataatcaaatttttatggctgaagaagatatccataagacagcttttagatgttctggtgcaatcggcttatttgaatgggttgttttgactttcggcttgaagagtgctggagctacatatcaacgggccatgaattatatttatcatgatctaatcgactggctggttgaggtctatattgatgatgtggttgttaaatctaaggaaataaaagagcacatagccgatttaagaaaagttttcgagaggcccaggaaatatggcttgaagatgaatccgacaaagtgtgcttttggtgtatcggatgggcagttcttgggatttcttgtccacgagaggggaattgagataactcagagaagtatcaatgcgatcaaaaagattaagcccccggaaaacaagaccgaattggaagaaatgatcggcaagattaattttgttcgaaggtttatttctaatttgtccggaaaattaaaaccttttacaccattgttaagattgaaggccgatcagcattttacttgggggcagagcagcaaaaggctttggataatattaaaggatacctgagttcccctcctattttgattcctccacagaaagggataacttttagattgtatctgtcggtcggtgagaactcaatcggctcaatcttgattcaggagttggatggaaaagaacgagttgtattttatcgcagtcgtcggttcttagatgcagagactagatgttctcctgtggagaagttatgcttatgtttatatttttcaagcacaaggttaaggcattatttactgtccaatgaatgtactattatatgcaaggccaacattgttagatatatgttatcggctccaatattgaaaggaagggttggaaagtggatattttccttaactgagtttgatcttcggtatgagtcaccgaaggcgattaagggacaagctatagccgattttattgtggaacatcgtgatgattcaatcggctcggttgaaatggtgccatggagtttattctttgatggatcggtgtgtaatcatggttgtggtatcggcctagttataatttcccctaggggcatattttgagtttgcttatactattaaaccttatgcgactaataatcaagctgagtgtgaagcagtgcttaaagggttgcaattgctcaaagaagttgaagccgatgctactgaaatcatgggggattctttactggtaatcaatcaattggcaggggagtatgaatgcaggaatgatacgttaatagtttataatgagaagtgccaagaactgatgaaggaactttggctggttactttaaagcatgtatctcgagaacaaaatattgaagctaatgatctggcccaaggggcatcagggtataagccgatgatcaaagatgttaaggttgaaattgcagcaataacagccgatgattggaggtatgatgtgcatcaatatttacataatccatctcaatcggcttctaggaaattaagatataaggcgttgaagtacacactattggatgatgagctttattatcatacgattgatggagtgttactaagtgtttgagtgccgatcaggctaaagttgctatcggcgaggttcatgaaggaatttgtggcactcaccaatcggcccataagatgaagtggttacttcggcgtgcagggtatttttggcccacaatgttggaggattgcttcagatattataaggggtgttaagattgtcagaagtttggggcaattcaacgagcgccgacgtcggctatgaatcctattattaaaccgtggccatttagaggttggggaattgatatgatcggtatgataaacccaccatcaagtaaagggtataagtttatattggtggcgactgattatttcaccaagtgggtggaggccattcctttgaagaaagttgattctggggatacaactcaatttgttcaagaacatataatctaccgatttggtattccttaaactattatgactgatcaaggttcaatcttcatgtccgatgagtttgttcagtttgccgacagcgtgggtatcaaattgttgaattcttcaccatattatgcacaagctaatgggcaggccgaggcatctaacaagagcttgatctaattaattaagcagaagatttcttattatcctcggcaatggcatacccggttggccgaagcattgtggtcttatcggatggcttgtcatggatcaattcaagttcctccttataagcttgtttatagacatgaagctgttttgccatgggaagttagaatcggctatagaaggatagaattgcaagacggtttgacagtcgatgagtattataatcttatggccgatgagagggaggacttggttcaatcgcgtttatgagcccttgctaaggttaccaaagataaggaacgagttgctaggcattataacaagaaagtagtgcctaaggattttttggaaggtgaacttgtatggaagttgattttgtcgattggaactcgggataacaagttcggcaagtggtcaccaaattgggaaggaccgtttcaaatctataaggttgtgtctaaaggggcatatatgttgcaagggcttgatggtgaggtttgtggacgagcgctcaatggcaaatacttgaagaagtattacccaagtgtttgggttgacgcatgatcgactcgtgttgctgatgcatgacagccgatgtgttttacatcgtcttgagatggctgatattgttatatcgcccttagtcgtttttccaattgtaatcggttatggtttgccgatatataacggccgatattgtatcgcccttagttgtttttctaattttatcaatgctgttgacattataaaattggggggcacatatataccaaaaatgaaagtgaaaattagaagttatgttaatcggcacaaaggattgttaaaacaacagggtattaacgtatcttagccgattacaagaatttttaagtcctattacacaaaagttattgagacaagtactgctggatagccgaaatagctctttgcctaatttgttcgacttcttcaatggcttgggcatcttgagtgtcacgaccggaagtaacccaacgggcgttccttacgtgcgtgtattatttcttgtcccaggaggcaaggtacaccaaaagttgatacatttcagagtttaccaagcggaagcgtaaataattaatttattacatgggcggcgaaggcccagcacacacaaagacaaacgggaaacagcggaagactagggcgacgaccacaggcgcttgacggcaggcacgagctaaacaccaacgccttcatcttccaggaactcctcttctgggtttgggaaaaaattaagcaagactgagtacaaccaccgtactcaacaagacacacccacaagtgcagaataaatgcaagggagtacaagggggttataatataagggttagggtttgcagtaaacagcattaaaagacacttagttgcccaaagatattttgtaaatacgatcctagagttatacaatgttattaatcaaggccgtgaacccacacgaacctgccttaacccaaggcctacgatgattcagaccgaactagcaacccgaccctgggtcccagctcgtcccaagccaacccaggccaaccgttccatattttagttgttaagcaggttttaagaattaaaacactaacttgggtacattgctcggcttgcccataaccgagggcgcgactattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccagccctgtgccatgacatctcgactaccgagccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccataataatccatccattccatgttcaggtgatgagaatattcccaaagtgtagagttgtaaaaccacctaatgttgcctaattaaccagcgaagcatctacctaaattcatactagtggttaccatgagtagagtgcccactagttggggttttgtttattctagggtgaacaaggtattaatatcaataacaataataataaggtcataacaaaggtaaataggcatggctaaataaaacagtgataacgcgggaatttaagtaaagtggtaatgcaataatttaaatcaaaataattttataaactgggattcaatatgctcaaggatgatgtgacttgccttgctcactttcccaaacgtcggcttcaacctccacgaagagcggatcttccgaagctgcagcatctacacgaccatcggaaaagaaaatgattttactctaataaactccatataactagcaagaacaaagcacaaaaatgggttcttgacttcttaaggaaaaattagagacttaaatgatccaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtggggcccatgcggcagcctcacgatccacggtggatcgggtgcacccgggctcacaccggccggcgccgtgggccccacgcgtcagccgcacccgagggcgcgggcggctgacggccgggccccacgcggtccacggtggcggcacggctcggctcaccctaggtcgatggcgacgatgaaaaaggcggccggagcggaggaaggtggcggcacggctcgggtcgacggggacggcggcgctccggcggtcggcgagatcgacgagggggtggacggggacggcgacggtacacaaacttatctgtgtataaaatcctcgtccaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttcgcaacttgtcttcaactgaggttgattgattattgcaagaatgagcatatgacatactcaacaagccacacagcaaatatgcaaatacacaaggataccaaaggatggcacaatatagtctcatttgcgaaagcagcatttagcaaagagttaagagtagtaaaacagtagagtaattaatcagaaactttaatcaacactgaacaacacacccatgctgcacaggcccaaccatcctgaacaaccatacccggctgtacagatctaactccaaaccaggagctaaacaaattattaccagttatagcatcaataattattgtgagaggtgtgagactaatcacgaaaaacattgctcaacccgcccataacttgggcacggctattcgaatagttttactctggccagaggtgtaccactgtacccacaagacacagcctcaacatcatgtctaccatgcatcgcgatactagaaagtacccgaatagaggctgtgacaataccctctgcacaacacaactcaccatagtgcaccattcctggatcataatcacccccttataaaacaaggcttggactccccagtgacccccgtgggcttatctccgccacttctcagtctggtgctccgcaatgaaccatgctatacaaaaggtaaagccgttgcccacgctggcttgtggttggcacggttaatgtttcacaacagtagctcgcgaaccggtccttaattgccatgagtacgaccttcaaaaccatgtgctcacaacccaccattaatcatattttaattaccaattaattatcataacacgattaaccatcgtgagataccattaaatataaccataaataataatgtagtatatatgattcatcccattagtgagctaatgtttctaagcatggctaagcaattatatctaacatctagttgaaccaatatatataaagctcaactagtcaaattataatatcccaaggtatcaaggaatagagtaatcaatgcaaacaggccataacaaaggaatagattcacaccacctagtgacattcgaaaataaatgcacacttgaaatacatagagaatttaaatataggatcaacatgctcaaaggattgtgtttaggatctgtgtgacttgccttgcaataatcggtcttcaattaatcttctgaacactcccgacgcactcacgaaccttcgcaacgacagaaacgacaagctaacacacaaaacgaagaaaaaaactaataaaaccaaataaacagtacaaaaacaagcataaacagtacatgtggatatttttaacatgtagatctcgattttagatgaatttagcaacttgaaccagtcgaatacaagttacgatgatttagttatgaatttccgaagatttaatctattagataaaaaggaaaaagaaaaacgatgatgacgtcatgatgacctcatcaatggccggaccaagatggcgacctcgccggagattggatggtcggctgcgactttggaggacatgtacacgtagaggacgacgagacgaacccaacggtactcaccctcgaaccaaacgacgaacgacgacggccggcgacgaggtctagccgcggcgcggcttcggtcgacggcggcgacggggctccggtgaccggcgacagcggggagggagcggccgagcttgcccacacctcggcgcaccttacggcggtgacggagaccgacggcaacggcggaggcgacggcgcgacacggccgaagttcggccggcggcggcggcgaacttggcggcggcggcggagaggatacggggcacgggagaccacgggagaggggcaaacgaaagaggaggactagggggtcctatttatagccttggattgaagagattggactcctcccgcaagaaatcgatccgggaaatcaaaaactcggttttggagataaactcgaaaacgagttcgattcggataagatactcaacgattagctccgatttttggggtaaagatagaggaggataagaggaatatttcccctcaactaaattggaaaaaggagcaacggggaggcgagatttggaaggaggatgcggcggcactgtgcacggcacggctggctcaggctctgcctgagctggaagatgaacagtagcgcagggacgaaaagtagacttttccggctgggctgagaggagaggaggcggctcaggttgggccagcgtgggctgcacagcacgcgcgcgaggagggagagaagaggaaggaatggaatgggccgattcagcctaagacaagggaggagaattttattacttttccaattaaaataatcacttaaatgatctttgaattgttaaaaatacttccaatgctcaaataatttcaagaaaaatcctgaaaatacttggacactcaaagtacttaaaaaaattataattagaccatttaatgattaatttaatatgtgggtaattactgaaatgctctttgtatgattaaaaattaggaattgagctccgaaaaatccgagaatattccagagagtataattaaccatggataatttaataaaaaataaatccatccatgctttatatttaggaaattttatttcccacatttaacttcacttgtaaattaatgaacatttaatataaattctaataataatttataaatcctgaaacaaaaatcaggatgtgacatgagaggtgaattggcttccccgatcagatacaattttcttaggaacgccatggagactcacgatcctagcgaagtagagttcaactaatttgttccctccataggtggtcttcagaggaataaaccgagctaccttggttagtcggtccacgactacccatatagaatcatatccgccttgggtttttggaagtccggtgatgaaatccatcccaatttcatcccatttccattctggtacttggagaggttggagaagtccggccggtcgttggtgctctgctttgacacgctggcacacatcacaaagggccacgaactctgcaatttaccgcttcatactaacccaccagtatttctctttcaagtctaagtacatcttcgtgctgccagggtggatggaataaggactttcgtgagcttcctgaagtatcaaccgtttaagttccttgtcgtccggtacgcatacacgatttccgttccatagggttccgtgttcatcttctgtgaaaccagcagctttacgctgtttcatattcttgaggatcccatgtatatctggatcattcttctgagcctcgcggattcgatcgagcaaggtaggcttggcttccagcgtagccaagaatccacgaccaactatgcttaggttcagggcttccatctgttgattaagttccggtggaatgccacggatgccaagagtgttgcaatggctttttcgacttagagtgtcggcgaccacgttggccttaccaggatgatagtggattcccacatcataatccttgatgagctctaaccaccttctttgccgaagattcagatccgactgagtgaagatgtatttcaaactcttatgatcggtatatatttcgcagcgatttccaatgagatactgccgccggatttttagagcatgaaccacagcggctaactccaaatcatgggtaggatagttgccttcatagggccgtagctggcgtgaggcataggctaccacatgacctttctgcattaatacgcaccccaatccttggcgcgaagcgtcacagtacaccaggaagtccttgcgagtatccggtaagattaacactagcaaggaaaccagcttttctttgagagtttggaatgctttctcgcattgagggctccacacaaatttttcttccttcttcagcaactgcatcatgggtctggcaattttggagaaattctcgatgaatcttcggtagtatcctgccaaacccaaaaaactgcgaacctaagtgactgtcttgggttgcttccaatcagtgacggcggtcaccgtttcgggatccacaacaactcctttagcagatatcacgtgccctaagaacttgacttcgggcaaccagaactcacacttgctgagcttggcatacaattggtgttcccggagctttcccaacactaaacggagatgctgctgatggtcttcctctgattgtgagtacaccagtatgtcgtcaataaagaccacaacaaacttatccaggtattccatgaacactttgttcattaagttcatgaagaaggcaggagcattggttagaccgaacaacattaccgtgaattcatacagtccgtattgcgtggtgaatgcggtcttcgggatatcctcttcacggatgcgcaactggtgatatccggaacgaagatcaatcttggagaatacagtggcacctttaagctgatcgaacagatcatcgatccggggaagagggtacttctttttgatagtaacttcattgagagctctgtagtcgacacacatcctctttgtcttctctttcttctccacaaaaatcacgggagcaccccagggggaagtgctcggctgtatataccccttttctttcaactcttccaactatctcttgacttcggccagttcatttgccgccatacggtagggtcgcttgtacagaggagcggttcctggagcaagatctatctggaactcaatctctcgcttgggcggcataccgggtagttcttccggaaacacatctccgaactcactgacgatgggtatttctggcaatcctagctgatgaagtactgaactgccggcggaagttgggggtgcaaagaaaacaaccggttgatcagggccccgatacacagtgacagtgcgccttgcgcaatccactactccttggaattgagccaaccaattcatcccgaggatcacatccaagttcttggtgtctagaagaatcaaatccgaggggaaagcaattccctggatttctataggaacggcagggctataatactttgctgtcataacccctccaggggtggtgatgagcagagggttcctaagcctttctacccccagctgatttctccccatgaatggcacagatataaacgagtgggaagctccagagtcgaacaaaatggtagcagggatggaatgaatgaggaacgtaccaacgatgatgtctggagttctcagcacatcctcggcagtcacgtggttcacacggccccgagtgacatccttaccaccgttgttggggcggggaggcgcttggccttgctgtcgcctcggctttgggcatttatccgcaaagtgcccgggcttgaagcagttgaagcacagacactgttgaccttgagcatccctgcggccttgtccaggctgcacggctggtgcaggagggcggggtgcatgggccccttgctgattctgctgctgctgcggctgtgggacgcgcaccacgaattgaggtcggagcgcggagcggggttgctgctgcggctgcgaggaggatccccctggatagggattggtgtagcggatcctttggttagccccctgttggttgcggaaattcgccaagcgacgcttgtgcgactccaattccttgtgcttggcttccaggcggatgctcttgtccaccagggctggaaatcaggatagtccccggagaccaaacgaacagatagctcagggtccatccctgccaggaatttctcctgcttctcctcatcttcacgaacatcctctggggcgtaccgggccaaattattgaactcgtgcaaatactccatcacggagcggttgccttgtttcaactcccgaaattccctcttcttaagggccatgactccggcgggcacatgggtcctccggaaggcggcggtgaaatgggcccaggtgataggctgtccctctggctgcgtagctggaagtggtcccaccatagagatgctgtcacgtcccaaaacgaccctaaaatatatcctctaaattatgcctagaataattaaaatccgtgtgaaagcctccaacaattaaaatgtgcaaagttaaaagtcaaataaggcttagaggatttttgtatatttcctaaaagcctaaaatgtgtaaataaattttagtggaattttcagagcacaaataataattattaagaaataaacaaagttaaaatgattttataaaaagaaaaaccctaaaatccctccttctctctaatgggccgagttcgacccatctccctccccctctctctctcct

SEQ ID NO: 38049 - DNA, 51930 bp, Oryza sativa
  unsure (1)..(51930): unsure at all n locations
gggcccacggcgccggccagtgtgagcctgggtgcaaccggtccaccgtggaccgtgaggctgccgcgtgggccccactcccgtggacccggtccgcgcgccccctccccctcagctgacgcaataaaccccttttttaaattaaaatttaaatgaagaaattcgcaaatattcatttaaagagcatataaacttcaaatggccataacttggccatttgaactcggaattggaccgttcaagtctctaatttttccttaagaagtcaagaaccaatttttgtgctttattcctgcttgttatatggagtttattagagtaaaagccttctcttttccgctcttcgtggaggttgaagccgacatttgggaaagcgagcaaggcaagacacatcatccttgagcatattgaatcccagtttataaaattattttgatttaaattattgcattatcgctttacttaaattcccgcgttatcactgttttatctagccatgcctatttacttttgttatgaccttattattattattgttattattaccttgttcaccctagattaaacaaaaccccaactagtggacactctactcatggtaccactagtatgattttaggtagatgcttcgctggttaattagccaacattaggtggttttacaactctagactttgggatatttatatcacctggacactatggaatggttggattattgtggaattagattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactattgtctatggctaggataggttggaaactatgtcacgtcttccgtccatataccgtggtggtatgtggcatgtggttacacgtgaggaagatgtgtcttgtgggtaaagttgtacacctctgatcagagtataatctatccgaatagccgtgccctcggttatgggcaagccgagcaatgtagccaagttattgtttttaattcttaaaacctgcttaacaactaaaatgtggaatggttggcctgggttggattgggatgagctgggacccagggtcgggttgccagttcggtctgaatcatcgtaggccttgggttaaggcaggttcgtgtgggttcacggccttgattaataatattgtgtagctctaggaccgtggttacaaaatagctttgagcaactaagtgtcttttaatgctgtttactgcaaaccctaactctctatattatggctcccttgtactcccttgcatttattctgcacttgtgggtgtgtcttgttgagtacggtggttgtactcaatcttgctcaattttttcccaaacccagaagaggagttcctggaagatgaaggctttggtgtctagctcgtgcctgccgtcaagcgcctgtggtcgtcgccctagtcttccgctgtttttcgtttgtcttcttgtgtgctgggccttcgccgcccatgtaataaattaattaattacgcttccgcctgttaaactctgaattgtatcaacttttgtgtaccttgcctcctgggacaaggaataaggaataatgcacgcacgtaaggaacgcccgttgggttatttccggtcgtgacaagttggtatcagagcccccttgaccctaggacgagccttagatcccaagcctttgcaatattttcaaaataaaaatgatagcgaaaagaaacataaaaacacgcacaagctccatcgggcaaaagcacatatgtgttatacaaaggagcaaaaaattacatcatccgtttcagaacatttttgccccgcccctactaagtcccgcgaacacggttcgtcatctatactgtacacgactctaaggggggaaggaagtgaaatacacaccgacgtcaagcgataacaacttgacgattagtcatttcgaagtctaaccaaagtgtggcaatgtcatcgcggcgctggatgtggcaccggccgtaatcctctaaggttcgaccgggatgtcttcgcctccaattcgccattttgacaaccacagctacataaaaggcgaatgcttgatcgacgaaaacgccaggggggcaaaacgaatcggccgaagcatcgctcgccgaacattgaaaccgcaacagcttgtttcggaataaagataccgaacgccgttacattcaacttacgcaaaacacaagcgtttttcccaacgcaaaatgctacgagtcgaaaacggaagtcgaaagctaaaaagtcaacaaatcttttcgccaatccccaaaagggggccgaacgcatgactttgggcaaaatccccgctaaaacaatagggaaaaggggaaagaaaaaaatacaagtcaagaatcgcgcaaagcagacaaacttggcaaaatataatcacccagtgtcataatacagcttcgccattctcgaaaggcgaacgccagtgttcatatgttttctgaaggagtctaaaacgaggtttcggcaggaacatcgcccgaaaggggacgcctcatgccataccgcatagtttgcacggtctcggccgaagctccttactcacccttccccgtgaggggcttgttggaggtatgccatgaagcccttcggccggacctgtcgaaactatagtaccagcaaggattcaagccaaagacgtcaaggccattcaggcgaagccctatggcgaaagccataagcgaagatggcgaaggctnnnnnnnngaaagccacgtcgatattccgaaagtaaaggcatctcgggcgaaggcatctcgggcgaactacaaagacttcgccatgacgagttcggcatcaaggaggcccaacaggccgcccctagccttttaggcccatttgccatagaccaggcccagcctatcagcccattaaaggcccatatgtgcaaatgacactgcatacccatgtaaatgtccctttcataagggcaaccatgtaaaatcccctgtaaccctaaaccctagaaggtgcaagcttgtgctaaggctataaataaacctctagggccatgtaatgggggggatccccaaaaaatatttcacgaatcaatacaattgcttttacattccaactactgttgagagaaccacgcctttcgacatggcatagttgtccattcgacaacatttagcatatatgaaggtttgagaaaaaagactacaataccccttattaaatggtttataggtaagagtggagaatagttgagggtaaaatagggagaaatttggacgagaaatgattaaagggatcattagtactctattgtgagaattattttgggacaaattcaaatcctagagatacaattattatggggtagaggtattatattactaaccatttagtttgtaatatagcgtgactgacactaacacaacttaacatatgctaatcacttgtgttttttttttgaaacggtagacggctggagggctaccggttatattagaaggagaaacaagtgaaaacagagttattacaacgtaataagggagcattggggataatacaactcagggataggcagaaggggaagggaggctagttatgggggcttgaaaacaaaattccgtaaatctatgtcttccttgattagcgttgctacatccacaaaggaattggatgtttgtttgaaaattgttgtatttctttggttccaaatatgccatcaagttgagatcagggcattgaattttgctttgctttgtgttgcatttgccgaagatgtaagaggggcaatccactcaggaactgatccccgtggggtagtaggtagaccaagcattgttgagattgactcccaaacctgtcttgtgaaggtacaatccctaaaaaggtgaacagtgtcctctaatgcccgtcagcagagagagcaaatgcaattacaaggttagtgtcttatgagtagattgtggttgtaagtgctttttgatgtaagattagccatccgtgaaaatgttgtttaggctacgcatgagcagaccaaatgatcttgaaagaggggttcatcactgatcctagaaaatgtacttggtaagcacttcttgttgaaaaacatcttgaagaattcaaggatgatgatatgtcatcttcagtgttttcctccagagtgattagagagagcattgttcctagttggacaagttcatgaatggactccacatttgtgatctgcctgaaagaggttaaccaagagtttttagagagttatgttgcaacagttctgctcttccgttgcactagtgagaaaagatctggcaaaatatcttttggacattggtcttgaagccagttgtcatgccaaaagaggaacaaatgcctgtctttttcattgcaagggagtttcatttgggcccaaggcctctgatcatccttccatctgagctagagccatctcaatcttagcgctcttgaaaacttctcaaggtctaagattcctatgcctcccaaatctttatgttgacaagctgtttgcaaatttacgatgcatgttctagggtgggtgttttcaggctcagtccctttccaaaggaaagatcttctaagtttatcaattttcttgatgaccaatttggggattttcaaggtggtcatctgataggttgggattgctgatagaatatatttgaccaaagtttctcttccaacccagtagtctagaggagatcttttcaagaaggggtaggaaataaattttgtttagcttccttgtgtgcaggggaaggcccaagtatgttgttgggaaggaagacaatttgccatggaaattctaaaatatttgttgcatattgatgtttgcacaagctatagggaggatctctattttggcaatgttatttcgtaggccagaaacttccccaaagagctccaggagaacttttaggttttcaatctccgtggagtctggctttacaaagaatgctacatcatccgcaaatagggagattctgaatctcaaatttccaattccaaggggagagattacccttgattgttcagctagtttcatgatattattgagtggctccattgcaatgatgaagagaaaaggggagagagggtcaccccgtcttaggcctcttgcatgtttaatgggctgcccaggaatgccaattacgagcacttttgaactagacttttggaagagtgtcgaaatcccatttctccttctagtgccaaaacctaattgtgtcagaacttcaatgtgatattgctagcttacagaatcaaaagcctttgaaatatctaatttgagaatgagtgttttgaattttttcctatgaagccttttgaccaagttctggacatacatgaaattgtcatggattgatcttttccttatgaaggctctttgattgatgttaatcatctcatgcattgtcggagtgagtccattggccagaatcttagagacaatctttgcaaagctgtgtactaacttattggcctgtaatggttaggtgaagtagcatcttcttttttcgggataaagcaaatatgagcataattcagatcatccaattggtttaggttatgattgatgaaagattggactgcctttaggaggtcaagcttgatgcagtttcaaagaatttaccaataaaaccatcaggtccaggagctttctgtgcctggatagatttgaacgcctgctctaactctgctagagtgatatcttcttcctggtcattaaggtcaactattgcaagctgatttgggtccaatttaaagttgattgacttatgtgggtttgcccaactctttgatgaaagaaatgttcagctcttccactttctctagattggaagaagctattccagaagtggtttgcaacacctggatgggtttgcaacacctagatgaagttctttcttcttcttgcattttcttttaggtggaatagctttgtatttgtgtctccttctttaatccaagttagtctagatctctgtcgaattttgattttattgagcccaagaattttgtgcttcaagctactgtgcagaatttgttcttcgatagaaaaggttcatgatttctggacaacacctagttggaagataacctcgtttgtgatggccagttgaagtattatgtctcctacctgtttcgctacccatcttcttatatctcgtgccaaacgtttcagtttcatgttaggaattgctaaagggtttgtggagttgattggtctttcccaggagcttgtgaccatttcttgaaaggaatggtagcttaacctaaagctctcgaaacagaaatggcttggcctaggggatccatcactgccctacaaaaggaggggagcatggtctgaacaggagctggataggggcaatagtcaagcaaactcgtagggcaaatctcaatccatgaaatagaaagctctgtcaaattttatatctcaatccatgaaatagaaagctctgtcaaattttatttgagttgggttgcttgaggtccctgcccaagtgaacattcttccctggagagtaagcacttttatttgcaaatgaccaatggcccatataaacctttgcatcatcctcaaatcaattctcgagttgtttttgtcataggttttgtagattggattaaaatctccaattattaaccaagaaggtaaaacgatgctcatgttgtgctcaagctcttgtagaaaagcgagtttctctgcatcactttgtgggccataaacagctatgattggccaaaatgtttgttcttctctcattgtgatggtagcagtgagggagaaaactcccaatgtgacagccgttaaccgaaagaaatctcatcaactgcaaggattatgcctcctcttattccttgggctggaaggaaaacaaaagtattccgaaatctacttcccatagattgaacaatgcagggtgtgttcacctcctgaattttagtttcctacaaacagacaatcgaggcacaatgttggttgatcaggagtctcagagcttccttcttggtcggtgcatttaatcccctaacattctaattaaatattttgcagtgtcgttaagccattaggaaacaaaataaggccactaagagcatccaagcatagcacaagggagaacaaacagacaaggaaaggtttcaagagcaagagcagcttaggtttcttctagcagtattcacagttggagatagcgcgggagaagaaaactgtactcatgtgaagatacagaagtgaaacatgcttagaacaagaataacagctttaaggtctttgcaacaacatccatagatagtgcacttcttaacatagcggggaaggccttatagccttgttggtgcatcaaaactacataacacatcatacaccaaaaacattccaggttcctagaggtttgcatcacacctcctgacttgatcactgggggtttgccgtccattatttatctaggtgcctactaggttggttgcagagtagcttcatgctggcagatcaattgtctacgtcttggcaactttgaccttgatctgtttgcagccatccatctgcgcaacgtgagtgacttcttgaaacattgtaaataaagttttttttgacattctcatcaaaagagtcactctcattcatgataacaaatttcttagaaaggatttcttgagctatggtttcaattttacatccattctttcttttcttttcaaccctttcgctgtgcctttgagtagaattaagggtcacctttgggcgatgggctcggatgcgtccaagcgacagacttgggagtagtgggacctagactggcgtcaagagggatgccaccatatccccaactatatccttttcaatcgtgctggctctcaggatggattcctgccttggttcataggttggcgatgcctcgtcatcagcattcccatccacggagaagttcagttggggtaggtttgcctcaaccagcatcgaatcatcatgaaccaactagttcgctggaacttcctaatggagaaaaaagaactcagttgggggcaaggagactggaataagaagagctagtgacccgtcattgggactcttgctgcggcgtgaagaacgaggcttgtaggggggagccagcagatgggagagagaaggcagagctagtgttttagagctgcgtcatggtgaggtaggataaagagaaggtctcacctctccgtgctctttggatcggcgattgtgacccatggagatcgatggctcccttgctctctgcctgccatgatttttcctggttgtagtagctgtgctcatcacccctatgcactctgccgctcgagcagccagtgatatagccctagagagagcacgagcgtctcctgtggcatggtcttggtcgcccaccgccaccatctgggtcatcctccaggcccctcaccgcgctcagctccggcctgcatggaataggaagtggacacgagtgcgtgcgagaggcatcgtcctagaccacgtaggtccattcataggtcttgtagagcatgggttggaggtcttctagggtgtctaggtggaggatgaccgggtaggtccatcccccttcagtctcggcaatggtgggttgcatagcgggtcgatgtccaggaatggcatgtcaatggggatcagctcttcatctacattggagacgcccagccaagcttcttcttgcatccgcttcagtctcaatgaagttgatggagcacttgggctcgacaagcttcgccgtcaccccctcagtgtgaccatgcatcgggatcccctcaatgcataggcgcacacggtagtgacagctagaaggtctgatgaccctcatggtgtgagtcccaagctcggagatggtaggaacagctagaagagcggtcaagccgtagagtgcacggaataaagtccctatcagcaggcctagccaatgtgaggaaggtagcctcatcaacgcagtcactgtggttgtccaagcaccacgcaatgaaggagcagcacgagaacttttgccgaagcctctcgacctcgtcagttgcagccactgtcaccgtggctgccactagccttttttccaatagttcatccatcgcaaccggggttccacgaggggcggccactcgagaatccggcagggccttcttggtgaccgaaggttggtgggggagaggtgggaactgagagggatttgggagaagaggggggagcaagcaaggtggcaggtgaactttgtcccctactcttcgcttggagcaattaaggacttcatgtccaatccctctacaaaaccagcgtttgaagggctctctgcaatctttaattttgtgatctggagcaaggcatctgaaacactttccttccatatgtttaaagaaacgagctcttccttgcttgtgttggtcctgtggatctgcttgagcactaagggattgctgtcttctccactagtgttttgctttgacttctttccactagggatctgagataatttgggaggatcttttaatctactgagatggaggatgtgacgaggtagagattacacttccgctcttgagtactctaggcgtatcactagcgagaggcaatttgcttcgcctggtagataacctcttgctcacaagcaaactttggggggcagcagctaaaggaagagagtcactggctgcaattgaaacctaactgactggggtcagtggagcattgatgctttcagcaggagtaatcaagacttctttgaacgttttgtagaaccgctgctagggatggttctggatttgctcatcacgtggaggaggcgctaggctttccaggtgtgaaaccagatctagatctgaggggaagagtggcttaccttgtggtggaagacgacattcaagacctgagagaaggtttgagatgttacggggtggagagaagttgggcaggagagaggtctggaggtactggctggccggaggtgggggtggaggtggtggcgacagctagttgctggtgtcgagggtgggtgtctgggctaggggacgacatatttattgctactccctccgtctcagaatataacaacctagcaccggatgggatgtattctagtactatgaatctggacagccccctgtccagattcgtattactatgatgcgtcccatccgatcctagattgctatattctaggacggagggagtaatcacttatcatgtcattagtttggtgggctagggcctctagctatagctcaccacaaatggaatccattttttttcttaggccaagtgctcccttagaaactgttcaagccagtctcctactcaagtatagcaaaccaaacaagtctggatcaaccaaaatccaacaaaccaaactcatcccatatcgaagaagaaaacaaaaagaaaaaggtagcacaagatctgcaactaggaatcacgtgtacaccttgtcgtcatctgcctgctagcactagtagccacaagatagcacattgtatggaaaattaattcaaccgggtaggttaggaggccgatgttttggtgcgtacgtacaaggatgtcaagcttgccgccgaacatggcggcgaccctgccggcgatcgcctccgggtcagcgcgcacctacgcgtcggacggagacggtgacggcgagcttcttggctctccactcctccagacacctgttcagggtagcctcgttccgggcgcacgtgtgcaccgtggcgccgaagctcgccagttcctccacgatggcgcgcctggatgatgcatttatacatgcttaatcagttaatctgctgccatcgatttaactagcatctactaatacgccgaagcaacgattcgatgacttggtgaacttattcatagtataattagatgttaaaagttaattagaatcaataacaatttaacactggctgaagagctagataattaagagcacaatctgaagagatagatctgtttcactcttcaattctgaaaacagatcgatgggaaagcttggattcggcgaaggaagacgaattaattacccgattcctttgctgccaccggtgacgagagctgtggcgccggcaaggctccaccgcccgacctccggcctgctgcttgtggacatatcggcgtgcctccggtttgtgcgtcagacttgtgtgttagtgagacagcttgcagttgcagcacagggtcgagtacttctaaaggcgtaaagcattagccgtctgcactaggtgcttgtctagtccgctggccctgtccgcctccttgtgtccatctcatgaatatctttgacgtgtatttgttcagatttttctttaaaaaatactattttttatgggaaaagagagtatagcatatatcggcttgtcctgagttatccattgactttagacttgtttagttctctgagacaactccgcatccgctgtccactaaagaaacgggatcggttatctgtaatgggtttaaagcatcatctctttcggacagggcacccgtcactaagcaaagatcagtaatgtgagaaaatatcttaatcgggcatccggccatcacgaacgaatgactctcatctctaatgggcctaagctatagcctgtcacggatgactctcatctctaagcacccggaaagaatttttccggtcggtcacccattccgaaattgctctaggccaagcacgcttaatctcatagtttttttttaagattggattccgaaaaagaaattgtaacttgttggcatgagtattctattaatcctattaagccctgggcaaggatgtcacaccctagcattccctattcatatacatttattcatatacctaactatcaatatatttaatacaaccacattcatataacatccattttgatcatatatttcaccagcaaaaccgagttaattgcatcaaatatatatttagcaagtattatcacgagtagggtaaatcagacttctaggcaaaaatgaatttcaaattgaattttatggtactagatgaactcatctgaaaaagttgtaaaaaacaaagttgtagaactaattgagatctaccaattttatttagggcaattgcatatttgactctgttttgaaagccaactactaaattgaccctgttttttttaacttagcttattttaccctgcttttcaaaaacaaacatcaggcctgaccctattctgtcaatccaacgtaacagtgttaacttatggctaaaaagacatttatgcccttgcgtatttgaccgtgatttgttttctattcggtctaatttcatacacttagttgtttaaaaataacattttaacatatttgtgacacaaaaatttgacgaagaatcgataaaactacaactgaagtttaactaaattttggcagcatatattatccatcacaaattacatatactgaagaaaaaactaagagctagctagcctgcggccctggagtgcgtcgcaccaccgccggccgatgcccggagaggtggaagccactggccatagaggcgcaggggtgccgacaccgttcctgtcaccacctcctcaaatctcatcgtcactggctcgccgctgatgcaccgtcgccaatgcgaggaagagaggccaccgtcggcaccagcacagtcgccgcatggatggagagcaggtggaggagcttggcttgcatggtcgccggtgtcgggacattactccgtcgcctggaacagctaagccgccgtggccatcgactgcatgaagcagctgcttcgcgcgtgtgccgccgccgccgccacaaatccctccgcgccccggcactgccgccgctcagctggtgcggatcccctccctccccgccggcgcagatcccatcccgtcgccgctgctgctccctcccaccacgtcgtgctgccgccgctccctccctccagcgtcggcgctgctatttcctcatacgccgccattaccactcgcatttatgatacgagacatccagatagggtttattttggatagggttcctggagggtattttggataataattatattttttatttgttttttaatgaaagcttaacggagtagcgaaaaaagggtcagaccaagtgatcagttttaaaaaatagggtcaaataagaaaaccacaaaaaatagggtcaaattggtagttagcctttcaaacggggccaaataagcaattgtcccattttattttggtcatttttctatccgagtttgattaaactatataaaatttgaattctaaaatataagaaatttaaatatttttttgggtagtaaatgatttcaaatgaaaaaattatcaacaacaaagttgtatatctcctcaagatctataacttttactttggtctttctcccatataatattttttgaatagtttcaatttgaatttgaaaatatgacaacttcaaacaatattttcaaatactaaatgatttcaacagaaaaagtcatcaacaaaaaagttgtacaattcatcaagatctataacttttatttttgtcatttttctatataacatttttttgaacagtttgaatttgaatatgaaaatatgataacttcaaacaatattttcaaatactaaataatttcaactgaaaaagtcaacaacaacaaagttgtataacttatcaagatctataacttttgtttttgtcatttttctatataacatttttgaacagtttgaatttgaatttgaaaatatgacaacttcaaacaatattttcaaatactaaatgatttcaactgaaaaagtcatcaacaacaaagttttatatctcatcaagatctataacttttatttttatcatttttctatataatattttttgaacagtttgaatttgaatttgaaaatatgacagcctcaaacaatattttcaaatactaaatgatttcaactgaaaaagtcatcgacagcaaagttgtataactcatcaagatctataacttttatttttgtcatttttatatataacattttttgtgaacagattgaatttgaatttgaaaatatcacaacttcaaacaacattttcaaatactaaatgatttcaactgaaaaaattatcaacaaagttgtataactcatcaagttctgtaacttttattttggtcatttcttcatccgacaaagtgatagtaatatcgttaccaaaattcacatatctcttatctggttttataaactataacacggatatgtaaattttgtgaacaatgttactaacactttgtcggatgatgaaatgacaaacataaaagttatagatctttgtgagttatacaactttgttgttgttgacttcttttagttgaaatcatttactatttgaaaatgttgtttgaagttgtcatattttcaaattcaaactcaaactgttcataagaaatgttatatagaaaaatgatcaaaataaaagttgtaaatcttgataagttatacaactttgttgttgataatttttctatttgaaatcatttagtatttgaaaatattgattgaagttgtcatattttcaaattcaaattaaaactattcaaaaaaagttatatataaaaatgaccgaaataaaagttgtaaatcttgataagttatatagctttgttgttgacaatgtttccatttgaaatcacttactacaaaaaatttgttttgactaataaaatgaattattatactacagttaattattttgcacaggtcaactcacaaatataaacatttcatatgaaaaatggaaaaaaactaagtcatctcaattgggcataagtacagagcccgtcacgaatgagtcatctgtgacgggcctaattgttaccgattgagatataggcatacatatatgttagatgggtagtaaagtcaggcccgtcacggatgacacctatcagtgacgggccgtagtttaggcccgattgagataacattacatttctcaatcgggccctaagttggcgcccgtcatggatgacctaaactaaggcccatcagtgataggtgtcatccatgacggggttgacttttatgcccatctaacatgtctgtgcgacaatatctcaatcgggcgctttttcggcctcatctgtgacggcctgctaattctagtcatgttagctaattctaggcatgtcaggcgctaaggttctgtactagtgatctaatagatcatggaaaatcgggcgctctcctgtagctgccttatatgtgcatgttggctctctctcactctgatgcatgcatacatatgtaccgcctccccatatatgattgaccaccatacattcatacagttcttgctccacaagttctttctcctctctccgtacacaatttaaaccaaaatcatagtttcttttaaattaattattgatctttaatctaattacgtagttgtatttgatgaaattaaaacgttacaatcaaatctcacaacactatatttcaaataaaaatataattatattcttaattgaaacattgtttcatcatacatacaacatgatttatagcaggtgaaacatcacaacatttttttaaaacatccaaagaatacaacgtgcaacatttgtaaatgagctagtgaaacatcagataatatttattgcaatatctaaataacaccccgaaaaccacgtgcaacatttataaatgacatagtgcgacatccgaaattcttattgcaacatccaaataacaccatgtccaccaaacaaaaatacatttaaaaccttaaagtgtgtgttacacactgaaaattttgaatttcaaatatggaaaacaaaattttgaataattaaacacctttctcaaaatttcttcatgcaggttgttgtcaattgacaactgcatcacgtcgaaggacatggttcagttaacaatagttggaaagtaaaagcagccaggcccacctgtcaatggttgttggaggcgtatcacgaggacctttggccgggcctaccgaaaccagaggtgatcaaaagtgcgagtaggaagaaagcggcgaagatcggagaaactgcatgggcaaaggtgatatggcgaaagcagtaacatggagcctacaagctttgccaaagacagacctcgccatggggagacacggtcgaaggttcgaggcaaaagccttgccacggagagcacgagtttcgccaggcatcaggtctcaccacaaggaggcccaacaggccgacacaccctccgaagctttcgccaaaggccgggctgaaacactcaacccattaagggcccatataagcaaaagacacaggatacccatggagatgtccctatcataaggctaaccatgtaaattcccctgtaaacccaagaccttaaaacggagagtctgtaatagggctataagtagccccctaggacaatgtaacaggggatccaaaaaaattttactatgcaatataattgtctttacttccaactacagttgagagatccacgcctttcgacgtgatgcagttgtccattcgacaacagctggcgccgtgtcacaccctgaagttcttttcccaagcctaaattgaatttataaatgacctcaagaaaataccgatgtaaaagcaagagcgaaaccctaataaattaatgcaaataataatcggaattggcatgtggaatttatcttgagttctacatgtcgaaatgtgctaacaagatttttagtggaatttttagagctctagaaataattttaatcaattaaaaatgagcacaagcaatatttaatccctggaaattcatttcctcctttttctttttattttccctccttttccttttcgaataggccgctggcccattctcttcccctccccgctgggccggctgaaggccaaggcccagcagccgcccgcctcctccctcctccctttgggtcgccgacaggtggggcccacctgtcgggcccgtctcccagctccagctcccacaaccgccgccccgctcgctcccgcacctcccgggccacgtcggccacgtcgccgccttgccccgccttccccgcgcccactccctctctctcccgcccgcgcccgcgctcgagacggccgggattcgaaattcgaatcccgtctctctctcctccccacctctccccactccgccggcgaaatcgcggccatcccggccataatcgacccccgcgggtctatataaagcgcccccgtctccccctctctctttttcgttttgcaaccatccactcccgtgccctccacagccctagtgccgttgccctcctctccgccgccaccgccaccgctccggccaccgctagccgccgttagccgccgtgccgagccgtgccgtcgatgccgttgcgttcgccgtcgtgcaggccgtctcgtccacctctcctccgtcagaaaccgccgccgtaacccactccgcatcgtgcgccggtgagcaccgccatggccgccgccttcggctggcgtcctcgccctcttctatccacctctctctctctaaccccttttatcatgttcgctaggtggtttcggagctcgtgccactgccgtcatcgccctccgtcgctcgccgtcgtcaatcgccgtcggtgaggcacctcctccccttcctccctctctcccacgcagcttagccgccgtgccgccgcctagccgcttagccgccgctagcgccgtccgcgtcgccgcgacgtcgccgccctccgcccccagccggtcgccgccggtcgccgacttgcgccgccacggcatcgagccgtgccgccgtgcaccatggccgccgggccggcttgagccgcccgagcgcgccggccgcgtggttccgccgctgagggtagatcggggccgtcggttcagctgcccgcgtggctgccaggtggccgccacgtgtgcgccacgtcggcgccacatcagcgccacgtggtgcgctgccccttccccggtccatggacccagtccaccgcggaccgccacccgagtcactgacatgtgggcccgcatgtcggcgccgccccctctctctccctgggattttaattattgcgcaataaatcaattaaggattttaattattgctccgtttaagcccattcaagtcttagtaaatcaagaaaaatgcatagaatccattaaaaatggttttgttctctgtttcaatagtcttatggcctgtttgtattgtttgttttgtatgtcgcttagattccggttctcccgacgctccggtgtactttgaaatagtcgccgaggttcctccagcagcaaagcaaggcaagtcatgcattacgattgatcatattgtacccaatttacaaatgtcccgtatttctattaaatgttgcattgttttacaatgtcatgtgggatgggtcctactactcggccatatattgtttaccttttgccattgataacttaggtattaaaatgattagatgttggtttagggaatgcttagccatgcttagttcaaccagtacacaaagggggatcactttaatgcctagactttgattattggcatagctttggattagtaccaccgcaatggtgttgattaattaaaatatattaaatggttggctgtgggtgcatgattttgatggtcgcgcccatggcacttaaggaccggttcgcgggatgccctggaagaacttatcgtacttaccacaagccagcgtgggtaacggctgggcttgtagtgtagctttgctctagctgacacatccaggcaagggtgggcgtgatggagcgggacaggccctgcgacggcctctgtcgcttccggatttacgtaggcacgagaggggactgcccgttgcccgctggggacgggggtgaaacctgaggtgtggtgtgcttggctagagggggttatgcgaagggtcctgtcacggcctctttccggtatgttgtggtggcatgtcggcgcacagtaacgtgtcgtggggctctgtcttgtgggtacagttgtacacctctgatcagagtaaaactattcgaatagccgtgcccgcggttacgggtggtccaccagattcactgtgattagtctcaccctagattagcctaatggaattgattagttcaggaggatggttgggccagttgcaacgtggtgtagcgttggacagtggatgattaatattgattaattactacaactgttttactgctttcaactactgtttataaatgctcgctttatgcaaatgacccgctctagctatcctttggttatatcatgcatcatactcctattctggtatgacttgctgagtacggtggtggtacttagtcttgctctattcccctccctaaaccccagagtttgagtacgtgtcagatgatggcttctccgaggtgtaggcttcgtccgtgccatcgaggatgcctgtggagtggtgttcccgctgcagtccaagtcaaggcttagctccagttatcctttaattttccgttgcatttatgtaaaacttttatgatgtttgtaagacgtggatctgtatgtcaactttgtcgtttgtgtaccccggccggtcctggacgggggttttaatgcacattctgcttggaattctattcggaaatttctgggcgtgacacgccgtccgtggggacgtccgagcgaaaccactgagagtgagcgaaaccactgatgccaccaaaggaaatcgttaaggagagagttgccaagtgaaaggaaggcaacagcgaaggggagatggctggcgaagagggagtagagccttcgacttttgaagccgaagttggagctgcgccacccccagcagcggcgccatctcttccaccttcagcactgacgaccttgacagatgcggatacgttgaaagcggcggccacgctccagttcagggacgtgatcctttcgcctcaagtaccgggggcacctcaagctgccgccttcacctagctagccacgacgtcaacagcaatcatcaccttgcaagctgacgccaatctcaaagctcaagccaatgcagacatgggggctatacgtcagaacatggctaaactgcgagacacacttcgccagatgcaagagcagcagcaagcatacggagcagcaagacaagccaaggccaacacgcaggagtttccgacgctctacgctcagccccaagtttttcccccacatgctgcaccagccccggcgtactacgccaagcccgtcccggccgtcgctgtacgaccgccataacatgtgatttcggcgccggttcgtccagcggcacaccaagcccagtacccgaagcccactcacactccacaagcaatgatggaggcagcttcgaccttacaagcacagtttcaagccttcttgcaacaactcaatcaaccccacaacaatataccaagagcttcgcctctggcccaggacgagcggagcccaagtcaggggtgcgctagccgggcagccgttgggctagttcatcatgccaagttgttgacgtaaaaacacaaggcctgggagatctgcttaactccagtgcaggtccaaaacttgcctttgggtgtatgagcgtgccagttgatttgatcctgcaatcaacaggaaacaaagacaaagaaaccgcggttaaatccataaacgatagccaatcggctaggtgccgatgacatatcatttacctttgagccgatgtcatatgtgcatcgatcggcaattattaataagtaagaaagaacaaaatctactcgatcggctgtagatgttaacgatatataatccttaggtcgatatatacttaaatcaagtgattgggatagatcggtcgccatgtcgagacagtataaatcacttagatcgaaatatatattaacaacaagaccatatatgttcgtagcatagccgatcagatagatctagcatgtagcggctaatgctccgatacgactctatattaagatattaaagtaagtaaaatataccaaacgaaagcctaatatacttaaatgctacaagatcttagcataaaaggtagaattaacatgtcaatcaagcacataagataaaagtagttaaattaggtaagatcggctgaaactccgatgctaccctaatcggcaaccaaaagcaggctagagattgagattctaatcacgattcataagatcaaactcaactgatgcagctataagtatgaaaagaaggacaatatctagacaatcaagccgttggatgtttcatagagtggtagatatcctatataatctaagtcaacatcggtatttaacctagtcggctgccttctattaacagacgttagccgattgtaggttagatggcgatattgccggagattatataagatatatgataactcgacgaattatagcaacaagattagagtatcatgaagatggaagcactaatcccgagaacgcaagccaccataacaagttttacctcttgttgaagatcgaaatcgatgcagctcaacccaaaagcaagaactcatcgaaacaaaatgaaagtaaaagggtggcgatgccccgagattgtattgaacgtgtgttagtttgattacatggggctcgaggtctatttatacccgagatttacaaaatatgtccacattggacacgactcttatctctaacaaactctaatataccataagtctttacggcagacttttgcccaaacatatctctaaggaaattacataaaatatcctaattaatagatataattgccttctcaggactacccatgcgtggcagtcatcatgaagcttattaactcaacccgacaatgtattcttcgtcatattgtcggattcggctcaataggctaaccctgtccaactcggactttgctgatcctgatcacagctgattcggacttcagccgattcttactctatttccgaaacaatcttggatttagattccgcttcaatctgatctctatctttgatactcagattaccaaatttggtcgttaacacatgcccaccaagtccagaatattggataatgtttcgaatttgccatacgtcgactccgagagaaatccgcacttgccgttttccgaccgttacacagtgctttaaatactaaccgttgtccccgagatatctcacacagtttcctccattttcaccgccgaagccaattccgtcctctctctctccggcaatcccctcggtgcgcaaggcgatttcctctccggccaactttccgcccacggcgatgtcgacctctcccagcccgtccgccgcatcatcagccgagtacgcagaggtaagttctcatcggctagatcctcttctttcgtatcggattggttttccctttccatatcttgttttcttcttctctgttcttttggatccgtagcatctctccaacctgatcgcagttccgagcctatctgacgagaaccattactttctcggcccagtcggcaaccttgatcctactgagttcatcattggcgaaaccaatagaattcctttcagattagccaacctagatctaggtcactggaagaataccttcaaatcatggccatctctcgagaaaacttcacccgagaagagctggattacatggtacaagcgcatgtcgtctaacaagaaagttcactgggacgaaattggaatcggccaagcgcttacccttaccatagccaattcagctaaagatgaacctttaatggccgccgccacctatttctggtccaataccatcaacgcttttctgttcaaccaagggccgatgactccaactttgattgacatcaccatgattaccggattagacgtaacttcattgcctaaccctgtgagtatgaacaccaagaaccaatttgatttcaggaccaaaagcataggtggttggtctggctatgtagcggcatacatgggcaaagggcctgtcactcctcggaaacatgtggctttcttgttgatgtggctagaaaagttccttttctgtggatccagttgatgtcctacaaccaactggcaatttgtagccgaagccctagaatcaaagaaacaatttcccttagacaaaattcttcttggctacctgtaccaagtgttaaataatgcatgggccaaaatagctatcggcttagtggtaggagcaggtggcccatggtggctgctgcagacttggctgaatctgatggtcatgaaagttgtcaatcggccatctgtgatagaagctgaattcctaagattagagccgatcatagaagacgatggagaggaacgcacccatcgcaaatgcacatcctatcgagggtatgcttccacactagccgacacaggggcaaagctatcagctgaactgcttaaggattggttctgcagtttttatgaaggctttcagaaagatgctccaatttggttcccttatgaggactcagcacttctagagctcccatcggactttagatttgaagacatcaaccacgagagatacgaaaagtccagagaagtcttctcggctgcaataagcccatgcatccttcctgtcggcattcatcaagggaggaatattcaagtctcttatgaattttatcatccgatgagttctgctagacagcttgggatgggtcagctaccaatcggcttgttctttgccgataaaattcaatgtcgaggggaaatttcatcaaccttaatgatggatcggttactcaatctcgaaggacctcctttgggcagtattgaaaatatagagctggcaaggttcaggagtaagaactttgacagatggtgggggtgaatggaaacaacatatcttccatcaaccagcttctatgtaaatgacagatctgttccccgatgttgttcctcaggtatatctttgctcttgtcaattctgtttgaacaattattagccgacttgaaacttgactaatttctcttctcgtcttgcagacaacagaatcctctccccctcgcaagagcaatagtggcatagatatcgaatacgctccaggtctcattcccaatggaggtgggtcatctccccctgtcatcaattgtcatgcccccaaaacttcaagtatgctccaagggctcattagagaactagctgatgccggtaaaaagagaaaaaccagagcatcggctatagacccattggctccggctccaaataagaaagccaagtcaaataagaccaagccaaccgatgatctgtctgccgtagatccatccattgaacaagctctggatgaagaggatattggagaagatgttgatcaagctgaagctgggataagcggtactgaaaaaacaccatcggcttcacctaaacaaactcctccgactccttctgctccagttcatttttccagggtaaacaactctccttgatttctttttgcaaccatttcatttatagccgattgcttatagattttataattgcagaaaaagaaaactactatgagaaagaaatcggtagcaacaactctcaaactggctccaccagtaagatgttcttaaatctttcactagttgatcatcgccgatcttgtctaacaattgtctcttttcagcctcctcctccttctccccatgtacagctatcatcaagtgaccaaactccatcggctatcatcagctagaagcatcatctctagacagtttggtagtagactgtggatcaattaggactcggctacataaagttcaagctttgatcccggaagaacatgccgacgtcctcactccagctgcttatcttgaacaatatcaattcaaactggagaaggccaagctgagattagccgaacgtcgggagcgcagggatattgaagccacaatccaggccaatcggcaactcgtgcatgaagagaagtccaagcttgatcagctatctgagggcccgatcaagtctaatattgatcagcttgaagctcgtaagattgagctcttggcacaactccaagaatgcaatgctgatatgaccaagtccctaaaagtcatctctggaaccgatgctcaagatacccaagctattgaagaagtagaacacattaggcaaagagctatatcggcgatctagcgctacttgtctcagtgatattctataataggatgtagtaaatttttgtaatcggctaagatactctggcacttgtagttaacttgtcttgatttatgccgattaatataactccatgtttttgctcaagaatttgctcaaaaattttgcaacttttgcatatatatgtgcccccctaattttacaatgtcgaaggcattgatgaaattatatcttgaactaagggcaatataacaatatcggccatttgtacatcggcaaaccacaaccgattacaataggaaaataactaagggcgatataaccatatcggccatcccaaggcaatgcaaacacatcggctattatgtatcagtagtaccagccgatcatgcattaacccaaacacttgggtaatatttcttcaagtattttccattgagcgctcgtccataaacttctccatcgagtccttgcaacatataacctcctttagacacaactttatagatttgaaacggtccttcccaattcggcgactacttgccgaatttgctatcccgagtgccaatcggcaaaatcaatttccatacaagttctacctccgaaaaagacttggctaccactttcttgttgtaatgtcgagcaacccgttccttatccttagcaacttttgcaagggctctgaatctagattgaaccaagtcttccctctcatcggccataagattataatactcatcggctgtcaaatcattttgcaactccgttcttcttgagccgattctaacttctcatggcaaaacaacctcatgtccataaacaagtttataaggagggacttgaatcgatccatgacaagccatccaataggaccataatgcttcggccaatcgagtatgccactgccgaggataatcggaaatctctctcttaatcaatttgatcaaactcttgttagacgcctcggcttgcccattagcttgtgcataataaggtgagaattcaacaattttatccccatgctaccggcaaactgaacaaactcatcggacacgaagattgacccttgatcggttgtaatagtttgaggaataccaaatcgataaattatatactcttgaataaattgtatagcatatccagaatcaactttctttagaggaatcgcctctacccacttggtaaaataatcggttgccaccaatataaactatcaatgtatcatttttgcactcatactctcctgccaactgactgatcaccagtaaagaatcccccataatttcaatagtatcggcttcaacttccttgagtaattgtaaccctttgagaactgcctcatactcagcttgattattggttgcataaggcttaatagtataggcaaactcaaaacttgccccccgaggaaaaattataaccaagcctataccacaaccatgagtgcacactgatccatcaaagaacaaagaccatggcacaacctcaaccgagccgattgaatcatcacgatgatcaacgatcaaattctgttaaggaaaatatccactttccaacttttccttttaaaatcggagccgataacatgtacttaacgacatcggctttgcatatgacagtgcattcgttggacaatatataatgccttaacattgtacaggaaaaatacaagcacaaacacaacttctccacaggggaatatctcgtctctgcatccaagagccgacgacttaaataaaatacaactctttctttcccttcaagctcctgaatcaagactgagccgattgacttctcaccagctgatagatataatctaaaaggtaatcccttttgtggaggaatcaaaactggaggagagctaagatattccttaatactatccaaagccttctgttgcactgcctcccaagtaaacttttggtcggctttcaatcttaacaatggtgtaaaaggctctaaccttccagacaaattagaaataaaccttctaacaaaatttatcttgccgatcatctcctgcaattccgtctattttctggagactgaattttcttgatcgcattaacactcctttgagttatctcaatccccctctcatgaacaagaaatcccaaaaactggccagccgatacaccgaaagcacactttgttgggttcatcttcaagccatatttcctagtcctctcaaaaaccttccttaaatcggctatgtggtcctctatctctttagacttaacaaccacatcatcaatgtagacctcaaccaaccagccgatcggatcatggtatatgtaattcatggcccattgatatgtagctccagcacttttcaagccgaaagtcatcgtaacccattcaaacaagtcgattgcaccaggacacctaaaagctgtcttatgtatatcttcttcagccatgaagatctgattgtatcctgcatttccatccataaaactcaatatcttgtgccctgaagcagcatcaaccagctgatcggctactgcattggatactcgtcctttggggtagctttgtttaaatccctgaaatcaacacacaccctgactttgccgtttttcttgataactggaattatactagaaacccacttggcatatcgacaaggacgaatgaaaccagcatcatataaacgtttaatcttagccttgacaggttcgagcatgtcggctttgcatcttctcggaggttgttggtgcggcctaaaccccggtttgataggtagccgatgttcaacaatcgatcggctgagccctgacatctcataatactcccaatcaacacaatctctgaattccttcaagagctctatcaacttggttctaaattctagagataagttcttactgataaatgtcggcctcgatcgatcacctggacctatgtcaatttcttccaaataatcggctgacatgaaaccctgtccttgcttgtcatcgagatcatctactgtgtccttggtgtagacgtttgaaccctccacaacgccctcaaaataataacttgggctctccatcttcaattggttgtatatcacaatcggacacatttagaaaatctccttcccaaacctttccagacaagcaatctaggccatccatctcccaaagagctaaatcagcactggcaacgttaactgacctgtcggctggtacaatttctatcttgtcgacttgccattgaatcaagcattgattcatggttgaaggaatacaacaattggcatgaatccaatctcttccaagcaacaagctgtaggaacccttcccatcgatgacaaaaaacgttgtagggatagtcttgctgccgactgttagctctacattcaaaactcctttggtttcggatggattgccaccaaagtctttgagcaccatgtttgtcttgatgagatcctcagcattcctgcccagcttcctaaacgtggcataaggcatcaaattcaccacggccccaccatcgaccatcatcttagacatcggcttcccattgacataaccgtttacataaaatggcttgagataccaattctctgtcccttttggcttctcaaaaactgcttgttctggtgataaaaccaacttagccgatgcttcctcaacctcatcaacatcggcttgtttgactccaaattctgcaggcagtgtgaaaaccatgttaaccgatgcagttacaacactattccctttagccaatctttttgcttcatcggctgtggcttcatcggctgtaggaacttgattcttaacgcgccactcctgctgcggcttcgttttcttcagccgatggttgatttcttgctcaacctcttccctgttcctcaacctttgaacccttctcttctgattctttgtaaaaataccagaaggacaccattaagtcttcctaccttcattgtcctcttggtcacgatcttgatttactgggcccaacctttgatgaacaggaacccttgcttgccttagccaattgcctttattatatgatcggcttgaacttcctgcaatattgctgtacctaggacaatcctcattggatggcagcctcataccttcattccaacagaatctaaagaactcacaaccccaatgaggatcaagaccgctatcatcttcctcataatacttttcctgatgctaatcatatttcctctgatacttattgataatcatagccgagttcatttgaaaacctcgagcttttcctccatcggctgttcgaccagctgtatgtaccatattgacaggaaaaggattgccatcaaccttcatcggcttattggaatcatcaaacttgattttgcctccctcaatagccgcctggatctgctgtctaaagactttacaatcattggtagaatgagatccagaattatgccacttgcaatatctcctcttgcctagctcctcagccgatggaattgtatgaccagcaggaagttgaatatgtttttcccgaagtaacaaatcaaagatcttatcagccttggtgatgtcaaagtcatacctctcttcttttccagaactcttcacccattggcatggtataaccttcttgctcctaacccacttggctgctgctacctcggaatcatcatcatcatcatcagatccatatatgtaggtaaccttttgtgcaagatgtgacaaactatcaaagtcctgngatgagaatttctccctgattggagctatcataccctaaaaagccaaatctgctaacatcagtcaagcttaagttgtagcacttattcctcatctctctaaacctctgaatgtagtcttgcacaggctcatcatgcctttgcctaatcgctgttaaatcagacaatttcatctcatgaaccccactataaaaatagctatgaaattcttctccaaatcggtcaactgttgattgatccatatggcaaagaagaaaaccaagtaaaagccgatccagacaaagactagggagacaacctaaccctcaaggcgtcgacagtcgatgctttaccacactgagctaagaatcggctagcatgttcataggttgagacactgtcttgccctgagaattttgaaaaatccggaaccttgaaccggctaggcaatggaaccctctcaaaccactcaggatatcgatgccgatacaagtttccagtgtcttttggcttgatcccaaattgctctctcatcacatctgcaatcatatcggcccatggttcctattgaggcaccccctgcacttgctgtggcacaggctcgaacgagttgtactgataagcgaattgaggctgagtcgatcctccttgttgatactgaacttgcggcgatggaggctgatactggtaattcaaattgcccccgtgataattctgaaagtttggctgtatattgcgcaccaaatgttcgggaataacttgaggtatcaccgattgatctggttgcacattatgaaccaaatgctctgggacaacttgatttgcagcgtgctgcctcggctgattgtcgggcgtcctgaacccagccgatgcatttaggaaaccttgctgctgaatcggctgagcaacttgctgcctcggtggcgtctgctgaatcggctgctgttgaactgggtcagcagtaggctgagttggtaaaaacatagctgcaacttgctcttgagttagccgattcacattttgtccactatgctgagactgctctctcaccaacaaccgaggattgattagttgacctggtgccgatgatggtccagcaggtgcaggagccgatactggtgctgttggctgagctgatggcacattgggagcaatcggttgagcagtcggttgattattagtgatcaagggccgatagtttgggaaaatacctcctggcaaataaaccggtcctgtagcctgatactcagctattgagccatcaaccatcgacttcaccatgtttgacaaggtattgactagtaccccagactgattcttggaagttgttaaattgtatatgtgcagtgttaccatctgggctgagatcctcatctttcactccctgagaacaatcacccttatcacctgagccatctgcagcacttttatcacctaattgagctgtagcatctgaaacctgttctacctccccatccttggaagaacttgtcctaggaacatcagcaactaatttcatcttatacctctaaacaattgttccttggcgggtctccatgaatgagttcaagaattggttctgtgtttctgcatcatcgcctcgagattattcttttgttcaagtgtcaatttgtctatagtgacgggcacgatgttgctttcatgaacttcggacccaccaagcttcgggatcctagatttgggaggaccctcttttgccagccgaagatggcgatgctggtggtttcttagcgatgagagaatgctattgcggttctgacttctaatctctcccactgggcgtgccaaaagcgtgttgacataaaaacatgaggcctgggagatctgcttaactccagttataaggttatgtctaagggagcatatatgttgcaagggcttgatggtgaagtctatgggcaagcgctcaatggcaagtatttgaagaaatattacccaagtgtttgagttaacgcatgatcggctagtattgccgatgcatgacagccgatgtgtttgcatcgccttgagatggccgatatggttatatcgcccttagttgtttttcatggtgtaatcggttgtggtttgccgatgtacaatggccgatatggttatattgcccatagttgtttttcatggtgtaatcggttgtggtttgccgatgtacaatggccgatattgttatatcgcccttcgttgttttataattttatcaatgcttttgtcattgtaaaattaggggggcacatatatatcaaaagcgtgttgacagaaaacacgaggcctgggagatctgcttaactctagtgcaggtccaaatctcgccttcgaatgtatgagcgtgccagttgatttgatcctgtaatcaacaagaaatagaagcaaagaaaccgcagttaaatctataaatgtagccgattggctaggtgccgatgatatatcatttatctttgagccgatgtcatatatgcatcgatcggtagtcattaataaataagaagggactaaatctactcgattggctgtagatattaacaatatataatcattattttgatatatacttaaatcaagtgattgggatagatcgatcgccatgccgagacaatataaatcacttagatcgaaatatatattaataatgagtctatatacgttcatagcataaccgatcagatagatctagcatgtatcggctaatactccgataccactctatattaagatatgaaagcaagtagaatatactaaacaaaagcctaatatactaaaatgcagcaagatcttaacgtaaagggcagatttaacatgtcaatcaagcatataggataaaaagtagttaaatcaggtaagatcggctgaaactccgatactaccctaatcagcaaccaaggagcgggctagagattgagattctaatcacgactcataagatcaaacttaactgatgcagctataagtatgaaaagaagaacaatgtctagacaatcaagccgttggatgtgtcatagagtggtagatatcctatataatctaagtcaacatcagtatttaacctaatcggctgccttctattgacggatgttagccgattgtaggttagatatcgatattgccaaggattatgtaggatatatgataactcgacgaattacataaacaagattagagtgtcataaagatggaagcactaatcctgagaactcaagccgccataacaagttttacctcttgttgaagatcgaaaccgatgcagctcaaccagaaagcaagaactcgtcgaaataaaactaaagcaaaaaggtggcgatgcgccgagattgtattgaacgtgtatgttaaaagttacatagggttcgggtctatttatacccgaaaatcacaagatatgtccataacggatacaactactatctctaacaaactctaagataccataagtctttgcggcagacttttgcccaagcatatctccaaggagattacataaatcatcctaattaatagatacaattgccttctcaggctctatccatgtgcggcaatcaccttaaagcgccttaattcaacccgatatcatacatcagtatgcattgtcggaatcggctgcattggcttacctagctcgactcagacccagccgatctggactccagccgattcctgttctgtttctgaactcgatctccgcctccgactttgtttcgatctaatcttctttcccaatgccgatattaccaaatttggttgttaacacatgccccccaagtccggaatatttgataatttttcggatttgctgtaaatcgactctgagcaagtttcgcactttgccgttttccgaccattactgccgtgctttaaatactaaccattaccttcgagaaatctcacaccgtcctcctccgttttcaccgctgaaaccaactttgccctctttcgctccggcgatctccccaatgcacaaggcgatccctaggcgatttcgttcccgactagatctccgctcggggcgatgtcgtcttccaccagcccttctaatgcaccatcgggcaagtacgctgaggtaagtcctcaccagctagatcccttttcctctcatgaaattgatttctccttttcttctcatgttttccgcatcccgattcctttggatttgcagcacctttccaacctagtcgcgattcctagcctttcacacaaaaaccactattttcttggcccattcggcaatctcgaccccactgatttcatcatcggtgaaaccaatcggatcccctttcgactagccaaccctaacctgggtcactggaagaatacattcaagtcttggccatctctcgaaaaacctactcctgataagagctggaccacctagtaccgacgcgtatcggctagtaagaaagttcactgggataaaattggaatcggccaagcagtcgctctcaccatagcaaattctgctaaggatgaacctctgatggctgccgccacctacttctggtccaacaccatcaatgctttcttattcaaccaaaggccattgactccaactttaatcgacatcaccatgattactggattagatgtaacttcatcggctaaccctatgagtatgaacaccaagaaccaattggacttcaagaccaaaagcataggtggctggtctggctatgtggcggcatatatgggccaagggtctgttacccctcgagagcatgtagctttcttgttcatgtggctggaaaagttcctcttctgtggatccagttgtggccctacaaccaactagcaatctgtagccgtagccttagaatcaaagaaagaatttcctttgggcaaaaatccttctgggctatgtgtaccagatgatgaacaatgcatcggctaaaatagccgttggctcaatagttggagcaggtggaccatggtggctgctgcaaacttggttaaacctgatagtcatgaacattgtcaatcgaccctctgtgacagaagctgaattcccattgccagagccgattgtggaagatgacggagaagagcgcacccatcgcagatgcatgtcatatggagaatatgcatccacatcaaccgatgctggagcgaagctatcggctgagctacaaaaggactggttctgcagcttctacgaaggttttaagaaagatgcacgaatctggtttccttatgaagactcagcagaccttgaacttccatcagactttagatttgaagacattaatcatcgaaaattccaaaaatccagagaaattcctatagctgcaatcagcccatgcatcctcccagtcggcattcaccaagggagaaacatccaagtctcctacgagttttatcacccaatgagcttggccagacgacttggattgggtcaactcccaatcggcttattctttgccgacaatattcagtgccgaggacaaatcgcatccactctaatgatggatcggctacttaacctaccaggaccccctctgggcagtattgataatattgagttggcaggatttagaagcaaaaattttgacagatggtggggtgaatggaagctgcatctatttcatcaatcggctgcaatgtatatgatagatctattcaataacgtcataccccaggtaaactttgtcattactaaattgcataaccagttagccgattcattacttgactaatctcttgctcctgttttgcaaacaacagagtcctcccctccacatcaaagtaatagtagcaagaacattgaatatgcttcaggtttaattctgaatggaggtggactatctcccactctccttcacggcctaactagggaaccagccgatgcaggcaagaaaaggaaaactagatcatcagccatgagtaacttagccttggctccaaagaaaaagaccaaattcaagaaaactcaaccacaaccaactgatatgtcgactgatgatctgcccgccttggatccatctattaaacaagctttagatgaagaagaaattggtgaagatgttgaccaagctgtagccaaaatgagtgacacagaaagaacaccatcggcttcacccaagcaaacgcctccaactccttctgcccccgttcattttacatgagtaagtacctctctttgacttcttctgaaattacctccctctttggctaattacccatagactttgtggttgcagaagaagaaaactgctgtgaagaaaaaaccagcagcaacaattgttaaatcggctccaccagtaagatgtccttaattcttttacttaaacaatctcaaccgattctatataacacttgtctatttcgcagcttcctcctccttctcctcctgtacagcaatcgtcaagtaatcagactccatcggctgtggggagtcatcacgtcgaagaggaagaacaaccagctgcttctgctatcccagtaagtttccctttgtctcaacaattagatcagctataatttacccagctcttattctttccgaaattgcctctgcaggctctagccgatctcttctcttttgacatcagagattaccttgatgaggcagaagaagacacttcaagcaaagcccaagctcccctatccgatgatgtgagaaaaacacttgaagacatcgctcatcggctagaagcctcttctttagacagtttggtagttgactgtgggtcaattaggacgcggctgcatgaagttcaagctctgattcccgaagatctggccgatgtcctaactccagccgcttatctcgagcaacatcagttcaagctggaaaaagccaagctaagactagccgaacgccatgagcgcaaagagattaaggccataatccaagcgaattggcagcttgtgcatgaagaaaaaaccaaacttgatcagctatctggaggtccaatcaaatccaatattgatcggctcgaagctcgcaagattgagctcttggcgcaacttgaagaatgcaatgccgagctagatatggaacacagaaatctagccgatctcccaaaatcaattgaagaacaaaaagcaaggctcaaatcggctatcaaaaatgttgctgacctaaccaagtccctgaaagtcatctctggaactgatgctcaagatgcccaagctattgtagaagtagaacaaattaggcaaaggcctattttggctatccagcgatacttgtctcaataacttttgtgtaataggactcagaaattttttgtaatcagctaagatgctctagtactttactgtcctgaaattcctttgtgccgattaatatgactttgaaattcgctaaaaaattttgcctcaaaaaatttgcattgcattttgatatatatgtgcccccctaattttacaatgacaaaagcatggataaaattataaaacaactaagggcgatataacaatatcggaaattatacatcggcaaaccacaaccgattacactatgaaaaacaactaagggcgatataaccatatcggccatctcaaggtgatgcaaacacatcggctgtcatgcatcggcaatactagccgatcatgcgttaacccaaacacttgggtaatatttcttcaaatacttgccattgagcgctcgcccataaacttcaccatcaaacccatgcaacatatatgctcccttagacacaaccttataaatttggaacagtccttcccaattcggcgaccacttgccgaatttactatcacgagtaccaatcggcaaaatcaatttccatataagttctccttccgaaaaatctttaggtaccactttcttattaaaatgccgagcaatacgttccttatccttggtaacctttgcaagggctcgcaatcgtcactgaaccagatcctccctctcatcggccataaggttgtaatactcataagctgttaaatcattttgtaattccgttcttcgagagccgattctaacctcccatggcaaaacagcctcatgcgcataaagaagtttgtaaggagggacttggatcgatccatgacaagccatcctataagaccacaacgcttcggccaaccgagtatgccattgccgaggataattagaaattgtccgcttaatcaatttgatcaaacttttattagacacctcggcttgcccattagcttgtgcataatatggtgaaaaattcaataatttgatacccatgctatcggtaaactgaacaaactcgtcagacacgaagattgacccctgatcagttgtaatagtttgtagaataccaaatcagtagattatatgttcatgaacgaattgaattgcatccacagaatcaactttcttcaaaggaatcgcctccacccacttggtgaaacaatcagtcgccaccaatataaacttatgtcctttactcgatggtgggtttatcataccgatcatatcaattccccaacctctgaatggccatggcttaagaataggattcatagtcgatgccggagctcgctgaattgccccaaacttctgacaatcttgacaccccctataatatctgtaacaatcctccagcattcttggccaaaaataccctgcacgccgaagtaaccacttcatcttatgagccgattgatgagtaccaaaatttcttcatgaacttcgctgactgcaactttagcctgatcggcagtcaaacacttaagtaacactccatcaatcgtccgataataaagctcatcatccaacagagtatactttaatgccttatatctcaatttcctagaagccgattgagacggattatgcaaatactgatgcacatcatacctccaatcatcggctgtcattgctgcaatttcaaccttaacatctttgatcatgagcttataccctgatgccccttgggccaaatcattagcttcaatattttgttctcgagagacatgctttaaagtaaccagccgaaactccttcattagttgttggcacttctcattataaaccatcaatgtatcattcttgcattcatactctcctgccaattgactgattactagcaaagaatcccccatgatttcaatggtatcggcttcaacttccttgagtaattgcaaccctttgagcactgcctcatactcagcttgattattagtcgcatacggtttaatggtataagcaaactcgaaacatgccccctaggggaatttctgagccgatattatcaaaatgcaatgcaaattttttgaggcaaattttttgagcgaatttcaaagtcatattaatcggcacaaaggattgtcaagacagtaaagtactagagcatcttagctgattacaaaaaatttctaagtcctattacacaaaagttattgagacaagtatcataggatagccaaaatagccctttgcctaatttgttctacttctacaatagcatgggcatcttgagcatcagttccagagatgactttcagggacttggttaggtcagcaacatttttgatagccgatttgagccttgctttttgttcttcaattgattttggaagatcggctagctttttgtgttccatatctagctcggcattgcattcttcaagttgcgccaagagctcaatcttgcgagcttcgagccgatcaatattggatttgattggaccttcagatagctaatcaagtttggtttttttttcatgcacaagctgccgattagcttggattgtggcctcaatctctttgtgctcacggcgttcggctagtcttagcttggctttttccagcttgaactgatgttgctcgagataagcggctggagttaggacatcagccagatcttcgggaatcagagcttgaacttcatgcagccgcgtcctaattgacccacagtcaactaccaaactgtctaaagaagaggcttctagccgatgagcgatgtcttcaagtgtttttctcacatcatcggataggggagcttgggctttgcttgaagtgtcttcttctgcctcatcaaggtaatctctgatgtcaaaagagaagagatcggctagagcctgcagaggcaatttcggaaagaataagagctgggtaaattatagctgatctaattgttgagacaaagggaaacttactgggatagcagaagcagctggttgttcttcctcttcgacgtgatgactccccacagccgatggagtctgattacttgacgattgctgtacaggaggagaaggaggaggaggctgcgaaatagacaagtgttatatagaatcggttgagattgattaagtaaaggaattaaggacatcttactggtggagccgatttaacaattgttgctgctggttttttcttcacagtagttttcttcttctgcaaccacaaagtctatgggtaattagccaaagagagaggtacttacttatgtaaaataaacgggggcagaaggagttggaggcgtttgcttgggtaaagccgatagtgttctttctgtgtcactcattttggctacagcttggtcaacatcttcaccaatttcttcttcatctaaagcttgtttaatagatggatccaaggcgggcagatcatcagtcgacatatcagttggttgtggttgagttttcttgaatttggtctttttctttggagccaaggctaaggtactcatggctgatgatctggttttccttttcttgcctgcatcggctggttccctagttaggccgtgaaggaaagttgaagtcttgggggcatggtagccgataaaagggggagatagtccacctccattcagaattaaacctgaagcatattcaatgttcctgcaactattactttgatgaggaggggaggactctgttgtctgcaaaacaggagcaagagattagtcaagtaatgaatcggctaactagttatgcaatttggtaatgacaaagtttacctggggtatgacgtcagggaatagatctgtcatatacattgaagccgattgataaaatagatgcatcttccatttaccccaccatctgtcaaagtttttgcttctaaatcctgccaactcaatattatcaatactgcccagagggggtcctggtaggttaagtagccgatccatcattagagtggatgtgatttgtcctcggcactgaatcttgtcggcaaagaataagccgattgggagttggcccaatccaagtgggtgataaaactcgtaggagacttggatgtttctcccatggtgaatgccgacagagaagatgcatgggctgattgcagctataagaatttctctggatttttggaatttttcatgattaatgtcttcaaatctaaagtctgatggaagttcaaggtctgctgagtcttcataaggaaaccagattcgtgcatctttcttaaaaccttcgtagaagctgcagaaccagtccttgagtagctcagccgatagcttcgctccagcatcggttggtgtggatgcatattctccatatgacatgcatctgcgatgggtgcgctcttctccgtcatcttccacaatcggctctggcaatgggaattcagcttttgtcacagagggccgattgacaaccttcatgactatcaggtttaaccaagtttgcagtagccaccatggtccacctgctccaactattgagccgacggctattttagcagatgcattgttcaatatctggtacagatagccgagaaggattttgcccaaaggaaattctttctttgattctaaggcttcagctacagagtgccagttggttgtagggccacaactggatccacaaaagaggaacttttccagccacatcagcaagaaagctacatgctctcgaggggtaacagacccttggcccatatatgccgccacatagccagaccagccacctatgcttttggtcttcaagtcaaattggttcttggtgttcatactcataggtttagccgatgaagttacatctaatccagtaatcatggtgatgtcgattaaagttggagtcatcggcccttggttgaataagaaagcattgatggcgttggaccagaagtaggtggcggcagccatcagaggttcatccttagcagaattggctatggtgaaagcgagtgcttggccgattccaatttcatcccagtgaactttcttactagccgatacgcgttggtaccaggtggtctagctcttatcaggagtaggtttttcgagagatggccaagacttgaatgtattcttccagtaacccaggttagggttggctagtctaaaggggatccgattggtttcaccgatgatgaaatcagtggggttgagattgccgattgggccaagaaaatagtggtttttgtgtgaaaggctgggaatcgcgactaggttggaaaggtgctgcaaatccaaaggaatcgggaagcggaaaacatgaggagaaaaggagaaatcgatttcatgcgaggaaaagggatctagctggtgaggacttacctcagcgtaccggccgatggtgcagtagaagggctggtggaagacgacatcgccgcgggcggagatctggtcgggaacgaaattgcctagggatcgccttgtgcgtcggtgagatcgctggagagaaagagggcaaagttggtttcagcggtgaaaatggaggaggacggtgtgagatttctcgagggtaatggttagtatttaaagcacggcagtaacggtcggaaaacatcaaagtgcgaaacttgctcagagtcgatttacagcaaatccgaaacattatcaaatattccggacttggggggcatgtgttaacaacgaaattttgtaatatcggcattgggaaagaagattagatcgaagcatagttggaggcggagatcgagttcagaaatagagcaggaatcggctggagtccagatcggctacgattaggatcggctgggtctgagtcgggctaggtaagccgatgcagccgattttgacaatgcaacctgatgtatgatatcgggttgaattaaggcgcttcgaggtgattgccgcacatggatagagtcctgagaaggcaattgtatctattaattaggatgttttatgtaatctccttggagatatgcttgggcaaaagtctgccgtacagacttatggtatcttagagtttcttagagatagtagtcgtgtccgttatggacatatcttgtgatttttgggtataaatagacccgagtcctatgttacttttaacacacacgttcaatacaatcccggcgcaacgctacctttttgctttagttttatttcgacgagttcttgctttcgggttgagctgcatcggtttcgatcttcaacaagaggtaaaacttgttatggcggcttgcgttcttgggattagtgcttccatctttatgacactctaatcttgtttatgtatttcgtcgagttatcatatatcctacataatccttggcaatatcgatatctaacctacaatcggccaacatccgtcaatagaaggcagccgattaggttaaataccaatgttgacttagattatataggatatctaccactctatgacacatccaatggcttgattgtctagatattgtccttcttttcatacttatagctgcatcagttaagtttgatcttatgagtcgtgattataatctcaatctctagcccgcttcttggttgctgattagggtagtatcggagtttcagccgatcttacctgatttaactactttttatcctatatgcttgattgacatgttaaatctgccctttacgttaagatcttgctgcatttaagtatattaggcttttgtttagtatattctacttgctttaatatcttaatatagagtggtatcggagtattagccgatacatgctagatctatctgatcggttatgctatgaacgtatatagtctcattattaatatatatttcgatctaagtgatttattctgtctcggcatggcgaccgatctatcccaatcacttgatttaagtatatatcgatataatgattatatattgttaatatctacagccaatcgagtagatttagtcccttcttatttattaatgactgccgatcgatgcatatatgacatcggctcaaagataaatgatatgtcatcggcacctagccgatcggctatcatttatagatttaactgcggtttctttgcttctatttcttgttgattacaggatcaaatcaactggcacgctcatacattcgaaggcgagctttggaccagcactggatttaagcagatctcccaggcctcgtgttttctgtcaacatgcttttgatatatatgtgcccccctaattttacaatgacaaaaacattgataaaattataaaacaactaagggtgatataacaatatcggctattgtacatcggcaaatgtcacgaccggaaataacccaacgggcgttccttatgtgtgtgcattattccttgtcccaggaggcaaggtacaccaaaagttgatacaattcagagtttgacaagcggaagcgtacatagttaatttattacatgggcagcgaaggcccagcacacaagaagacaaacgaaaaacagcggaagactagggcgacgaccacaggcgcttgacggcaggcacgagctagacacaaaagcctttatcttccaggggctcctcttctgggtttgggaaaaattgagcaagactgagtacaaccaccgtactcaacaagacaaaaccacaagtgcagaataaatgcaagggagtacaagggagccataatatagggggttagggtttgcagtaaactacactaaaagacacttagttgctcaaagctattttgtaaacacggtcctagagctatacaatattattaatcaaggccgtgaacccacacgaacctgccttaacccaaggcctacgatgattcagaccgaactggcaacccgaccctgggtcccagctcatcccaagccaacccaggccaaccattccacattttagttgttaagcaggttttaagaattaaaaacactaacttgggtacattgctcggcttgcccataaccgagggcgcggctattcgaataggttatactctaatcagaggtgtacatctttacccacaagacacatcttcctcacgtgtaaccacgtgccacataccaccatggtatacggacggaagacgtgacatagtttccaacccatcctagccatagacaagagtaccgacccaaccccacctacggccggaacccccgggacaggtaggcaggactaagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaagagaggcccgaagaccggtccttatatggccgaggtgctactatcaaaaccatgcaccccgagcccagcctaaaaccattttgagggttttgaatagaggggaggtgtgaatccaattccacaatgatccaacaattccatagtgtccaggtgatgagaatactcccaaagtctagagttgtaaaaccacctaatgttgcctaattaaccagcgaagcatctacctaaaagcatactagtggtaccatgagtagagtgtccactagttggggtttggtttaatctagggtgaacaaggtaataataacaataacaataataaggtcataacaaaggtaaataggcatggctagataaaacagtgataacgcgtgaatttaagtaaagcgataatgcaataatttaaatcaaaataattttataaactaggattcaatatgctcaaggatgatgtgacttgccttgctcgctttcccaaacgtcggcttcaacctccacgaagagcggatcttccgaagctgcagcatctacacgaccaacgaaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaggggtttattgcgtcagccaagggggaggggacgcgcggaccgggtccacgggagtggggcccacgcggcagcctcacggcccacagtggaccgggcgcacctgggctcgcaccagccggcgccgtgggtcccacgtgtcagccgcacccaagggcgcgggcggctgacggccgggccccacgcggcagccactcggcgcgcacgagggcggccacgctggcgcggtcggcgggaggcggcgcgcccgcgccccgatggtcgccgccggcgaccaccggcacggcggagcggcggccgagagaggggagggaagggggaaaggaggcgacggtccacggctcaccctaggtcgacggcggcgacggaggaggcggccggagtggagggaggcggcggcgcggctcgggtcgatggcgtcggcggcgctccggtggttggcgaccgaaacggagaggtgaacgaggttggcgaggatgcggtgaacccgaaggaggcggcgccgaggtgggaggcggtccggggagacgacggcggcggaccgaagctcggcggcgacggcggagagagagagtgacgtcgcgagctcaaatccggcgaggaggaagggcggcgagaggcagaaacggacgaaggaggtgcggggagggtttaaatagggttggaagagggagagagtggccggaggggaaggaaaccggcgtggcgctctcgggctccatcaatggcgccggcgggattaggggagggtttccaaacgaatccaagggagagagggatgcaaaattgggtggaatgggagaggggatcacggggagtgattccccccactttattgcacgcggggacggcgggaggcggcgggattcgcggcggcggcggcgctagggtgcgggggaggcggcgggagcggtgggagaaaggggatgacgggtgggccccacccgtcagcgagggtggcgggcgggcctgcccgtcagcggcgcgcgcgcagggagaggccgagtgggccgcggggagaggagagagagggggagggagatgggccgaattcggcccattagggtttttctttttataaaatcattttaactttgtttatttcttaataattattatttgtgctctgagaattccactaaaatttatttacacattttaggcttttaggaaatatacaaaaatcctctaagccttaattgacttttaggaaatttatttacacgttttgggacgtgacaaacctacccccgttaaacggaatctcgaccccgagattcggaagaactggcgaagagatcgggatgggctgactttagctcgtcttcacgttcccaagtagcttcttccttggcgtggttgctccattggaccttgcaaaaacggattacccggttcttggtcctgcgctccatggtgtccaagattttcactggtctctccacgtaggtcaagtcttcgcgaacttcaatttgctctgagtcggcctgctcggatggcactcgaagacatttcttgagttgcgacacatggaacacatcatgcacgttgcccaatgatgcgggcagctccaactggtaagcgacttctccgcgtcgagcaatgatacggaaaggacccacgaaccgaggtgcgagcttccctttcgtctgaaaccgacgtacgcctcgcaacggcgtgacccgaagatagacaaagtcatccactgcgaattccaggtcacggcgtcggttgtctgcataactcttctaccgagactgggccaactttagattctcccgaatggttctgactttcgcttcagcttctctcaagttatcagtcccgaacacttggctttccccaacttggtcccacaatagcggtgtccagcatttgcgtccatacaacgcttcatagggtgccatttgtatgctggcttggtagctgttattgtaggagaactcggcataggggagactcttatcccaggtcttcccgaaatctagaacacaagcacggagcatatcttctaggatcttatttagacgctcggtctgtccatctgtctgcgggtgatacgcggtgctgaaatttaatcgggtacccaactcttcttggagtttcttccaaaagtgagaggtgaactggtttccccgatcagatacaattttcttaggaacgccatggagactcacgatcctagcgaagtagagttcggctagtttgttccctccataggtggtcttcacaggaataaaccgagctaccttggttagtcggtccacaacaacccatatagaatcatatcctccttgggtttttggaagtccggtgatgaaatccatcccaatttcatcccatttccattctggtacttggagaggttggagaagtccggccggtcgctggtgctctgccttgacacactggcacacatcacaaagggccatgaactctgcaatttcccgcttcatactaacccaccagtatttccctttcaagtctaagtacatcttcgtactgctagggtggatggaataaggactttcgtgagcttcctgaagtatcaggtgtttaagttccttgtcgtccggaacgcatacacgatttccgttccatagggttccatgttcatcttctatgaaaccagcggctttacattgtttcatatttttgaggatcccatgcatatctggatcattcttctgagcctcacggattcgatcgagcaaggtaggcttggcttccagcgtagccaagaatccacgaccaactatgcttaggttcagggcatccatctgttgattaagttccggtggaatgccacggacgccaagagtgttgcaatggctttttcgacttagagcgtcggcgaccacgttggccttaccaggatgatagtggattcccacatcataatccttgatgagttctaaccatcttctctgccgaagattcagatccgactgagtgaagatgtatttcaaactcttatgatcagtacatatttcacagcaattcccaatgagatagtgccgccagatctttagagcatgaaccacagcggctaactccaaatcatgggtagggtagttgccttcatgaggccgaagctggcgtgtggcataggctaccacatgaccttcctgcattaatacgcaccccaatccttggcgcgaagcgtcacagtacaccaggaagtccttacgagtatccggtaagatcaacactggcgaggaaaccagcttttctttgagagtttggaacgctttctcgcattgtgggctccacacaaatttttcttctttcttcagcaactatgtcatgggtcgagcgattttggagaagttctcgatgaatcttcggtagtacccggccaaacccaaaaagctgcggacttgagtgactgtcttgggtcgcttccaatcagtgacggcggtcactgttttggggtccacagcaactcctttagcagatatcacgtgccctaagaatttgacttcggacaaccagaactcacacttgctaagcttggcatacaattgatgttcccgcaactttcccaacaccaaacggagatctctgattgcgagtacaccaggatgtcgtcgatgaagaccacaacaaacttatccaagtattccatgaacactttgttcactaaattcatgaagaaggcaggagcattagtcagaccgaacgacatcaccgtgaattcatacagcccatatcgcgtggtgaacgcggccttcgggatatcttcttcacgaataagcaattggtgatatccggagcgaagatcgatttttgaaaagacagtggcacctttaagctgatcgaacagatcatcgatccggggaagagggtacttgtttttgatagtaacttcattgagagctctgtagtcaacacacatcctctttgtcttgtccttcttttccacaaaaatcacgggagcaccctagggggaagtgctcggccgtatgtaccccttttcttttaactcttccaacagtttcttgacttcggccagttcatttgctgccatacggtagggtcgcttgtacagaggagtggttcctggagcaagatctatccggaacttaatctctcgcttgggcggcataccgggtagttcttccggaaacacatctccgaactcactgacgatcgggatttttgacagtcctatctgatgaagttcggaactgccgacagaggttgggggtgcaaagaaaacaaccggttgttccggccctcggtacagagtgacagtgcgtcttgcacaatccattactccttggaattgagccaatcaattcatcccaaggatcacatccaagttcttggtgtctagaagaatcagatccgagggaaaaggaattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacatcctcggcagtcacgtggttcacccgaccccgaatgacatccttaccaccgttgttggggcggggaggcgcttggccttgctggcgcctcggctttgggtatttatccgcaaagtgcccgggctcgaagcagttgaagcacagacgctgctgaccttgaacgtttctgcggccttgtccaggctgcacggctgacgtaggagaacggggtgcatgggtcccttgctgactctgctgctgctgcggctgtgggacgcgcaccacgaattgaggttggggcgcggagcgaggttgctgctgctgttgctgctgctgcgaggaggatccccctggatagggattggtgtagcggatcctttggttagccccctgttggttgcggaaattcgccaggcgacgcttctgcgactccagttccttgtgtttggcttccaagcggatgctcttgtccaccaaacgctggaaattcggatagtccccggagactagacgcacggacagctcagggtccattcctgctaagaacttctcctgcttttcctcatcttcacgaacatcctccggggcgtaccgggccaggttgttaaactcatgcaaatactctatcacagagcagttgccttgcttcaactctcggaattcccttttctgaagggccatgacttcggcgggcacatgggtcctctggaaagcggcggtgaagcgggcccaagtaataggctgcccctctagctgcgtagcctgaaagtggtcccaccatagagatgcgggcccctgcagttggtgagcggcaaagatgactttctcctcatcgttgcactgcacggtgtctaactttttccccacggcatgcaaccaatccaaagcatccacggggttattggagctagagaaggtaggtggacggatgcggaggaactctgcgagtttagaatgttgcgggggtggtggtggaggtggagcattatgttgtgacggattttggatgtgatggaggaaggcagccatcatgttggcctgctgggcgaagatttgggtgagaatggagttggtgtctggtggtggtggtggaggcgggggaggaggtggaggtgggctgccatggttgttgtggttgctaccttcgggttggttgcca

SEQ ID NO: 38050 - DNA, 1799 bp, Oryza sativa
caaataaaataaagacaggctccgacacagttataccacacaccggtataaccatgccccacacgactcaagcagaaaaaccaacgagaagaacatacgcgcaagcctactaactgctcgtctacttctgtgacgggccagggcggaaggtgagcaacaacacatcctccgtgctaccaacgctagaggctccctcctcctgaggaaccaagggcgcgggcccggcacgaggggtctcgacgaagcaggtccacgccagggactgacgaaccagctcgggcctagaggtactcttgcgggcagtgatcttcaggctgcggcagacgcgacggcgcttggggcgacagacctctccctgggcgatcttgagctgacacagctgcgcctccactgcgtctaggtccttcttcagctgcagattctcctgtcgtagctccaggatcttcatgttgttctcgaccaacccacgacgcaccatctgatggaagtcgatacgagccgcgtcgtacgcctccaccatgcgcgccaggtgcatgatggtagcgtcatcctccgagctagcatccctgaaggtggcgtagtcacgggctcctccgcgacgagggcggtagtggtagggcgagtgctgcaactcgtccgggtagcgctggtgaagagtgccgatggtgaggagagcggcgttctggcaagcggcggagaaagaatctccacccgcggtgactgccaacgaagtcctctcgggtgagccagtgagaatcactgcagtgacctcccaagcagcgtggggctctgcatcgtcaccctcctattccgggagctgcttgccctggtagtccactccatgcagataccccaagacaacgcacatgccccgcagctccaaaacgaagccagtcaggtccagaccacgacggttgatgctgccggccatctacaaacaaaaaacaaaagagaaaagcaacattttaaagattagattatggtgataaatgaagtagcaggacagagagagactagaggattttcacaaataaaaaaggatttttatttcgaaaatattgctaaggcttgggatctaaggctcgttctagggtcaagggggctctgataccaacttgtcacgaccagaaataacccaacgggcgttccttacgtgcgtgcattattccttgtcccaggaggcaaggtacaccaaaagttgatacaattcagagtttaacaagcggaagcgtaaatagttaatttattacatgggcggcgaaggcccagcacacaagaagacgaacgaaaaacagcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcagaataaatgcaagagagtacaagggagccataatatagggggttagggtttgcagtaaatagcactaaaagacacttagttgctcaaagctattttgtaaacacggtcctagagctatacaatattattaatcaagaccgtaaacccacacgaacctgccttaacccaaggcctatgaggattcagaccgaactggcaacccgaccctgggtcccagctcatcccaatccaacccaggctaaccattccacattttagttgttaagcaggttttaagaattaaaaacaataacttggctacattgctcggcttgcccataaccgagggcacggctattcggatagattat

SEQ ID NO: 38051 - DNA, 27885 bp, Oryza sativa
  unsure (1)..(27885): unsure at all n locations
gagaatattcccaaagtgtagagttgtaaaaccacctaatgttgcctaattaaccagcgaagcatctacctaaattcatactagtggttaccatgagtagagtgcccactagttggggtttggtttaatctagggtgaacaaggtaataatatcaataacaataataaggtcataacaaaggtaaataggcatggctagataaaacagtgataacgcgggaatttaagtaaagcgataatgcaataatttaaatcaaaataattttataaactgggattcaatatgctcaaggatgatgtgacttgccttgctcagagacaacggccttccgaaccttcggcgacgaccgcgaaccacgcttcgggaacctcaggaacgacagaagctacgcgaagcacacaagcaaagctacaaacctataaagaagcaataacaatacataaaaagaaagcacagggttctttaggttataacaaacgttaagagacttgaacgggtcgattcggagcttgtatgaccaagacatggttatccgaaatttaatgctgttatatggtgatttgcggattattgtaattatgttttacaactataaaacatgagcaagcgctagcctggaaaagacaggaaggctgcgccgttgacatgcggaccccacatgtcaacctaaaggaccacggtagaccgagtacacagagacggtccacgggtcgacggaagcggaccccgtgtgtcaactgaggcgagtggccgacaaacggactccactagacaccacgagggctgcacacgagcaaaccacgcggctaccgagcgcgcacacaaacacggtcaccacacgcacaagcgaacgactaccgacaccggtacacgggtaccggggtcgacaaccacacaacgggtacggggcgacaccgaaaggacgaggacggggcagcgagagaagagattcttaccaccacccgacgaggcgagggaacgacaacaacgaacgggcgcggcggagacggccgggaacgacggagacgaaaggcgaggggacgacttcggcggcgatccttggacgaaggcgagacgcggccggcccaacgcttgacgacgcggagccgaggacgaagacgacgacggggctgcagcggctcacttgacagaatgcggacgatgaacgcgaacggcttgacggagggacgaacgccacgacgatgaggatgacgaccgggaccggcgaggaggcaacgagggcagccggcggcagcttcatggagacgaggatggcgcggaacacgccgctgcgatgacgacgatggtggcggcgcagcgagacgacgagccggcgaggacgaacgaccgaccggaggagtcgtcgacgaggacgaacggagacgacgataacgaacaccggcggggttcggatggaggggaggcgaggccgagggcaaccttgacgctgtgatgccggaggtggagatggcgacgtcggccggcgcacgggcacagcggaagaggctgccgaaggcgacgtcgacaaggaggaaggagaggccggcgcgggcgacggcggtctccggacgaatcagagggtaggccggggtggaggtcgacgcggcgacgctgagggaggagacggcgcggccgacccacacctgagcggcacggcaggggcggctagaggcagtgggtggcggcaatgccaccggttgccggcggggacacgcctccggtggtttccccgtgaaacggaggtctgaccgggggagaggaggcggctgcgaggccgaacgcggcgacggcgcgaccggacggtgctcgggcgaggagggagaggcggctggaggccggttggcgccggagcgagagaaggagaaggcggggaaaggtggagaggccacgggagagcgcgggagggggctaagacgatagaacggagcgaggagattccgttttataggggaggagagggagccggccacgggagaggcggggaacggcggcggaattcatggccggcggccatggaaggtggccggggttggcgcgggcgttcccgacgattgggggctcgaatcaagggggaaattggggggaattgaagaggaaggaaaggggattaattccccctaattaatttggaatgagccggcttgaatggggcggatttggaggaggaacgtctctaggtttgcacgggagagagaagaggccgtgcgggaggaaggagacgaccgaggtgggacccacgcggcaaggcgcgcggtcagcgcgcgtgcggcgctcgtgcgcacgcggctagggcaggagggcgctgcggctcgggcaggggcattgcttgggccaggcggccggcccaggaggagaggagggagtggcggcctgggagagagagggaggaggagggagctgggccgagggggggaggggaagggcggcccaagagagagggagggaggctttgggccagacttggcccaaagggaggagggggatttatttttagtttttctttttagtaaactttgttaattgttgttgttgcttaagaaatattttcggtgctctgaaaattcaagtaaaatttgagggctcattttagaccaaggagaatttaacgaaaattctctaggccacattcgaatttttcttgtacgtattttagtgtttgccaatttcttttcgaattttaattaattatattattccttttagaaaatgatttttatttggggatgaatttattaggacgtgacataccacaaccatgagtacacaccgatccatcaaacaataaagtccatggcactatttcaaccgagccgactaagtcatcacgatgttccacaataaaatcagctattgcttgtccttaatcgccttcggcgactcatacagaagatcaaactcggttaaggaaaatatccactttccaacccttccttttaatttttgagccgatagcatgtacttgacaacgtcggccttgcatataacactacactcgttggacagtagataatgcctcaaccttggacacgaaaaatacaaacacacgcataacttctccacaggggaatatctagtttcagcatctaagagccgacgactgagatagaatacaacgcgttccttcccttccaacgcctgaatcaaagactgagccgattgacttctcaccggccgataaattcaacctaaacggtattcctttctgtggaggaatcaaaacaggaggagagctaagatattccttaatattatccaaagccttttgctgctctgccccccaagtaaactgctgatcggctttcaatctcaacaatggtgtaaaaggttctaaccttctagacaaattagaaataaaccttctaacaaaatttatcttgccgatcatctcttgtaattctgtcttattctctggaggctgaatcttcttaatcgcattaacactcctttgagttacctcgatccccctctcatgaacaagaaatcccagaaactggccagtcgatacaccaaaagcacattttgtcaaattcatcttcaggccatattttctggttctctcgaaaaccttcctcaaattagctatatggtcctctatttctttagacttaacaaccacatcattaatgtagacttcaaccaaccagccgattagatcatgatatatgtaattcatggctctttgatatgtagctccagcactcttcaagccgtaagtcatgacaacccattcaaataagccgattgcaccaggacacctaaaagctgtcttatgaatgtcttcttcggctataaaaatttgattgtatcctgcgtttccgtacataaaactcaaaatcttatgtcccgaagcagcatccactagttgatcggctattggcattgggtattcatctttcggggtggccttattcaaatttcggaaatcaatgcataccctgaccttgccgtttttcttgataacaggaactatactagaaacccactcagcatatcggcaaggacgaataaaaccagcatcatataatcttttaatcttagccttgaccggttcaagcatgtcggccttgcatctcctcggaggttgttgatgtggcctgacccttggtttgataggtagccgatgttcaacaatcgatcggctgaatccaggcatctcataatattcccaagcgaagcaatctctaaactcttttaagagctctatcagcttggttctaaacactggagataagttcttactaataaatgtcggccttagccgatcgcctggacctatgtctacttcttccaaatcatcggccgacatgaaaccttgatcttgcttgttatcgagatcatctaccgtgttcttagtgtagagatttgaaccctccacgatgccctcaaaataatagcttgggttctccatcttcaattggctgtatatcagaatcggacacttttagaaaatccccatcccagacttttccagatatacaatcaaggccatccatctcccaaagagctaaatcggcactggcaacattaactgacctgtcggctggcacgatctctattttgtcgccttgccactgaatcaaacattgatgcatagttgaaggaatgcaacaattggcgtgaatccaatcccttccaagcaacaagctgtaagaacctttcccatcgatgacaaaaaatatggcaggaatagtcttactgccgactgtcagctccacatttagaacacctttggttttggatagattgccaccaaaatctttgagcaccatgtttgtcttgatgagatcctcggcatttctacccaacttcctgaatgtagcatagggcatcaaatttaccgtggccccaccattaaccatcattttagacatcggcttcccattgacgtagccatttatatacaatggtttaagatgccgattctctgtcccctcgggtttctcgaacactgcctgttctggtgacagaaccaacttagccgattcctcttccacctcatcgacatcagcttgatcgatcccgaatttggctggcagggtaaagaccatgttaaccggtgccgtcacaacactcttcccttttgccaacctctttgcctcatcggctgcaacatcatcagctacaggaacttgattcttaacacgccactcctgccttggctttgctttctttagccgatgattaatttcttgttcaaccccctaaaggcgctccctgttcctcaatctttgaacccttctcttctgattcttcgtgaaaataccagaaggacaccattgattcttcctaatcacattgtccttgtcgatatgcttagtggccatgatcttgattaattggacccaatctttgatgaacagaaactctcatctgccttagccgattgctcctattatatgatcggccggagttctcgatgatatcactgcacccagggcagttttcaatagatgacaacctcataccttcattccagcagaatctaaagaactcacaaccccaatgaggatcaaaaccatcatcgtatttctcatgatgcttctcctgctgcttgtcatacttcttccgatatttcttgaaaatcttagccgaattcacctgaaaaccccttgcatgggccctatcggctgcttggccagctgtatgcaccatattaacaggaaaagggttaccatcgaccttcatcggctttttggaatcatcaaacctaatcttgcctccctcaatgaccacctgaatctgctgtctaaaaaccttgcaatcgttagtagaatgggacctagaattatgccatttgcaatacctctgtttgcctaattcctcagccgatggggttgtatgaccagcagtgtcacgaccggaaataacccaacgggcgttccttatgtgcgtgcattattccttgtcccaggaggcaaggtacaccaaaagttgatacaattcagagtttaacaagctgaagcgtaattaattaatttattacatgggcggcgaagacccagcacacaagaagacaaacgaaaaacagcagaagactagggcgacgaccacaggcgcttgacggcaggcacgagctagacaccaaagccttcatcatccaggggctcctcttctgggtttgggaaaaattgagcaagactgagtacaaccaccgtacttaacaagatacacccacaagtgcagaataaatgcaagggagtacaagggagccataatatagggggttagggtttgcagtaaacagcattaaaagtcactttgtaaacacggtcctagagctatacaatattattaaccaaggccgtaaacccacacgaacctgccttaacccaaggcctacgatgattcagaccgaactggcaacccgaccctgggtcctagctcgtcccaagccaacccaggctaaccattccacattttagctgttaggcaggttttaagaattaaaacactaacttgggtacattgctcagcttgcccataaccgagggcgcggctattcaaataggttatactctgataagaggtgtacatctttacccacaagacacatcttcctcacgtgtaaccacgtgccacataccaccacggtatacagacggaagacaggacatagtttccaacccatcctagccataaacaagagtaccgacccaaccccacctacggccggaacccccgggacaggtaggcaggactgagcccctagcagcaggacaccggccctgtgccatgacatctcgactaccgggccgcagctcgtgtagccttcatttgccctagagatgtccattgacccccgacttcgtccatctccatccgtgtacttttgtttataaccagactgagccacaaactaagccttacccactagacatgtggaactacgatagtgctttgcaacagaggcctgaagaccggtccttatatggccgaggtgctactatcaaaaccatgcaccccaagcccagcctaaaaccattttgagggttttgaatagagagggaggtgtaaatccaattccacaataatccaaccattccatagtgtccaggtgataagagtattcccaaagtctagagttgtaaaaccacctaatgttgccgaattaaccagtgaagcatctacctaaaatcatactagtgttaccataagtagagtgtccactagttggggttttgtttattctagggtgaacaaggaaataataacaataacaataataaggtcataacaaaagtgaataggcatggctagataaaacagtgataacgcgggaatttaaataaagcgataatgcaataatttaaatcaaaataattttataaactgggattcaatatgttcaaggatgatgtgacttgccttgctcactttcccaaacgtcggcttcaacctccacgaagagcggatcttccaaagctgcaacgtctacacgaccaacggaaaataaaagggcttttactctaataaactccatataacaagcaggaaaaaagcacaaaaatgggttcttgacttcttaaggaaaaaaaagagacttgaacggtccaattccgagttcaaatggccaagttatggccatttgaagtttatatgctctttaaatgaatatttgcgaatttcttcatttaaattttaatttaaaaagggtttatttcgtcagccgaggggaggggacgcgcggaccgggtccacgggcgtggggcccacgcggcagcctcacggtccacggtggatcgggcgcacccgggctcgcaccggccggcgccatgggccccacgcgtcagccgcacccgagggcacgggcggctgacggccgggccccacgcggcggccactcggcgcgcccgaaggcggccactcggcgcggccggcgggaggcggcgcccgcgcccctatggtcgccggcggcggccgagagaggggaagggaagggggaaaagaggcggcggtccacggctcactctaggtcgacggcaacgacaaaaaaggtggccggagcggaggaaggcggcggcgcggctcgggtcgacggggtcgacggcgttccggcggtcggcggactcggcgagggggtggacggggttgacggcggtgcggcgaagccggttgaggcgacgccggggcgggagacggtcccggcgagcggagaaggccagccggaggtcgtcggcgacggaggtcccggcgagagggcgacggcacgagctcgattccggcggggagtgggtgcggcaaggggcggaaacgggcgagggaggcacggggagggtttaaatagggttggaagggggagagagcggccggaggggaaggaaaccggcgcgggaggtccggccgccatcaatggcgccggcgagatttgcgggggcaaatctgcccgtttgaacacgagagagagagggaaaaatggggcgaaagggagaggggatcacagggagtatttccccccactttattgcacgcagggacggcgcgatgcggcggatttggcggcagcggcggcgcttggcgcgggcggagcggcgggagcggcgggagtggcgggaggacggggatgacgggtgggccccacccgtcagcgagggtggcgggcgggcccgcccgtcagcggcgcgcgcgcggggagggaggctgaataggccgcggggaagaggagacagagagggggggtggatagggagatgggccgagccagcccaagggagggaagggggacttttagggtttttctttttataaaacctttttaactttgtttattttttaataattattatttgtgctctgaaaattccactaaaatttatttacgcattttaggcttttaggaaatttacaaaaatcctctaagccttatttggcttttaactttgcacattttaattcttggaggctttcacacggattttaattattctaggcaacatttaagggatatattttagagtcgttttgggacgtgacaaacctaccccccttaaacggaacctcgaccccgagattcggaagaactggcgaagagatcgggatgggctgccttcagctcgtcttcacgctcccaagtagcttcttcctcggcgtggttgctccattggaccttgcaaaaacgaattacccggttcctggtcctgcgctccatggcgtccaggattttcaccggtctctccacgtaggtcaagtcttcgcgaacttcaatctgctctgagtcggcctgctcggacggcactcgaaggcatttcttgagttgcgacacaaggaacacatcatgcacgttgcccaaggaggcgggcaactccaactggtaagcgacttctccgcgtcgagcaatgatacggaaaggacccacaaaccgaggtgcgagcttccctttcgtctgaaaccggtgtatgcctcgcaacggtgcgacccggagatacacaaagtcatccactgcgaattccaggtcacggcgtcggttgtctgcataactcttctgccgagactgggccacctttagattctcccgaatggtcctgaccttcgcttcagcttctctcaagatatcggtcccgaacacttggctttccccaacttggtcccacaatagtggtgtccggcatttgcggccatacaatgcttcgtacggtgccatctgtatgttggcttggtagctgttattgtaggagaactcggcgtaagggagactcttatcccatgtcttcccaaaatctaggacacatgtgtgaagcatatcttctaggatctaatttagacgctcggtctgtccatttgtctgcgggtgatacgcggtgctgaaatttaagcgggtacccaactcttcttggagcttcttccagaaatgagaggtgaactggcgtccccgatcagatatacttttcttaggaacgccatggagacttacgatcctagcgaagtagagttcagctagtttgttccctccataggtggtcttcacgggaatgaaccgagctaccttggttagtcggtccacgactacccatatagagtcataaccgccttgggtttttggaagtccgatgatgaaatccatcccaatttcatcccatttccattctggtacttgtagaggttggagaagtccggccggccgttgatgctctgccttgacacgctggcacacatcacaaagggccacgaactctgcaatttcccgcttcatactaacccaccagtatttcccttttaagtctaagtacatcttcgtactgccagggtggatggaataaggactttcgtgagcttcctgaagtatcagctgtttaagttccttgtcgtccggaacgcatacaccatttccgttccatagggttccatgttcatcttctgtgaaaccagcggctttaccttgtttcatattcttgaggatcccatgcatatctggatcattcttttgagcctcgcagatttgatcgagcaaggtgggcttggcttccagcgtagccaagaatccacgaccaactatgcttaggttcagggcttccatctgttgatgaagttccggtggaatgccacggacgctaagagtgttgcaacggctttttcgactcagcgcgtctgcgaccacgttggccttaccagggtgatagtggatccccacatcataatccttgatgagctctaaccatcttctctgccaaagattcagatccgactgggtgaagatgtatttcaaactcttatgatcggtatatatttcgtagcgattcccaatgagataatgccgccagatttttagagcatgaaccacagcggccaactccaaatcatgggtagggtagttgccttcatgaggccgtagctggcgtgaggcataggctaccacatgaccttcctgcatgagcacgcaccccaatccttggcgcgaagcgtcacagtacaccatgaagtccttgcgagtatccggtaagattaaaactggcgaggaaaccagattttccttgagagtttggaacgccttctcgcattgcgggctccacacaaatttttcttctttcttgaacaactgtgtcatgggtcgagcgattttggagaagttctcgatgaacctccggtagtatcctgccaaacccaaaaagctgcgaacctgagtaactgtcttgggttgcttccaatcagtgacggcggtcactgtttcggggtccacagcaactcctttagcagatatcacgtgccctaagaatttgacttcggataaccagaactcacacttgctgagcttggcatacaattgatgttcccgcaactttcccaacaccagacagagatgctgttgatggtcttcctctgattgtgagtataccaggatgtcgtcgatgaagacaacaacaaacttatccaagtattccacgaacactttgttcattaagttcatgaagaaggcaggagcattggtcagcccgaacgacatcaccgtgaattcatacagtccataacacgtggtgaatgcggtcttcgggatatcttcttcacggatacgcaattggtgatatccggagagaagatcaatcttggagaataccgtggcacctttaagctgatcgaacagatcatcaatccggggaagagggtacttgtttttgatagtaacttcattgagagctctgtaatcaacgcacatcctctttgtcttgtctttcttctccacaaaaatcacaggagcaccccagggggaagtgctcggccgtatgtaccccttttcttttaactcttccaacagtttcttgacttcggccagttcatttgctaccatacggtagggtcggttgtacagaggagtggttcctacagcaagatctatccggaactcaatctctcgcttgggcagcataccgggtagttcttccggaaacacatctccgaactcactgactatggggatttctgacagtcctatctgatgaagttctaaactaccgacagaggttgggggtgcaaagaaaacaaccggttgttccggccctcggtacagagtgacagtgcgtcttgcgcaatccactactccttggaattgagccaaccaattcatcccaaggatcacatgcaagttcttggtgtctagaagaatcagatccgaaggaaaaggaattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtaccagggatggaatgaatgaggaacgtacccacgatgacgtctggagttgtcagcacatcctcggcagtcacgtggttcacatgaccccgaatgacatccttaccactgttgttggggcggggaggcgcttggccttgctggcgcctcggctttgggcatttatccgcaaagtgcaataatttaaaacagtgataacgcgggaatttaaataaagcgataatgcaataatttaaatcaaaataattttataaactgggattcaatatgttcaaggatgatgtgacttgccttgctcactttcccaaatgtcggcttcaacctccacgaagagcggatcttccgaagctgcaacgtctacacgaccaacagaaaataaaagggcttttactctaataaactccatataacaagcaggaacaaagcaccaaaatgggttcttgacttcttaacgaaaaaaaagagacttgaacggtccaattccgagttcaaatggccaagttatggccatttgaagtttatatgctctttaaatgaatatttgcgaatttcttcatttaaattttaatttaaaaaaggggtttattgcgtcagccgagggggagggggcgcgcggaccgggtccacgggggtggggcccacgcggcagcctcacggtccacggtggaccggttgcacccgggctcacaccggccggcgccgtgggccccacacgtcagccacacctgagggcacgggcggctgacggccgggccccacgcggcagccactcggcgcgcccgagggcggccacgccggcgtggtcagcaggaggcggcgtgcccgctccccgatggtcgccggcggcgaccaccggcgcggcggagcgacggccgagagaggggagggaagggggaaaggaggcgatggtccacggctcaccccggggcgacggcggcgacggaggaggcggccggagcggagggaggcagtggcgcggctcgggtcgactggtacggcggtgctccggcggtcggcgaccaaaacggaaaggtggacgagatcggcgaggatgcggcgaagccgaaggagacggcgccgagctgggaggcggtccggggcgatgacagcggcggaccggagctcggcggcgacggcggagagagagagcgacgtcgcgagctcaaatccggcgaggaggaagggcggcgagaggcggaaacggacggaggaggtgcggggagggtttaaatagggttggaagggggagagagcggccggaggggaaggaaaccggcgcggcgctctcgggctccatcaatggtgccggcgggattaggggagggtttccaaacgaatccaagggagagagggagggaaaattggggggaaagggagaggggatcacggggagtgattccccccactttattgcacgcgaggacggcgggaggtggcgggattcgcggcggcggcggcgctagggcgcgtgggaggcggcgggagcggcgggaggaaggggatgacgggtgggccctacccgtcagggagggtggcgggcgggcccgcccgtcagcggcgcgcactgggagggaggccgaatgggccgcgggggagaggagagagagagggggagggagatgggccgaattcggcccattagagagaaggagggattttagggtttttctttttataaaatcattttaactttgtttatttcttaataattattatttgtgctctgaaaattccactaaaatttatttacacattttaggcttttaggaaatatacaaaaatcctctaagccttatttgacttttaactttgcacattttaattgttggaggctttcacacggattttaattattctaggcataatttagaggatatattttagggtcgttttgggacgtgacacatattcctaatgcttataatgatgtttctaggggatatcctcccgatacaagacaaggccaatataatcatattgcgccacaaacacaacctattaggccaccaaacccaccgccaaatcaacaagggcctaataacatggaggatatgattagtgatattatgaggaatagattcgggattgaaactagaaatcgtgctagaacttacaaaaagtcatatcctgattattatgataatgtgctgtttcctcgaaattatagagttcccaaatttgccaagtatagtggtgaggatggtaagaccacatgggagcatgtaggtcaatttttggcgcaatgtggtgaggctaatagtgatacttttaaattgcgcttgttttctttatctttatccggtaatgctttcacatggtttacttctttaccagcaaattctattcatacttgggctcaattagaagaacaatttcatgattatttctatactagagaaactgagcttaggttatgtgatttgacatcggttatgcaaaagtataatgaatctgtcattgattatattaagagatttagagatgttagaaaccgatgttatactttgaatataactgatagagatttggctggtcttgcttttaatggtttagttgctcctcttagagaaagactagatggccaacaatttcttgatgttagtcaactcatgcaaagggctctggctcaagaaagccgggttaaggataatagaaaacttgctagaccatttgataaaaagcctaatgttaatgtggttgattacccttaagctaatgatagtgaggaagagggtgatcatgatatttatgttgccgaatggtcatggactaacaaaaataaaacttttgtttgttctaacctaatcccgactcctcgcaaagatcggcaaagtgaggttaaatatagttttgatgtggccaagtgtgataagattttttattatcttttgcaagagaaacaaattagattacctaaaggccatgtcataccttctcaagaagagttgaaatgtcgagcatattgtaagtggcatgattctcattctcactctactaatgattgcaatgtgtttcgacgacaggttcaatcggccatagatgaaggacgattgaagttcaccgatggctccaagatgaagcttgatcatgatcattttccggtgaatacaattaatttcaatgataagaaggtgttgattcggccggagcaagccgaatctactaaggggaaggaagtggtcattggtgaaccaaggtccaagatgatagtgctaaagaagccggaggttggcgtttggaaagagaataggagtggagcttcaacttctaaagcccctaggaagaccaaggtgacttttaatatgcttttggagaaatatgaaaagcaaggtggtgagaaaattcgcaacaaagggaaaagaccaagatcacctcctaaggagcgatttggtcattcaccaagacggtcgcgttcaccttcgtatcattatccacaagatatgtcatggggttcctatccaatgccgccgtcgggttatccttatccttgcttcatgccatgggggccgacgccgccaatgttcaatcatatgcctcctatgcaattcaaccaagggaggggaggaccacggaggccaattcatgagcgtttgtcttcaccaaacaatagccgattttatggtaagaatcgggctaatgaagaaaagtgggaaggaaagcgcgtcaaggtggaggagaggacttcggaggtgattactatcaaagtggggtctcatgatgtgccaataccttctggagatggagttggagtgtccccaaacaagaaatccgaagccggtaccagttcttcgcagtcggccggtctgaccgcagccatacggctggtctgaccgggccatcaggccggtctgaccgccgacccgacagcggttcggccgatgcctcaggccggtttgaccgctcgccacatgttggtctgaccagcgcgtctggccggtctgaccggtggtctacggccggtctagccgggctccagcttcggtttgatgagagggctgcaaagggcgatgtgagggcttcatcgtcttcaagcaaagttaataaagggcattatttacctcctggaatagagccgaatcctaggtggatgcctaaggatttgacggctacacaaaagagaaggttgcaacgtcttcgggcccaagaaataagagagaaaaaggccgaagagcaaagagataaaaggtttaacgagttgcgaccaccaccggtatggaggcctaagtccatagagaaggaaaaaccggttgatataaatgagaaggaagaacaatcggttgacaaaggtgaatcatctccaaaagaagacatggatatcaacatggtgtgtatgttgcctatggagttttgtgctatggatgaagctgaggttgctcaattctcattcggtcctaaagatgcggtttttgagaagcccgatgagtcaaaccgtcacatgaagcctctttatctcaaaggccatgttgatgggaagccggtctctaggatgctagtagatggaggtgctgccgtgaatttgatgccatactcattattcaagaagttgaggcgtgaggatgatgagttgaagaagaccaacatgattctcaatggcttgaatggtgaaccaacggaggcaaggggtatcttttcggcggagctcaccgtgggaaataagacgctaccaaccgctttcttcatcgtcgatgtgcaaggtaactacaatgttattttgggtcgttgttggatccatgccaattgttgtgtaccttctaccttgcatcaatgtttaattcaatgggacggcgatgatgttgagattgttcaagcggatacatcggccgaggttgcaatggctgatgctacttttgagtggcatcataggaatatccaatgcttatcggggagggatctttctagttaggattttattagtatctccgatggcaaatttgtacctatctctataaagccggctagtgtagcacggctaagccatataaatttgtataatgagtaaagaggctaatttagagtggttacaaaggagggtgtaagaatatcggtctacaaagaacgatattggcgaaaccgttgaggattttgatgaagtagagaagcttagaaaagggtttacatcggccgatcctttggaagaagtagacataggtgatggaactaagccaaggccgacttttgtaaacaaaaatatgagagctgattataaggttaagataatcgagctacttaaagaatatgttgattgctttgcatgggagtaccatgagatgccgggtcttagccgtgagcttgttgagcatcggcttccaattaaaccaggttttaggccttataagcaaccacctcgtcattttaatcctttgctatatgactgagtcaaagaggagattgatcggttgttgaaggcgaggtttattaggccatgtcgttatgcagagtgggtatctagcatagtcccggtggaaaagaaggggagtgataagattagagtttgcatagattttagagatttaaataaagctactcccaaagatgaatatcctatgcctatagccgacatgatgattaatgatgcctcgggtcataaggtgattagttttttagatggcaataccggctacaatcaaatctttatggcggaagaggatatgtacaagacggcttttaggtgcccgggatttgttggtttgtttgagtgggttgtcatgactttcgggttaaagaatgccggtgcaacatatcaaagggcaatgaatttgatctttcatgatttgttaggtattgtcctggagatctacattgatgatattgttgttaaatcggatggtatggaaggacatgtagccaatttgaggttagctattgagaggatgcgccggtatggtttgaagatgaacccacttaaatgtgcttttggtgtgtcggcggggaagttcttaggattcatggtgcatgagagaggagttgagattgatcctaagaagatagaaaagattcatgatttcaaagcgccgacatgcaagaaggaggtccaaaagttgctaggtaaagtgaattatttgagaaggtttatttctaacctagcgggtaaaatcgatgcttttgttcctatacttcgcttgaaaaaagaagccgattttacttggggggcaaaacaacaagaggcgtttgaagagttgaagagatatttgtctactccacccgttgtgcgagcgcctaaagccggaaagccttttcggttatatattgcttccgaagacaaagtcattggtgccattttgacgcaagaggaggatggcaaggagtatatcattacatatttgagccgccgccttttagatgccgaaacaaggtatgtctttatagagagactttgtctatgcttatactatgcttgtaccaaattgaggcattatttgttatctagcacatgcatagttacttgtcaagccgatgttattaaacacatattgcaaaggccaattctaagtgggagaattggtaagtgggcatatgctttgatagaatatgatttggcttatgaaccattgaaatctatgaaaggccaaattgtatgtgattttatagtagaccatcatatagatattgcttatgagggagaggtttgcttaattgaagttataccttggaagatttattttgatggttcttcttgcaaagaaggtcaaggcataggggtagttttgttttcacctaatggcatgtgttatgaagcatcggttcgtttgaagtattattgtacaaacaatcaggccgaatacaatgctttattgttcggcttacaagttatggagatggttggagctaaatacgtggaggcttttggtgattcggaattggtggtgcaacaactcgccggagtctacaaatgcttggacggatcactaaataggtacctcgattcatgtttggatattattgtcaattttgataattttgctattacacatattgcttggcgtgataattctagagcaaatggcttggcacaacaagcatctggctataatgtgaagaagggattattttttatattagaagagtcggtgcttgattttaaatctttatgcgaaattggcaaaactggagaccaggggcggtctgaccggccgcatgccgccggtctgaccggcgaccccgagcggtctgactggccctgtgtggtcggtctgaccgggtttggacagagcgccggggggcacgtttcaatcaatttggaagccgaattaattgtgaattcggacatttgtgcccaggtgacagaagaagattggagaattcctttgattcaatatttgaaggatcccacacttaaggttgatcggaaaattcggcggcaatcgttcaaatacacattgcttgatggtgtcttgttgaagtgcttagatgaagatcaatctaaagtggctatgggggaggtacatgaaggaatttgtggaactcatcaatcggcccacaagatgaattggttgcttagaagagcgggattctattggccgaggatgattgatgattgcttcaaatattatagaggatgtgaggcttgtcaacggttcggcaatgttcaattggcgcccgccgccgtgttgaatcccataatcaaaccatggccattccgagggtgggctttagatttcgttggtcaaatttatccttcattatcaaaggggcataagttcgtgctagttgctacggattacttcactaagtgggccgaagccgtgcctttgaagaatatgactcatacggaggtaattgactttattttgaagcatattattcatagattcggtattccgcaaacattaactacggaccaaggtgcttcttttatgtcttaggaagtgaagagttttaccgaatcttatagtattaaattgttgagttcttctccttactacgcttaggctaatggacaagccgagtcgagtaataagacattgttgaagctagtaaaaaagaagattgaggaacacccaaagaggtggcatgaggtgctttccgaagcattgtgggcgcataggatatctaaacatggtgccactaaagtcactccttttgagttagtttatggtaaagaagccgttttatcggttgaggtaaatcttggttctcttcgttatatcaagcaagatgatttgtcaagtgaagattacaagacgttgatgggagataatcttgatgaagtcatcgacaagcgcttgagggcattggaggagatagagaaagagaagaagagggtggccaaggcatacaacaaaagggtgaaaggaaagttgtttcaagttggagacttggtttggaagacaatttttcctttgggtactcgatccaaggagttcggtaagtggtctcctagttgggagggtccttatcgagtatgcggcattgttcgagggaacgcgtattttttggagacacttcaaggggagcgttttcagcgagcaatcaacgggaaatacttgaagcaatacttcccgagcgtttggcaagacgcttaggaggtactatggccggtaattagattatcgtcctaagaccaaaaacatgttctatgcttttagattcacgttgttcatcaaaaaggcaggggggcatgtgtttatacccaaatttggcacctaggattaaaataggaaagattgccaaaatttggaagtctgccggtttcctccgagtgggccggtctgaccgccgtgtgttgggcggtcagaccgccggttgagggctggtcagaccggcggtgtgtggccagtctgaccggcagggccgagtccgattctgtttcatcgggtctcgaggtttctttgctcgggaaggcatgtttcgggtttcctttggcttctatcccgagttggacgtggaggagggcctgtagagggcaagaccaacccctatataagggacatggccggttcattgtaaaaaagccaatctactatcaatcgatcgaattgtttttttatattgcttttagttttctcttagtttgtccatctttgtcgggttgcgccataaaccgtccgccgtcgctgtgagagtgcgacagctctttgtaggtttgtcctgaaaaccttccgttttgcccacgagacgggtagttatctagaaatcggctccgctagccggtttagttatcaaaacccatctaggtttagctctttgctagatcgaggtggttggcgactctaggatcaccgcaaggcttaaggtgctgcgatcgtgcttgtcaacttgtcacaaaaagttgccaacaccgtcggctgagatgttggtgcagcggaggaaaccgcctgagttgatggctgaacatcggtaatcaaagaccgataatttggaaagacacctccttgcaaataaaccgggcctgcagcctgatgctcagctattgaaccatcggctatggacttcatcatgtttgataaggtattgactaacaccccagattgattgatcaaagcatgatgcacagcgtagtcaacccgatcttggaaattactgaaaaaatcttgtgccgcatcactattctgattatgatttcctccttgcaacccctgagcaccatcaccttgcactccatgcaccccgtcaccttgcactccatggactccttgagaattgtcaccttgatttcctagagagctgtcgatagcacttttgttactcagctgagccgagccgtctggagcttgttttccatctccatccttagaagaactggtccctggatcatcagcaaccacttctattttgtacttctaaacaagtgtccccttgcgggtctgcatgaatgagttcaagaactgatcccgtgcttgctgcaacattgcttcaaactctatcttctgctcaggtgtgaatttttctggatcgatcggcacgacgtttccttcattgacgtcagtcaaccctaatttcagcaccttttccttaacagagcctgggctagctggggatggtggtggtggttgtttctcggccatgaggacgaattgttggctgacttcttaaatgtcccaccgggcgtgccaaaagcgtgttgacagaaaacacgaggcctgggagatttacttaactctagtacaggtccaaatctcaccttcgaatgtatgagcatgccagttgatttgatcctgtaatcaacaagaaatagaagcaaagaaaccgcagttaaatctataaataatagccgatcggctaggtgccgatgtcatatatacattgatcggcagtcattaagaaataagaagggactaaatctactcgattggctgtagatattaacaatatataatcattatatcgatatatacttaaatcaagtgattgggatagatcggtcgctatgccgagacagtataaatcacatagatcgaaatatatattaataatgagactatatacgtttatagcatagccgatcagatagatctagcatgtatcggctaatactccgatatcactctatattaagatattaaagcgagtagaatatactaaacaaaagcctaatatacttaaatgcagcaagatcttaacgtaaagggcagatttaacatgtcaatcaaacatataggataaaaagtagttaaatcaggtaagatcagctgaaactccgatactaccctaatcagcaaccaagaagcgggctagagattgagattctaatcacgactcataagatcatacttaactgatgcagctataagtatgaaaagaagaacaatgtctagacaatcaagccgttggatgtgtcatagagtggtagatatcctatataatctaagtcaacatcggtgtttaacctagtcggctgccttctattgacggatgttagccgattgtaggttagatatcgatattgccaaggattatgtaggatatatgataactcgacgaattacataaacaagattagagtgtcataaagatggaaacactaatcccgagaacgcaagccaccataacaagtttgacctcttggtgaagatcgaaaccgatgcagctcaacccgaaagcaagaactcgtcaaaataaaactaaagcaaaaaggtggcgatgcgccgagattgtattgaacgtgtgtgttaaaagttacatagggctcgggtatatttatacccgaaaatcacaagatatgtcctaacggacacaactactatctctaagaaactctaagataccataagtctttgcggcagacttttgcccaagcatatctccaaggagattacataaaacatcctaattaatagatacaattgccttctcaggactctatccatgtgcggcaatcaccttgaagcgccttaattcaacccgatatcatacatcaggttgcattgtcggaatcggctgcatcggcttacctagcccgactcagacccagccgatccaatttgtagccgatctggactccagccgattcctgctctgtttccgaactcgatctccgcctccgactttgcatcgatctaatcttctttcccaatgccgatattaccaaatttggttgttaacagataccactctatattaacatattaaagcaagtaaaatataccaaacgaaagcctaatatacttaaatgctacaagatcttaacataaagggcagatttaacatgtcaatcaagcacataagataaaagtagttaaatcaggtaagatcggctgaaaccccgatgctaccctaatcggcaaccaaaagcaggctagagattgagattctaatcacgactcataagatcagactcaactgatgcagctataagtataaaaagaaggacaatatctagacaatcaagccgttggatgtttcatagagtggtagatatcctatataatctaagtcaacattggtatttaacctagtcggctgccttctattaacagacgttagccgattgtaggttagatggcgatattgccggagattatataagatatatgataactcgacgaattacataaacaagattagagtatcatgaagatggaagcactaatcccgagaacgcaaggcgccataacaagttttacctcttgttgaagatcgaaatcgatgcaactcaacctgaaagcaagaactcgtcgaaacaaaacgaaagtaaaagggtggcgatgcgccgagattgtattgaatgtgtattagtttgattacatggggctcggggtctatttatacccgagatttacaaaatatgtacacatcggacacgactcttatctctaacaaactctatgataccataagtctttgcggcagacttttgcccaaacatatctgtaaggaaattacgtaaaatatcctaattaatagatacaattgtcttctcaggattctatccatgcgtggcaatcatcatgaagcttattaactcaacccgacaatgtattctttgtcatattgtaggattcggctcaatcggctaaccctgtccaactcggactctactaatcctgatcaaagccgattcggactcttgccgattcttgctctgtttcctaaaagatcttggatttagattctgcttcgatctgatctctatctttgatactcagattatgaaatttggtcgttaacacaagtcaagcccaaggggcatcgcctcaaagccaactgccgcaattcgacccaagcaccgcggtccaagcacccatgaccttcgcacaagccgtgccctctggctacggagcggtcccactaccaaatcaagtttggaaccaagtcgtgttcgacccagctatggtgatgcaagctgctccgactgaccaacaaaaccagccaatggtgtttggcacggggcatcaatcaacagctgctgctcaacctcatttgcgcccccgtacccgcagctaagctggccttctcagcaaggcgtcatgatcaagtcggatggcgaaaagggtttgccgttgagttgggggatcaagaatcatcccatcccaccccagttcaagttccctcatgtcccaaggtattcgggagaaacggatccgaaggagttcctctccatctatgagtccacaatcgaagctgcccatggtgacgagaatacaaaggcgaaggtaattcacctcgctcttgatggcattgctcgatcttggtatattaatttgcctactagtagcatttactcatgggagcaattgcgcaatgtctttgttcttaactttcgaggcacttatgaggagccgaaaacacaataaggtcttctcggcattagccagaggccaggagaatcgacaagggaatacgtgcgccgcttctcgcaagcacggtgccaagtgcaagacataacagaagcctctgtcatcaacgctacttcgaccggcctacttaagggcgaactcactaggaagatcgcccgcaaggaaccaaggatgctcgaacacctctttcgcataatcgatggttatgcatgaggcgaaaaagataccaagcggcggcaagagatacaagccgaatatgacaaaacagccgcagccgagacggccaccgcgcaagctcacgcacaagctcaaattcaagcccaagttactagttcggcacccgttctgattcactcaacccctccggtgaatcaagggcagcctttaaggccgaaccatgccccgatgacatggaaaaatttagaactgatcgagctggcaaagcagtgatggcaggagaagaagtgcaagcccttcgcaaggagttcgacgctcagcaagcgggcggccagcaacaaccttttcgcaaaaagatcaggaaagacctatactacgccgttcatggacactcttcgcacacaaccgagcaatgccggaacattcggcagcaaggcaacactcaagagctcaggcagcagcaagccagggctgaagaggcaacgcgcgaagcggtcctcaaccaagcacctcaggctgaacagcgccaagatgcacagtgaagagtgatctaggtcatcacaagatcttatccccccctcgcaagtgtcgaaacgacaaaaaaagatgcaacttcgagcagtgcatagtattgtttcggcaggcgaaggggtcccaagatacttgacgcaacagatatccttcagaccgaaggatgctgaaggagtccttttcccacaccaggatcggttggtgcagagatggttggtattgaagttcggcatatcttgatttatggaggcagttcggctgatgtcatcttcgccggaacatatgccaagatgggtttgccgacactggcattgtcccaagcaccaacctcgctcagggggtttggaggcgaagtagtgcaagttttgggtcaagcccacctcaaagtcaccttcggcacacaagaaaacaagagagaagaagagatactcttcgacattgttgacatcccatacaattacaacgccatcttcggctgaggcactttgaccaagtttgaagcagtctcttatcacaactacctcaagctcaagatgcctagcccagccggtgtggtagttgtcaagggttcccatccttcggctaccatggtggccttatagatcgccatgtgggccacccggcacggcacggcccaggcccggtcgtgcctgggccaaggcttgtcgagccgacacggcccgaccgacgcaccgggccatgccgtgccagcccacgtgccgcactcacggcctaggcacggcccaacacgcctggggccgtgccgggccggcccgaaggcacgatggcccatagtgcttttcctcagaataagtctaattttcctccctcctattgggctgtgacatatatatagctaaaaaaagtctattttacctcccttttctttgggttgtgatatcaatagctaaaataagtctatttaaggtccctattctttggacagtgacatttatatgtttatttttagtccctatactttgtgtggcatgcctggcctgccggcccatcatgccaggccggcctgaccgtgccgggccagcccagcgtgccggaggggaggcccagacacggcccggcggtcgggccaggctggcacgggcccgacccaagtcaagccgtgcggtgcttgggccgggccaaaaagccgtgccatgggccgggccttcgggcctcgggccttatggccatctataggtggcctccttcgacaggggagttcataccttagaagtcgaacggcaagaaagaaccaggccgacgctgaaacccgtccccacggcaaggttgtctggttgcagatagatgactctgaccccgccaaaatcatatcactcggcggagacctgagtgaacaagaagtgaatagcatcctgatcgtgctcaaaaaaacattgatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38052 - DNA, 717 bp, Oryza sativa
ccaacccatcctagccatagacaagagtaccgacccaaccccacctacggccggaacccccgggacaggtaggcaggactgagcccctagcagcaggacaccggtcctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgagggttttgaatagagagaaggtgtgaatccaattccacaatgatccaacaattccatagtgtccaggtgatgagaatattcccaaagtctagagttgtaaaaccacctaatgttgcctaattaaccagcgaagcatctacctaaaatcatactagtggtaccatgagtagagtgtccactagttggggtttggtttaatctagggtgaacaaggtaataataacaataacaataataaggtcataacaaaggtaaataggcatggctagataaaacagtgataacgcgggaatttaagtaaagcgataatgcaataatttaaatcaaaataattttatacactgggatt

SEQ ID NO: 38053 - DNA, 852 bp, Oryza sativa
tcccgccggcgccattgatggagcccgagagcgccgcgccggtttccttccaaccctatttgaaccctccccgcacctcctccgtccgtttccgcctctcggcgcccttcctcctcgccggatttgagctcgcgacgttgctctctctctccgcctcgccgccgagctccggtccgtctcccacctcggcgccgcctccttcggcttcgccgcatcctcgccgacctcgtccacctctccgtttcggtcgccgaccgccggagcgccgccgtacccgtcgacccgagccgcgccaccgcctccctccgctccggctgcctcctccgtcgccgccgtcgccctggggtgagccgtggaccgtcgcctcctttcccccttccctcccctctctcggccgccgctccaccgcgccggtggtcagcggcggcgaccatcggggcgcgggcgcgccgcctcccgccgaccgcgccagcgtggccgccctcgtgcgcgccgagtggctgccgcgtggggcccggccgtcagccgcccgcgcccttgggtgcggctgacacgtgggacccacggcgccggctggtgcgagcccaggtgcgcccggtccactgtgggccgtgaggctgccgcgtgggccccactcccgtggacccggtccgcgcgtcccctcccccttggctgacgcaataaacccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgc

SEQ ID NO: 38054 - DNA, 3767 bp, Oryza sativa
  unsure (1)..(3767): unsure at all n locations
tgttgcgagtgtagtggtttatgtgcgcgtctgccatataatcttaaaacactaccataattttaaatctggtttaaaaatttaagctgaaatcaacgaagtatttgaaattctcgaaagtccagacacactatcaaactattgttacactgcacgaactttgtagtgatgtcatataaaaatggttagcggtactacgaatatatattgacaaaatgttcagtcgaaaaaaatagaagaccatttaacatttatggtccaaaatagatcacagaccgctacactcaagcacaagacaacaatccataattctcccagtatatgtaccatgaggtcataaattaatcaatattctcaacttcgaaaactatgaatcggcagcttgtgttctcaactacatctcttcatttttcgcacgcatatatttctcagactactaaatggtatgtttgatgaaaaaaaattctacgaaagttgctttaaaagtttatattaatatatttttcagaaaaaaaatactaatacttaattaatcacgtgctaataaatcaccttgttttacgtgtttgacctaccgaacacagccttaaaacaaaagcaaaccaaacggatttacctcacattaatccctggaatttctatttctaatttaaatccagccaccacatcgatccgcactaactgtctcatctctcaatcacagctcgtatttcatccatgagggaagggaaatcctgcaacaatcgaaggtacccctgcgtcgtcgccgccttcctgaagtgttcgtcctcgcgcgcgaggtagtcgaggcacttcttcttcagctccgggcagccgtacgtctcggcgcagacgatgatcccggcgacgttctccggcgtgacgttgtcgagcagcttcttggtggacagcagcttcagcccgccgagctcgtaccgctccgccgcggcgagcaggtgctggaacatgtccaccggggagaatccggcgagctcgtcgatgtcgtcgggcagcgcgtccgtgtagatgaagtggagcaccgcgcggaacgccgccgggtccatgtcccggagcgcgaccgacggcgcggtggcctccgccatggagccgaagagggcggccttgaagaccggcgagcgcgcggcgagcacggcgcggtgcgcgcggaacgtctcgccgccgacgacgagcgcgacgtccgcggtgtcgtcggcggcgccgtagagcaggcggccgatgtgcccgcctcctccaccggacgacggaggcggcggcggcggcggggacagcgcctgtgggctgtcgctcgggatcaggacgccgcagacgacggtgacccagccgtcgccggacacgaacttcttctcgagctcgctccgcgacgcgaagtacatccacccggcggcggccttgccgccgccgcggccgccggcgccgagagggtagacggcgacgaagctcttggcgtggaccggggacgggtggccgtcgaggtggacgaggaacgcggcgaagatggccctgacattggtggaccgggtgacgaggtcgagcttgatggagaggtactcgccgccgatccgctggccattgctgttcatcgcgccgccgccgcgagggtagcagaggacacgccacgtgtggccgccggcgtagatgtcgtcggagcggacgaagtcgccggcggcgaggtcctcgtaccggagcttcagctcgatgaagccgccgtccaacatggcgatcgaatcgtgtttcgtgctagatggaacgcgattaacgagaagaggataacgatggtttacgtcattttaaaccatgtcattttttaaaagttaccaaatatttacatacatttttttccaaattttgataaatacataagaaattctacaatattgtcaacttaacaaaatttggtaaggtttattttagctataatatggacaacgcttaaatctaaaaaaaaaaaaccctgcttattctgttgcgtatgttgcctcttcagcatccgtgggcttcttggccttctcccataaattttacaaatattttgacagaaatttgttaaagaaacaaatgtctggcagaaatagttttttctttcaaatttgccatacgtttatcaataaattttattaaaaaattgataaatgtaaaaaaatgtagagtaaatatattgtaacttatatatctacactaaaatataagtttaccaaacattgtttaagtttttcataccttatactccgtattaggtaaatttgaccgagttcgcccccttttttatgtatagacgcacttgtggcaagatctcatttctcatggttcacatattatcaactgaaaaatcttatttcctagaggaatttcacagttgttaaaaaaatatctcaagatacctaaattaacttgaaatatttagtacttagatataccaaattttgaactagaaaatatctcatttcttatggatgataaaattatctcatttcttatggttcacatatcatatggctaatgtatggctcactttttgctagctataacttgaacaagtgtgataaatgatactactagcaaacttagagcaagtttaatagtatagccaactactagctccaattcatctatagccaatctaatagctcattcatacaatagttatatactacgctattaatacctggtcccacatgtcatacacaccctgcatcttggagtccgtgctacagctggctacaaatctgtagtctgcttctcttctctctccttatttatcttcttaaaatatgtttgcagctggcttatagcctgctattgtacccgctcttagaatactccctagcattcaaacagccccttcataccaaggcttgttctccgggacgccgatggggtagaaggtccccttgcatctggtgaaatgtcgcttgccatctgttgtggtcgccgaaaaactcgaggtgcccctgcacaagcatcatcttgcgaggggtacccgtgtttgcaatgccggtgttcataatttgatccggagagagatcttgtttaaatacaagtcgtatagcttagcaaggcgagagtctgataaacgttaaagagttcaggcctccagggcaagcataatacaccataatataatattaagacggtcatgcatgccaagaggcaagagcaatgtgtctgttaagagttagcaacgaaaagttaagttcaactgaatgtccgatgctttcctttcaagaaaatgttgaaatttctcacacgcatgaatggaatgaagcagatgcagatgagatgatgaaggttttccttcttccatcaggaaaatcagtctccgcttagatgacaattttgaacgaatacaaactctattctgtaaaggtccgacaactctaaggcctaagctttcacatactcacgaatgaactcctcaaccgctgaaacattaccggtcagaccagcaccttcagtaactgtcaccttgttctggcattggctgaaattaaatgcttctccagggttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38055 - DNA, 662 bp, Oryza sativa
attatattgttattttattacatcatcatcatcatctgattgcctttatatcattatctacattggacatatagccgattgcttaaaccctatcgctatcggctattatcggctatcggctggaactactccatcggcttgtcagccgataggctgttttatctactgtttacatatcttgtcagttgcaggatcaaactgactggcacgcccgcatctcattatatttggacctgcactggagctaagcagatctcccaggccagtgtgttcgattttttcgttaacaaatacacaattaataactggtcccacttgtcatacacacatgtatcttgtagtctgtgctgcaactggctacaaatatgtagtctattgcttttctctcttctcttttatcttctcgaaatgtatttatagctggcttatagtctgctgttgtaactgctccgtactagggatgaaaatgatacgaaatcggatggaaactacctttatcttttcgttttcatattttttacggaatcggaatcggaaaccccagatacgaaaacggaatcaaatattgtcgaaaccaaaaacgggaccggtgctgatacggtaacaaaaatttatcgaaatacaagtctcaaactaagctttaaactatgtcaaatccaatt

SEQ ID NO: 38056 - DNA, 376 bp, Oryza sativa
acctcttcaccgccggagggctaacctggagggtgaactgctacccgcgcggcgacaaggcagacaacaatggcgactacatctcgctctacctcgagctgatcagcaagtccaagaacatcaaggccatcttcgacgccttcatggtggatgaacacggcaacccgtccgatggatcgaacaggttagtgcaggtctacccacccgcgggctatcccgcgtggggatggccacgattcgtgaagcgaagcaatttgtcatcggtgttcgtggtggatggcaaggtcaggatcatgtgcgtcgtcgtcgtcctgcgtgacgacgacggagacggcgacggcaaccgtgtgccgctgccgtcgccgggggtcaccgg

SEQ ID NO: 38057 - DNA, 803 bp, Oryza sativa
ctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtat

SEQ ID NO: 38058 - DNA, 1150 bp, Oryza sativa
catgctctcagtgatgcagtgcactgggccttaccttgtcagttacgtcagttatttgtaacaatcttactgttttgtgaggtgacaaatccacaaaggctttttacagaacatgcccagcatatgagtgaagattttagatacagaacaaatcaaaatctatcacaaagtaatagttcatttgcagactcttttgttggcaatgccctattatttgaattggataaattattgagaaatgctggatattctttatcacactttaatttgccacttccagatgatattggtagtgcatctgcagataatagattattactagatgaactcagctatgatattaccagcattgcatctacatctgctaatgacatcaatagtctgaatacaaaccagaaggaaatattcaattctatttctaactcagtcataaataatgagggaagaacattctttgtgtatggacatggaggaactggaaaaactttcttatggacaactttattaaactttgtgagaactcaagggaaaattgcattagctgttgcataatcaggaattgcagccctcctacttccaggaggtagaacacctcattcccgcttcaaaatccctttggacatacgtgagaattctatgtgcagtataaagaagaacacacacttagcagaacttattcaacaaacatctcttattgtttgggatgaagcacctgtgaatcacaagtattgttttgaagcattagatcacacacttagatatatattatcggacattcgacctaatgcacagcataggcaatttggtggaataactgttgcatttggtggagattttcggcaaacacttcctgttattcagaatgcaacaaggcaccaaattctgcgagcttctattgttaattcatacttatggcatcaatgtgtagttcttcaactgactgaaaatatgagacttagctcacaaaacctttcaccatccgataaagaagaactacgggtatttgcagattgggttttaagagtaggaaatggtacagagcctcatatttcaatagaaaatgaaaccaatggtactttcatagagataccccaatctcttttgttgccctcagattccagaaatcttgatagcttgatgggctgcagga

SEQ ID NO: 38059 - DNA, 8364 bp, Oryza sativa
attcctgcagccctgcatcaaatgaacattgcacgcaaaatgtagtatatcatgagatttttcaccgtttcaacaatgatatgaattagttaccaaggtattttgtaaacaaattatctcttatatgcaatgtatgttttctgatattgtctactagctaaccttagacctcttatttcaggaacatttccatagatgggatcagcaacaaaactcaaacagataaatttgggacagcaaaacctcaaagttttcggacgacttattagactatgggatgctaaaaacatggcctcagccagtacaccaacaatattcaacatcgatggggtaattcttgatgaagaggtatactatcctacaccaaaaaatgatttatcctatgcttaacttccaatctaaatattactgataaaacgatgcagttttagacttataccagttctaatcttgcagggcactatggtgcagtttactattccaaagaaacttgaaaatgaatttcgtccatcactaactctaggttgtgtctacatgtttgttgatgtcaatactgttgacattaaaaacaaaaaatatatttaccaccaccaaaaatacatgttgcagtttaagtccagcacaaaggttcatcacctagaatcaagaggttcatccatcccaaactatggttttgaattctgcccatttgatcagataccatctaaaagcggaatatcaaaaccattgataggtaatacttgcattttctatcttcttttatttaattattatacaactaatctcgaacattttgcctctagatctgataggagttatcagccatgttgggccatatgattatgctggcaaaacatcatccaagaaaaacagaaagctcaaaatccgtagcaaagagtatgtatcacatatgcattatatttttatgttccaaatgtatatgacacagtagtttataccttttgtttcaccaatttgtagtgaacaagaacaagaaatagtcctctggggtgaatatggagggtcatttgatgaagcttttgttctacagaaatctacagaccacaaaatagtagtagctatacttgctggacttacagcagggacttatttaggtcagtccctcaaataactttttaataccccctctcataaacaacactactcacttatgtgctacaattttaaaaggcaaaacagaggctacatcaagttcagcaacacaaatatattttgactccgatataacagagattgctgaatatcaaagcaggtaacttatatagcttattgtcatactgattttaatttatatttgcttcaaaaatgcatcaatcttccttcaagctaccaatgggatattccaactctccaacaacaaatgccacgagttgaacatttaactccacttcaagcggctggtaagctatacaaacttgaagaaatatcaagactgcccatttctgctttcgaggtacctcattcacactacatcactaaataagttgctaatctaattaaataatcatttcaatatttcttacacactagggagggaattcatacagttgcattgcaaaggtatcagcgatagtaccatatacaaattggtactacaaaatatgcaaatcatgtactgcatcatacaatagcaactccgacactccaagatgtcaatgtcagcattccatgccaaaaccaatgtatgtgacatatctataatactaatttttcttattaattaattcgtcttacatttctataaacaaatctaatatactcaaacaaactttcaggtacaaacttcctttaacaattaaagatgaatcaggaactttggacgcagtagcattctacaatgtggctgaggatttggttgaggtaaatgctactcaagctacccagaacttgaaaattgatgcaacagaacatgccatagctcttgatatagccattgggaaaacaagattgtttcacattgccatgaatacaaagtactcttcacacttcactatcaattatgtcctcaagaagagttatcccgttgaaaatgaaaatacaagtttgatactacctactctggaaaatacaaaggtagcaaaggtatacaaatgtttgtccttaccatatcttctaccaaccatctataatctaaaaataacttttttcaggaatcagccaccaaacaacttgcaacagatgaagggctaaccaccatggaacattgcaggttaaccaacatatgccttttttacttattatattctgcttaacatttctatatttatgactacaactaatagcagcaaagaagaccaacatcccactacgccaccatccctacaacctccagaaacaactctagacaacaatacagtaaaccaaattataccttcagcaaagagagctcttcaatttgaaaaggagttacacattgatcaaccaaggtactgcactgatacaagttctttttccagaatatacaaactattcttcaactaaattcctttcatatatgcatcagcccagcaattgcaaacactattcaggttgcaacaaatcaactttatcatccccaacaagtagatctcagcaaggaaaaacaaccgtcaacagaattttctccaggacaaaattctaagtgccataaaaaagtgtacgtgcacaccttaagtttcagcctataaacatatatatgtgtgtgtcgcgcgcgtgcatatatatatgtatgtatgtatgtatgttttgctactaatttgactgctaaattcagaacggaaacctccaccaatggagaggaaaaccagctgcagcagccaaagatagctgatcaacagccatcgggtcacaaggaacaggtacaactcttcaaatccttcacaattctcctacaacatggccttttatcagcaacatatatagattttcttaaaaaaattagacctgcaccaaatctgtcaccatcactgctaacgatttccttaagaaatttaaacctgcaccaaatctatcaccatcattgctaacttatctttgcaaccattacttgcaagtttactggcaaaaccaaccaaatctgaaatatggcatttatatctattccatattttatcctcaataataaaagactcaagatatgattcttaatcatatctgattctgcaataaatgagaaaacaaaattagtatccttattatcaccactgaaatactataagaatcacccacaacaccacaacaacatgtgcactgctcaatttctcataccacagtccttccttcacaaaatttcttctgcaaacacaacgtccattgccaacacagatggaccaacaaccagaaaaaaataggttagctctcactatccaggttcagctatagcttcctaattacatagttttcaagcttatattttatatttaacatgcttcatgcatttcagtgctctgtacattgtatatgcctatctatacatcatcaaacgcattactcttcttcaggaaccatgaggcgcaactcatccacaccaactacctgcaagcagtttccaagattactgcatccaaatcaatagctatttatatcactctccaagggaaatcatccaccgacgacctctccaagctgcagccaactcaagctcatgttgtgaattacatgaaaaataaacttcctcacatgcatatcattctcgatggagaaaatgtcacaaacaatgagatttagaccttacagtttcctactgtttccagctcatagtattactacctacctacagtttgctgtaatcaaataaacaaaacttaattttatatttgcatgtgtttcactcaacttatatttatcctctggtgaagatcttggtgttcctaacaatattctgcttgcaatgtttccagtaaatctgaatggtgttgtcattgtgactataaatttccaactccctggactcgaaatgagttttttgtgcttggcacttttagcaattgatgatgcaaatatcatctttaattgatcagatagcagaactgcttacttttgaaattgtatactatactaaactatattcctgtttggttaggtagcagaactactcacttatatctcacttattcatgtttattcatacttacatgcatattcatcctttctaatgtgcccgccacaacgcgcggggtttcaactagttacagataaagacgactccattatttttaatcgatccagcacgagagtgtgcttttttcattaaataaagtgggagaaaaatgcaacccctaagagcaaagaaaaggcaaaagccaagaaaaactgtacactatacaaggtgcggaacaagctcactaaggcacttagcgcccgccaaaccccacatgtcgacttcttcctttattctcgcgagaagatacgaagttgtggcctccttgtactcatagatccgctggtttcattcctttcatatttcccaaacgatgaggaggatcatggtacgggatcccttcttgggaatgccagccaaagtggctggcacttcccaccattcattgaccgactgagtagtctcccagtgtcaaggctcaagctgatgattggccacccaatccgtccttttagtgtatctgcacctagtgacgaggtgcaaggccgtttcgtcctctccccgacaaagtgggcaccgtccgttgttctatcatcccctggtcgcaagtcggtcagaggtccagactttattcaggatgatgaaccaggcgtgtagtttgcattttcctggcgcccagaccctccagatcaatgaatcaaaggttgtgtcgagcacgccaacgcattgtgtttataggccgacgaagccaagtactagtcatggggtgtgaacttccatgagatttggtcagactcttcctcgtctagctacacaccacggactgcggtccataaaggccacaagctgctccacgagggccactgtgatatgtgggtttgtctccaaggctaaatctccgacccagacattattctcctttccttggtgtagggactctctcctcttcttagaaattgcgtagactaggggtacgaggaggtctttgggtcttcgcccttccatccatgcttgcatgtatactttaagagcattgctccagtccagcatattgtacctcgaggtaccggtaccttgaggtaccaatttaaatccggccattcattcacggagggtaagattgaaaatctcacgctaagcagctcgtgatgctccttctctttgactgagtgactgtgtgaacgaagactccaagagcaactgagcaagtccaaaccaagagcaagggcgtggtgggagcgggacgaggggtggtcggcgccggtggtgccgggggcgtcggcggcggggtgttggacggcggcgcgttgggtgccggcggtgtctgcatggtggcgaggtaacgaggagcaggaggggtggtcggcgccggtggtgttgaacggcggcgcctgcatcggaggctgctacgcggcggcggaggcgacgaggacctacgtcggtcgcctatgtgctcgaatccggcagcgagattaggggaagggccgcggtaggcgtatgtcaccagcgagcttgggggaagtgatgcacggaggctcgtcggccccctccacctccactccggctagcctatccatccctggtgagagccatcgatcgatgcaggcatgcagcatcttttggagagagaaaagacaggaggaagatgaagaagatacacgtgaaattacttaactacccttacttctttagcacctctctatgctatgtaaaatcacgtggacagtactactaggtacaactctttctcacccgttggatcaaacgaaatcaatggcttaaattgcatgtacagtaaaaattctcatactttaatgtgatcatgcatgtacggtgtgtaacaaacaacacaatcaatcgaacacataaaaaaaacatccatttaaaaacacatcatgaatgaattaagccgattgaaattgggacaaatatatatgattaatcattaaatagactgaaaatcagccgtgtaaatctgttgctaatattattatagcatatatcatctcggggtgcatgcatgtctgaacttctcatgacgtctaatgctcgccggcatctctcctgctccggcgagtctcctcagctgcggcggcggccggatcagttgtctcgacgacgaacggtggcggcggctactcgacgcgctcatacagattcttgaggctctggagattttgctcgatgttgctgatgtacttcttcccctccgagcgctccaccgcttgctgcctcacgcgcagtttaacgccgacgtagatgccggccgcgaagctcccgcagatgctgtaccccatcttcgcgaagttcgacatcgacatggccggcgcacgtacgccgccgctcgccggcggtagggttgtcgaacgggctgaatctccggcgaggtggctcgcctgcatgcgtgcgtaactgcgtatgcaagtcgcgtcgtgtcgcgcgtggagatcgatcgatcgcctcggaatatgtacacgtgagtacgttcgatcgatagagtttgtgtcggaattatccaagttgaatttgggtccaagagaccagagcctgtttgtgtctagaattaagccagggttttgcccaaattaaatgaaattaattctgggctggaaaccggcggctaggattgtggctagaatcgaatattgatggcctgatgtaatacgctctcagttcaagaacattgccaaattttggcaagattcagtgttaccgaattttgatagttttttactatgtgtttagtttgatgcctttttaaattttgatagtattgagaaaacttttgaaattttggtaggatagcattttactccaattagtatggttaaaagttccaattaaaatttagaatagtttgatggtaaagaggaaaggagagagaagataagactaggggtgaaaataatcgtagaaattcctgactgaccgacacttgttctcgattttgactggctgagctatgtgaaaattgttgccaacaaaattaaaaatagaaatagtagaaaaatatagaaatgcaaatgaaaactattttattgttatatcgagtgtttccgaatttttataccataattgtatgaaaattaccatctattaccctatatttgtaaatacgtcaacatctatgacccatttttttttatttgactgatacccatcaactccatacccaaatcaagtgcatggctaaaaaaagagacaattataatttacattgtataatcttgaatttattatattttatatagctatgtaaagttaaatgtgtgatttcgccgttcaatgtttttgatatttattatcgttttccaacacgtcgtttccggtttttccaatatttttcgataccgttttcattttattctttactgttttcgattccgttccgaaagaaatataactatgaaagtggtttccatattttcggacctttttcatccttagataagaaaacacaagtggttttatgtgtgagttggggtagtggcgttggtaggttggaagtggtgaatccgtggtggtaagcagggttcaaattttcggaacgaaatttctaaaatttcggttctattggatccgcgatacaatattatttcggccaaaaaaatatttttaaaatttggtaataatttgttcaaatttaacaaaatttatcaaaatttccaaaattcgaaaactaaagattgaactggtgaacaggttgaagactaaagattcgatatatattgcaccctccgaaaaaaatgtcgaaaactaaagattgaactggtgaacaggttgaagacgatgaccgcgacagcaagaacgcgacgcagccgaccacaaatcgagctccacttgtgcacagagagagatggccaaaccgcgaacacgataagccatctgatcagtggctcgccgtcgccgctgctcctctccaactccaacctcgcatcactccatgcgcgagctcgagctcagctgagtggacgatggaatgaggctcgtggctgccaaaccttgctgcctcttccgaatctcaagcgtcgccgccgttgcagccggtcgccgccggccatggcgagccgcggcggcgagcggcaatgcgcacgccgaagccgaaggcgatgaggacggccaatcgctgtcggcgagggcgaggggcaggcgggcgcggctgtcggcgaggcggcgggagaggatcgtggtggtggagggcggcggcgttgggggcatcggcgagttcctgcgtcagcccgccggcgtggagtcgctgctgaaca

SEQ ID NO: 38060 - DNA, 18298 bp, Oryza sativa
tttgatttgatcgttttgttggtggcagtttgagggttcaggctcagttgagcagcagaatgagctcttttcaggtaaaaaaattcaggttcttcggttagctgattggctcgcagttcttgaaaattctttgcagttttgagtggagacatctgatttatctgtgcaattagtagattggtcatcaattcatcgttgtcaatcatctgttttgctaaccattgtaaccatgcgaatcattactgcttagtctgaactctgaactctgaacttcctttccggggcaacaaaataaaatgtgtgtctgatttagaggtttgatgtttgcagcttttatgagcaaccatataacttggaaagacgatggtgaggaaccatgcttggacattgatgtcaatttggaggtcactctggaggtatattacatgagaagatacagcatctggatgaacagagcacctcaaccgttttgctcactgaattactgattctacggaactaagagatgatctgatttttttttaacgtacactgaagttcttcatatgtggattacaggtttacacgaagccattcagcatgcttccattgtcagcagtggagacaccaggcaacctgtaaggccctacattaatcactgaagtttctgaaagttcagtagtaaaaaaaaaaggcaaaatatctcaaagaaattacacacaagtgctcaccagatgctgatgagaactaaattccaatccaatcaccccatcaagatgtttaagcacatcttttacactgaaactgaatcactgttcagtattaccagtttcattttggtttaacattagaactgaacatttggcaggctgatgcaaggcctcctggacaggctcgtgcccttgctgggggagcagctgctgagagactaccattcgtgggttcagcttcagcagcagcagcctgaaatttcctcattagaaactgctgaaatcgatgcttcatagtcggatggcttcatcgaattcagagatttttagcgagacgaaagaattctgagaaaatatgttggatggtttggagaaaaattggttgccgatgtaactaaaaattgcagtttgtaatatagttccattatgactgcttcagtgaaactcaggcatcaaactgcacagcttacaatctctgttttcttcagcactagttctcgtaaaaaaagacgaactcaagaattaggaaaagggacattgcactgagaacttttggtgaagtaacaaagatctgaaaatgaataatcttttaggaatttcagcttgcgtgatcatatatcacagagagagaaatgaaaaggtgaagtaacaagcatctgaaaacgaataatctttcaacaattttttgatcgcactacatgatcatacatcggagaagagatgaaaaggtgaagtaacaaacatctgaatctgaaaaccaataatctttcaagaattttggattcattgatcatacatcggagataaaaaaaaccacaaaaaagttaacaaataatctttcaacaattatgaaaccaaaaagaaattccgttgccgggactcgaacccgggtctctcgggtgagagccgagtatcctaaccagctagactacaacggattgctgatggaagtacatatacaaattatataaatattattattacaaaatgatacagagggatattattgccgttcgattcgaggctacccgctaccagcatgcacggtgtggtgtccaaggccccaaagctagaatgacgtgcacacgagtacaaaagagagatatagctgaatgattgatgtgtttgaaaattagcataaaccaaaactgcttgcaattgatgagtagactcatcagtagagtacttatttatttgtgcatgacatcttcaggataggtagatgccatcatttcctgacctcacccacatctgtagttgcatcaatcttggacatgtctcaactagtaaaaaagaaacggtaactttaattgcaactctgcttgaaacttgttaacactatatatgtttttcaaacaaaatgtgaaatacatgaacttacaagtatgattacacagagacatcaaagacacacgtacaccacgcgagtgagtcccctcccttaacacaagcttaaaaagaaggaaaaaacatggcaaatatcggactgaacaatatatatggttttgtactatacgtagcatattttgaaggggtttttcggctcaaaattatgactataatgttcacgtgagcgctcggtgagaggagtccattacttttgtttatgatgaaacgggaattccattattaatttggttctttcactttctatctagctagttttaaaaaatctcttcaaaaaaaagttttaaaaaaatctcttgcagcccttgcctaaatctcttgtactatcttcctccggatagagtggaaaataggaagaaaaaagacatcagtcattctaatgaaagcccttctgctctttaacatgaaagcccttctgctctttaacacaagttcttgattctatagactttgatggtacaactcattatggctagatttgttttcatatatgttcagttcatgcatttatatatgtgcttcataatccttggacttatttacatgcatgagattttgaccccatatatatactccaagctagcatatgaaaagggtaattgattaattcacattcgaccctgccaaagttcacatatgttcatgatagctagtatcttcatatagaatgcttctgtcatcccccagaatgaattgtaagaaagttataccgcaaaattaaacattccactcaaaaattttcaaattcaaactttcgcgccatgggtcgatttcgcgcctctttttctcctttcttcctctgttaatttccactacaaaatcacaccggattgcaaagagaaacaactgcaaatttccatttcatgacaacatccatctcatatataacaacagttccttttcaagaaccgattattacacttctcttacacaaggatcatacacaaggtgcatgaccaagtacagactaagttaatttattccatggctagagtactctagactctagatcatgcatgtcttccttgatatggctagttacaccattaggacagcacaacacaaccacaaaagtgcatagtacacatgctacatagaaggtgtaactagctagctaagaagttgtagatatggtcactctccttgctgaacaatggcgatcaaagcggcgacctcttcgatgtccatggagaggaggcggtcagccgcagccatgacgtcctcgtctgtggtggtgtcaggctcgttgcagtagtaaggatcggcagcatggttggccggcgccggcgccatgggcggtgcaggtgcggcgaacacggggacggcggcggcggcgacgggcggcggcggcggagggagcgggcggaacaggacggagccgacgtcgtgggcgtacctctcggcgatggccctgacgtggcccggcgtgagcgcgtggcggcggcggtcgtcgatgcggaggcgcggcgcgtgcgggaagttgaaggcgcggttccccggcggcgcgccgccgtggaagcagtagagcgcggcgtcgtaggcgagcgccgccgccgccggggacgggaacgtgccgatccacagcctcgcggccgcgcggtggccccgcggcacgcggatctccgccgcccacctgccccacagccggcgccgcacccccctcagccccaggttcttcggcgcgtgcgccgccggcggcaccatggcgaggtgatcggcgacgcgaggaggaagacgatgacgatgacgaggaggagatggtgttgggggagaggggatcggaggcgggttttaaaggcggggaggggtggacacgtggcggcatgcacgcatgcaggagtaacgtgggagaaatgccacgtgtccatgcaacctggcgcatctgtttgcaaaattgcaagtgtttttttttaattttctttcattttatttatttgtttattattatatagggatatttatcttgaaaccggttgacacctactcctctagtgatgagccggtccgtgcatacgtagttctatctctagtgtctcgtgcacagagaaagtagctacatttatgtttctagccatataactataggttgaatttatttatgggttcactccatcttttagcttgctacactgcaaaaaatttagaggagtaactaacagtatggcttactttaccaccaaacgaaagtgccacaccatctactaatctctatccatgtcagtccggctgcaatctgctctgggtctgcaactctctcctcgcgctttatccattgggtattcatattgttgctagatgtggcaattgatctctgggtctgaaactggatgaaggatgaaggatggtggtcctatcttgtcagattgtaccatcgatgtttttattttaaagaagtatagatatagtgtttttatgttgtataaataaggtcttgtctagatcccacttcaaaattttttaccctgtcactcgaacgtttgaacacttgcatgaaggctgtgtttagttcagcgcaaagtttggattttggttgaaattggagatgatgtgactgaaaagttatgtgtatatgacaggttgatatgatggaaaaggactgaagtttggatccaaactttagatctaaacacatccgaagtattaaatataggttaaaaaaataactaattatacagcttgcggccagacgaatcttttaagcctaattgctccatgatttaacaatgtggtgctacagtaaacatttgctaatgacagattaattaggcttaataaattcgtttcacggtttactaaccaattctataattagttttttattagtgcccaccctatacgatattctatataatatctgatgtgacacgttaaaattttaaaccctggatatacacccccttaacgcgaggggagtatagcaccgagggcggcgagggacggatgcacggagcgtacgtacgtgcgtgcgtgtgtcacacgcgcgcgcggcgacggtgcggacgtgagcgatcgaggctgggccgcgaccgctctatacctgcacaaaagtacaaattagcatccatctgactttgcaagagtccatgccagtgtgtaggtagacactgatcaggccggcttaattaattaagtaaaacccacaaatacgacacactataatctctaattatattactctctccggttccattgctcttaatgttttgaataaggttgtattcaaacttttaaaatttcgactgaaagcactagaataacatatatatagtccctcttagtctttactattagagtaaatacttatttgtatttatttattgtatatgtcataatagacaatatagttaaagatatacttcaaaaattatgtcgttctccaaaaaattaagaatatcgaatcggatgaagggagtagtactgtctttgctcgcgtttgaagatatgaggattaattatgtgcttgcagatatgtagtatacacgtacgtataaccccaacgctccgtattgacgcctactaccgcgtcactcccatcgatcggcgcagtttgactcttgtaccagagtatgtatatcgatttccattattatcgttggtttatcatcatacttgttagatgataagaatagttagctagatagattggttcttatcttcagtttgttgtaactaacagagagataggataagatctctcatcctttgtatgtaccacgctaggggttattcctagcctatataacatgcaggcgtacctggaggaagggtatcgcttccatcacatggtatcagagccttccaccctccaccaatcaatctttcaatctaatctcccaactcccgacgcaaatggcgtcttcttcctccaacccatctgctctcaatgggcagacagtttctgagaagctcaccaagagcaacttcgtgctgtggaaggcgcaagttcttgccgcgctgcgcggcgcacagatggccggcttcctcgacgggagcaatcaggcaccggctgcaacgatcatcatcaccaaggacgatggcaagaccaccgagaaggtggcaaatccggcgctggtgcaatggaaggcgcaggaacagcaggttctcagctacctgctgtcgtctctgtcgcgtgaggtgctcactcaggtggcaacactcacaacggcggcagatggaggcaattgagagcctcttcgcatctcaatctcgcgcccgcatcctcaacactcgcatggcgctctccaccaccgtgaaaggaaaccggagcatggcggagtatgtcggtaagatgaaatctcttgcggatgacatggcttctgcaggaaaaccagttgatgatgaggagctcatctcctacattcttgccgggctggatttcgactacaactcggtggtctcgtcagtcacgggacgcaccggtccaatctctgtgagcgatgtctatgcgctcctggttggctttgagtcgcggctggaacttctccagaacgcggccaatccttctgccaacaccgcgtcgcgaggaggacgaggcggaggcggtcgtgatggcagagggcgcggcggcggcaaccctggacgtggcggcagcttcgggcgcggtcgtaatgacggcaagcccaagccgacgtgccaactctgcggcaagatcggccacatcgtcgccaagtgctggaagaggtttgatccctctttcaccggtgaagagaagaacgccaacactgctgcagtgaactcctacggcatcgacacgaactggtacatcgacagcggcgccaccgaccacatcactggagagatggagaagctcatggtgaaggacaaatacaccggcaatgatcaagtccacaatgctagtggcgcaggtatgaatatcgatcatgttggtcatactgcaattcgtacccctactcgtgatctaacgttgaaaaacgtcctccatgttcctgatgcatgcaaaagccttgtttctgcccatcgctttactcgtgacaataaaacatttgttgaacttcatcctttcttctttttggttaaggatcaggtaacgaggatgccactccttcgaggcaggtgtagatccggcctctatcctctgccaacagacaagctccaaaccatctccaacaagcaggcttttggtgttgtcaagccctctcttttccggtggcacagtagattagggcacccttctttttctgttgtcaatcgcgtcattagccaaaataatctcccagttgttagggattctagtcaagagtttgtgtgtgatgcttgccagaaaggcaagagccatcagctaccctaccctaagtccagtagtgtttctattgaacctttgcaacttgtgttttccgatgtatggggtcctgctataaactctgttggcaataaagtttattatgttagtttcatcgatgactttagcaaattcacttggatctatctccttaaacacaaatctgaggtttttgccaagtttcaggattttcaaaaccttgttgaacgcttgacgaatagaaaaatcaaagctgtgcagacggattggggcggggaataccaacgtcttaattccttctttcagcgcattgggattgaacactacgttgcctgtccctatgcgcatcagcagaacggttctgccgagcgcaaacaccgtcacatcgttgaggtcgggctctcgttgttagctcatgcctccatgcctctcaaattctgggatgaggccttcaccaccgctgcttacctcataaacaggaccccaaccaaagtgataaactttgagacccctctacaacgtctgtttaacctgcccccagattattctctgcttcgcaccttcggctgtgcctgctggccgaatctgcgtccctacaacgcccgcaaattagctttccgttctaaacagtgtgcttttctgggttatagcacgcttcacaaaggttttaagtgcctagacatctctacagggcgtgtgtatatttcccgtgatgttgtctttgacgagcaaatctatccctttgaaaaacttcatcccaacgccggtgctcgcctccgggctgagatcaatctcctcccggcgcatcttcttccgctgcttgatcacgggggtgtacagatgcatgatcaaccgctgattgatgattctaatcctgctaatccaattattgagaatagtgcaggcagcagtgcaggcaatggagcaaaatcaggggcgcagcacgggcatgatttcatgcagagttccggcgggcaacctaccggcggccatcatgactctctgacgcacagtaccatgcatggcacggagaaccaggcggaccaggagaactcggcgtcatctcgatctgcagaaccggtcacgccgcgacacgcagcgagtccctcggccgcgccacacgcggcaaccgcgccaatcgcgtcgtcacacgcggcagcctcgtctctgtcgggagacattgtgggaccgggttcacgtgggccatcgcaggaggatcaagacacgtcgcaggaggatcaagacacgtctgcatcagctcctgcttcttccacatcgcatgatgatgatagtgctcagtttgccgctcagccgactcgaccagtgaccagagcacagcgtggtatccacaaaccaaagaagtacacagatggcacagtaaggtatgcaggactcacacatacaggagaaccaggtaatctccaagaggctttaagtaatactaattggaagtcagctatggatagcgagtttgctgctttagtgagaaataaaacctggcacctagttccaccaaagcagggggtgaatgtaatagattgtaagtgggtctataagattaaaagaaaggcagatggaactatagatagatataaagctaggttagtagcaaagggttttaaacaacgttatggtattgcttatgaggataccttcagtcctgtagttaaggctgctactattagacttgttctgtcactggctgtgtcacagggatggagtcttcgacagcttgatgtacagaatgccttcttgcatggctatcttgaagaagatgtgtacatgaggcagccaccaagatacgaggagaaaaagatgccacactatctctgtaagttggataaggctctgtatggcttaaaacaggcacctagagcttggtactccaggttgagtaaaaggctacaagaacttggttttgtttcatctaaggctgatacatctttgttcttctataataagaagggacttgttatgtttctgcttgtatatgttgatgatattatagttgctagctcttctggtcaagcagttacagttttactcaaggaacttgagaaagattttgctctgaaagatcttggggatctgcactactttctgggaattgaagtaaagaaaactgagaaaggtctgctgttgacacaggaaaggtatgcaggtgatattattaagagaactggaatgagtaattgtaagcctgtgagtactcctctctgtgtgtctgaaaaactgtggttaaatgatggtgaatttttgggtgcaaatgatgccagtcagtacaggagtatcgttggggctctacagtacttaactcttacaagaccagacatatctttctcagttaataaagtgtgtcagttcttacagaatcctactattgtacattgggcagcagtaaagagaatacttagatatctgcaaggtactcttggtctaggattaaagattgacaaatccttttcttatattgttagtgctttctctgatgcagactgggcaggatgtctagatgacaggagatctactggaggttttgcagtatttctgggatcaaatttgatatcctggagtgccaggaagcaagcttctgtatcacgctctagtactgaagccgaatataaagccttggctaatgcaactgctgaggtaatgtgggttcgtaaattgctagaagagattggtttgttgcatccaggaccttctcaattatggtgtgataatattggagctacctatttgtcagcaaatcctgtgtttcatgctagaacaaaacacatagaagtggattaccattttgtcagagaacaggtggcgcagaaaatgttggaaattcggtttgttccgtcacaagatcaaattgctgatggatttacaaagcctcttcctgtgagacaattacaattgttctgtaacaatctcaatcttggagagttgagattgagggggagtgttagatgataagaatagttagctagatagattggttcttatcttcagtttgttgtaactaacagagagataggataagatctctcatcctttgtatgtaccacgctaggggttattcctagcctatataacatgcaggcgtacctggaggaagggtatcgcttccatcacaatactaaatatcttgaagattggttacttcatactctatcaatgtatcttctggacatgtatatcatcttgaggatattattagttattacctattcttttttcttagggtatttaatgagcatccatctattatgcaattttatgggtttgcctatgttatatctccacatgtgcaatgttaggtacagggcccctttatttatttatttattgggaaaatttcagattactacatatttaatgattaaactatcaacttgctgcaatataaatgacatattttagatagctacgataatacaaaataaaattatcataaaactgtaactctccagaccctcttgtcacttaaacacctggcttatatgccatacaaactctactagatggaagcgaaatgatgagaagtgtcacattgcaagtaggttatgtatgactcgtgggcctcgtgtgtcagtaataagagggttctaacgaaattgtagatttattttttataatttaatccactgtcatcgtagctaattgaaatatattgttaatgttataacaagtattcctactttggccatgaaatttatcgtccttttcttttgaatctacatgcattgactccttgttttggttgtggcatttaggacctttctattatggttgaaatgtattttcctggagaattttgactagccataagaaacatttttagtgcgtgtccattgcacgagtgcaacatgacgcattgctgcaccatgtgtattgttgagcgccgctccaccgcctccctttcctgcatgacaacacctttggcctccctactactgatgttgttggttgcaaactattactccttataaatcaatcggttggtgaaagatggatgttcatactaaacatagtaccgcaaaatgccatcaaatatatgtggttcttagcacatctcatcgatcggtgcaagaagcacccaaagataaaaaagctttacctaagcacctgaatactgatttgcgttggccgctgagtcctcgtcacgaagaacatggcggcatgccgcgtaaactttcagatgaacttgatagagttgaagagtagcgtggtgcatgttccggcttccgtttctacgtatactcgaaactcgaaaccgcaaacaaataggcaagaacgttgagatttccgcaggaatattgcaaatctttcatccagggtttaaaggatgatgttgaaaccagagataccgtctaatttcagttcaaccgcaaacggatctcaagatggtttcatttttgggagaactacggctaggcagcagcatgttggaaaggctgtcatgcaactaacggccaaagcattttggcccgcccataagcacaacttatattctactttccgaagcacattagagtattacaaagtgctccaggataccgtctcaacaaggaaaaagaaaaagaatgaatgaacgaaagaaaggggtaaaaaaacaccttcacactgaaagaaagggaaaaaaacacctgcacactggtattatagactttactgtggaagaagcaatcgaccattcaaaaaatgactatgcttccggtgtgcacactccacacagatatggtacggagtaagactgatttgcattcttacatcaaggctggccatcacacgatgtttcccatctccaacttccttagcaagatcactgcatgcaatactgtcagctgctcctgatagaagcacatccacatggatcaaagttctcaccttgtttggaaaatgaaaagggtatcagctcttaacactgttctgcaactcactgagagctgccattcgcagggcgtgcgaacttgtcggtactccagcagggccaccgggaggatccacctttgtttgctcattattgtcttgaaagtcatgtgaaagttgcagctttgataaaagcttcacaatattacatgacaacaactaattttaatgacatccagtcagtcgagtagtcagagtcgaaccaagcatgcaatggtacccagtctaccactccacaatgtgatgatgcacatggattcattgtttcatcaagggccctctctttgaatcaagcacatcagaatggggtaacttgaaaatgctaagctacagataacatgataacatataacaggattccatgagctctacgagtctggcagaaagtaacatgcatgcctatttgccgtacacatgtaaaagcaaacaatagggacttatagaacttctgagcactgggataatcatagtttttcaattaatttctacattggctgtaggagtcaatccattgacaacgatggaaactaagctaaggtccatggttcaaatgaacctgattaacctcagacaatggttttataggtctcctaaccaatataccaacattgtgggaggacagaagggtgttatcctctttttacaaacatataaaaattttgtggcagaaacctagatcaagttcattttttatttattccaaaggctgataccgttgatgaaatagtgatatactgacacagaggtatcaattccatggtaccgagctaacttgtttcttagacccaattgctacttcaaacaatagcaccagagaggctctccaaatcaattttcagtacaaaaagaaaatgtggagagaaacttgtgaagaggatgccacgcaaacatatagtgagaaactgagaatctaccttccaagatcctctcgaaaatttttaaaacgggtaaaaaagatataggcatcagcaagaaccaacttatctgagataccaaacccttacgttgaaacaaagaccacaaacacaattgacaaaactgagaccgcaatgaacagtctaatagtacttcatagcacacaggtagcaatctaagacacagatagctaattgaaatttatatcataaattgccattttcccagagtaccagtaaccaagacaaagcaaccaagcttcagaagtatatgacaaattcacaagggatgttcttaaccaaaatctgtagcaataaagaaatccatgactccagttgccactccaaaacgtttaccattaggacgacgactcaactaaggtctcaaggggatacagcagcgactactgacacagatagaccccagacattcagactgaaccttgacgacgacgctggaccttcttgaccctcataactgttctaggactcactgtaacagtaaggacatgatatatcaagccatgcacaagagatgatgaagacaagcaaataaacgaaactgttgatagaaaacataagatatgcaatttatattgaattgttctaaagaaaggcatggcatataatgatgatcatactggaggttctaattatgcacctgattgtcctgatcagcagatgactcattagcattgtttgtctgaaatggcttttcagcctcgcaacttggacggttacattttgtgcggaatggatagtttatgttattgcacttctcgcacttccaactaccttctggcatctttggttctgccatgaaatattagatgtaaagattatatagaattaaaaaggacaaagccattacaagaactagtgctaagtgacacgcataacttatgcaatgtggaaataagatggcattgatctcagaattttactggtttcgaggtactaaaggtacactaaaaaattttacaaacaaggcaccgcatgtatgcatagttagtgttaaacttacttggacctcttgcaccatcaggtttggacccctgcataagagttgacacacaagctatcagcaaagtaagcatgatggtttaactctaggaaaaacaagagaagtcaaagcatgaggaacaatttcagaagatagatgaaagtgaaattacgaagagaacagctcaaactattttagaatactttgacacgctacagacttcccagaacacagttaatatagcagtactgaaaatcgccggtttgttactgcatgtcagctgtgacttgattaatggctaaggctgagtggacgatgtattgctaagtataggttccagatttgccaaatggagagaaatttagtacatcttgttttgaggagaaaacaatgacagttcacacgaaatgggcaacttaataccttaggtcctggtgcccaaacaatgggcaacttaatacatggcacaagcaaattgtgttgaattgcatggcatgaggttttaatgaacagttcagaccagttactatagcatcgaatataaacggctgtcacattgctaatcttgtggcaacaaggtcaactttaagcatgattacgatgttagtatattgcagtacaccttttagtaagcaaatcaaaaatatttattcattatcagaatttgcacataaactttgaccaattttagatttatagaaagaaagatatttcataatttagtagtagtaatacaataggtgggaacttgcacaagtacaagaagtggagaattgtacctggttttcaggtcttggtgtattgcactttctcatgttacagactgtccggaatgcaaagttaatgttgttgcaattagggcatttccaatcattatcacgcccagctcctaaaataaagttcataagaaaaataaaccaatggacaacaaaatcaatgaacagtcaaaattcatttgaaaatatatacctgcaggcttcttctgggatccttcctcggaatatgaaccagccctcgcgcccttcatcaaagaattgtataaatgagagttgaaacatttcctatcgtgatttatcacactataatatcaaaggacacttaaaggaagcccttcgacagttagacccacagagcacagagtgaccactgacaacatcccacaatagtttgttatgcaagggaaaaacaattgaatcatgctaatatgcatgagcaaatactaataatccagaaaagtttaccattggaccaggaccagcaggtaagcccaagctatatctgtccatgggcatcccatacattccacctattttgaggacaggaaaatggataagagaaaaaatgtgaggaatagtctcacacgagtcaggacacatattcacaaagagttggtaactttttaatttttatctcgtatgcatttaattcataaactgcaacaaccacccaaaaaaaatatatggtaataactaatttgcctataaaagtttacatgctagagcgtagaagagtaaattagttcccaaagaaacatacttcgcatactagcatttctatcctgtagctatagaaaataaatgtcaggcaaaaggatatttcctgtaaaatctcattctggccacactaaggtttgcataaaaggacataaatggtctcaaaaattttgcccattgtatctagtaaatcaagtactcagcagttagtagagtctatattgttgtagcacccctacctggtcccatcatggatccagcagaatatggaggccctgccatatgcatcggcggcccataggggctccccattggcaggcggccaccatagccatatggatatccagaacccccagggaactgagcaataccataacgtggtaaagcaggtccgccatagagggaggtgccataagggggagcaccacccccgaggtacatggatggcggcgtccctgggctcatgtatccccctgacatggggaaatggggcggcggtgtctgcataggtttctgcatatccttctggagaggaggcaacagcacgactaggtaaatgcaaaaatcacgatgagcggaactaatcaaccacatgagcgcgcatcggtggcaatcacatgtaccgtatagtcggtgggcctggattggttgcaattgcgcatgttgcaggtggtgcggaaggcgaagttgacgttctggcagctggggcaaacccagtcgtcctcacgccgcccacctgtgagtcgtcatccataccaaaaatgaaattcccctcagatgcagcttaaacagtaaaggaaagccgcaggttaatcgccgcggcgaagcgacctaccgtcggtgcgggcacgctttccagcagattggctacggttgtcgacctgtaaacaaacaaacaccgcaagcgtgagcttttgcggcgagatcccatggctgatcgacaagcaacaggtccaaatccaacctaacctaattctacgcccacccactcccgcacgcaccatcccgcggcgacgggggtggattcccgcggcagcaatcggagccccccgaccaatccgcggcgacaaatagagcaaggcgaggaaagagacccgtgtacctgagaagacatggtggtgggggtggctgctgctgaaaccggcggcggggcaagcgacgcggcgacaaggcctgggctccttcggagcagggcggcgccggcgaaggcggacgaaggaggaggaggaatccggcggcggaagggggcggagcgccgcggttagggttttgctctttctctctcgatttttcggctttggaagaaagtggaaactgatttccacttctccacgacgacgcgtcctccgctgtatatgcccccgcgaaaacaattgggcccactaggtgggccctccacctcacctagcagagctggcaatctcttccgggttatggcccatctgtaaactcaccatgggcttactaagcctgtttggaattcgtataagtctactttgagtccctcagaagtggacttattcttttggaatttgatctaggatttccaaagttcattaataatacttattcattttatttttttactcacaaaaaaagaaaagttaccccctctgattataaatatttgaagcttagaagaagatttatcaatcgtttaaaattctgccaatctgtatatgtgtataagtttatgatattatgacagtacttttcaaggtaaatctattgttgccacttttttgtgcttttaaattagtcatttaaagaaatttcgatggtctgaattttgaaattttgatcacaatctcattccaggagttaaatatttatgaccggaacgagctttttttttaagaaaaaacaaaacaagttattcagttcagtatagctcagccaagagtgtgcatcgagctgaacaggtgacaacctttgacaacgaaaaagaaaaggaagaacatcatggacaatgcatgcatggcgatcaagatcatcgaacagttcgtgcatatgcacgcgtagctagtcgccttcttccccttgcctttttctgcattcatcagtcgtcgccgcccttgtgaacgatcacgagatctcctcctccctcctctcctttcccctcatgtcgaacacttgcacaccccccacactgctcactcgatcacgacgactatatatttcgatgcatacgaatcaaaccgaattatccaactgttccaatggcaatggattcggaggaggaggagacgtcttccatgtcgccgtggtcgtcgtcgttgttgtcggcggcggcgtcgtcgcagccgctgctgctgaacccggcgtacgcgcggagcaagtcggtgatccacgacgagctgcgcagcttccgggtgttcctgcagtggtgcgcgctggaccactcctcccgcgccgcgcgggccgcgtcgtacgcggcgttcctcgcgctggcgctcgccgtccccgccgccgtgtcgctctcgctgcgcgccgacgccggggcgtcccccgtgtccgcgtcggcgatcacgttcaaccgcgtcgcgcaggccccggcgacggggctggcggcgatctcgttcgccgcgctcgcg

SEQ ID NO: 38061 - DNA, 13544 bp, Oryza sativa
  unsure (1)..(13544): unsure at all n locations
cttcgccaccgtacgggtcgagccgccgctccccctccccggcgtcggcgtgccgtggcgcgcggtggcgctggtggccacggtggcgtcgtgggtgtaccgcacgggcgtgttcctcctggtgtgcgtgctgttccgcctcacgtgcgagctccagatcctccgcttcgaggggatctaccacatgttcgacgtcgaggcgcgcgccgccgccgccgagatcttcgccgagcaccgccgcatccgcacgcagcttctcgccaccagccaccgctacagggcattcatcctctcctgcctcgtcaccatcaccgtcagccagctcggcgccctcgtcgtcgccctctcctccaaggacggcaagagcttcgccaactccggcgacctcctggtaacaccacacagccactccgccgccgccgcaggcgtagcaatcacgacacgatgcttataccctcgccgtctcgcaggtcggctcgtcggtgcagctcagcggcttcttcatgtgcctcttcggcgcggcgaggatcacgcacagagcgcaaaggatcgtgtccatcgcgagccagtggcacatgagcatggaggccgtggcgcaccacgccaagtcggcgccattgccggcggcgcccagctcgtcggccagcgacgtggacgcgccgcaccaaccggagctcgggacgacgacgacggcggcgtgcgcctacagaagcagacacgccctcggtaacaccagatgaacccccactcgcgccattttttttctgagatttaaattcactcgctcgcgccattttttgtcgttgcagtgacgtacctgtgccacaacagcggcgggatcacactgttcgggttcacgctggacaggggattgctccacaccatcttcgccttcgagatgactctcgtgctatggattctaagcaaagtcctctcttaattaattattagctcgtgttaattgttaaaatttcctcaccagtttgcaagaacgcaattatgcaatgtgtcagtaaatgtttatgagtgtggtatgtttcagcaattggacgatgtacatataatcgtctactccctccgtttcatattataggtcgtttgacttcggtcaaaatcaaattatttcaaatttgatcaagtttgtatagaaaaagtaataatatttttaatccaagataaatatattatgaaaatatgttccattatcatttaattgatctaatttggtgttgtaaatattaatatatttatctataaatttaaattagtttgattttaaccaaagtcaaaacgacttataatctaaaacggagggagtatcattctgaacttctggtgtataaatgtaaaaaaaaagattcagatcatgtggttggattagtaatgtggcaattctgaaattgacaggttgaatttgctaattgaggtagtaagtccaggttagtcgtagctgagagagagagatggttgaatttgctatagttaggcagcaacagcaacggccacagccatggccatggccatgcggccagctagctcgacgccccatctctctctctctctctctctctctctctctctctctctctctctctctctctctctctctctctctccacgcgcgcgcgcgcggaagagagctctctcctgaatcagctctcctccccgcgatctctcctacttttcctctccggagaaagctacgtgcgccacccccaccaccccgccccgccgtcgtcgaggcgctggcgccggcgggctggacatggccggagcgccgtgcctcctgcgcgtgctagccgtctcctcctgcctctgcctctcgccgacgccgcgcgcctcctggcggcggcgccggcggaggaagccgacgcgctgctcaagctcaaggccggcatcgtggacggcggcggcgcgctggacacctgggccgccggcacgagcccctgcgatggcggcacctcggcgtgggccggcgtggtgtgcagcaagggcagcgtgctcggcctgcagctggagaaggagggcctgtccggcgagctcgacctcgccccgctcaagagcctcaccggcctccgcacgctcagcttcatggacaacgagttcgccggcgccatgcccgacgtgaagggcctcggcgggctccgcgccatcttcctgtccgggaacaagttctccggcgagatccccgccgacgcgttcgccgggatgggctggctcaagaaggtgtccctgtcgcggaacggcttcaccggcgccatcccggcctcgctcgccgccgtgccgaggctcctcgacctccagctcaacgacaacaagttcacgggcaagatccccgacttcccccagaaggatctcaaggtgttcgacgtctccaacaacgagctggatggggagatcccggcgagcctcaaatcaatcgatccacagatgttcgagggcaacaagaagctctgcggcgcgccagtcgacgcgaaatgcgaggcgccatccccagcggcaacgacgtcgccgccggcggcgacatccggcaagatcgggacctcgccgtctcccacggccgccgccgagacaaccacaacgggcacagtgccagccgaggaggggacgcagggcgcgacgaagcccaccaagggatcgacgtcgttcggcgtcctcgccgcgttcctcggcacgctggccatcatcggcttcgcggtggtcgagctccagaggcggcgagagtacaacacccagaacttcggccctgcagcttcaaccaagcccacattgccatcagctcccgcgtcaccagcaaccaagcccacgcacgccgccgccgccgccaccgccgcagccgccaccaccggaggaggcggcgcgcgaagcagcagcgtgagcgggagcacggcgaggggcggcggcgggaaggcgggggagcaagggcggctgacgttcgtgcgggacgacgacagggggaggttcttcgagctgcaggacctgctgaaggcgtcggcggaggtgctcggcgccgccaacctcggcgtgtgctaccgcgctacgctcaccggcggccactccgtggtggtgaagcggttcaaggagatgaaccgcgtggggaaggaggacttcgaggagcacatgcggcggctcggccgcctctcccaccccaacctcctcccgctcatctcctactactaccgcaaggaggagaagctcctcatccacgactacgtccccaacaagagccttgctcacctcctccacggtaatccacacacaccacatttctttctttttattagcttccttgttggcttattataatccacactcaaatttaatgtttaaattttaattttaagccacaatcagagttccaggtttcaaacttgatttttaaagtttgttttggagtattccttttatcctagttttttttggtagattggatcaatgccattataaatttaccgtattagaaatataacattattattcgtggaacttgttgcgtgccaccagaattttctaaattttcaaaccatggcatcgccgtcaaattttctgccatgaggatgattcgagttttagaaaatttcaatgcccccacaacatgtttcagaatattaataatatttttaatacggtaaatttgtaatggcatggatcaaatttacctatttttcaaccccaacaaatgataacttaggtataataaaagttttgactcgtaaattattgttttaagttgtttcatttacttttctataatttttcatcattgaagctaattttcttttgggggggggggggtgtggatttgtaggtgagggtcggagggtgaagaagctggtgcactggccggcgaggctgaagctggtgaagggggtggcgcgagcgctccaatacctgtacgacgagctgccgatgctgacggtgccgcacggccacctcaagtcgtccaacatcctcctcaacgaccgcttcgaaccgctgctcaccgactactcgctggtcccggtgatgaaccagtcgcactcggcgcagctcatggtggccttcaagtcgccggagcggaggcagttcggccgctcctccaagaagagcgacgtctggtgcctcggcatcctcatcctcgagatcctcaccggccggccgccgtcctacgacccgccgccgcagccggaggcggcgacggcgaacggcgacctcgtcggagcggtggcgtcgacgccggagggggagtggctggagaaggtggtggacgcggacatgatcaggaagtgggaggacgaggagagcaagggggagatggtgaagctgatcaagatcgggatggcgtgctgcgaggccgccgtggacagccggtgggagctcaagacggcggtggagagcatcgaggagctcaagggggggaaggaggaggacgccaacgacgagcactccttctactcctcgatcgacggcgacgaattcgccagcgtcgccatcaactaactcggaaatcaacccacattagcgcgcgcatcggttgtaattaagcagcatcaaatgatatgttaaaaagctcattatgtaaagtatacagaaatgatgcctaacacactaaatctgaactagcattctgtacttcatgtacgtctttttcgatttttttttcgttagcatttgactcatttcatttctcttttttttttttgctagtggcacaaaggccagggcacagtatgttcatgtcgtgtacaatatgagcgattttacggtccagaaggtcgtatattttagtttaaatttgttatgcctcactactaattagggcatcatcggtgtatgaaataaatcgaaccatcgcacttaaaattgtaccaacaagcacacaacactacaggtagcaaaccaaatcggtacaaggcaaaatggaaccatgttcttcgttcaaacctgtcaaagatagcttgtcgtccctcctatttttggcatcgtatcttccatatttggtgaacggggaatgcatagtaagccccactattaccttccgttctctgtaatattttccgattattcactagctaggtctatttcactgaaattagcccgtaccaattgtgcatgagttaagccattcctcttctctctcgatacacttgcatggtgacggagcatggggctcctcaccgggagaccgcgcaggcccccctttgccggttcggccgggggcgctaagtgaggttcttcaccctcgatctgtggaatgtacgcgagagagaaaatgcacgagacacgggcgatgtagacaggttcgggccgctgagaagcgtaataccctactcctgtgttctggtggatctgtgtgtgaaggggttacagagaactggaaagcaagagagtacaggctctagaacccctctttctctttctctcctctatcagctcaggtattctctaagttctcctcctcccggatcccggatcccggatccctttcttcggtgggtaaggtcctccttttatatctcaaggggataccacatgcaccacttctacctccccttcttttgggtgaggatttacaatggctgctccgaatgaccctccgatgggatgggtcatacctacctccacttcgccggaagcaaatacaacatgggagcacggtttgtctgccgatgacgtgaccggcgtcagaccagtcacagaccggtcattcttgtccaccacgcgtcagtttagcatgccgcacatctgtccttcttcatacaatgacttccttgcaatggttgcgatgaagcctggcatgaatctggccgggactgacgtgccaactccaggagttaccacgccggctccggctagggacgagtgcctggaggctctcatcattccgacgggacggggcgagacgagtgtcaggccgcctgttgccacctaacccgcgatctgaccggtctgtgaccggtcacatactgcgaccggtcacggaccggataagcgagcgcgctgcgcttgtattaaatgcggcgtggcgcgctcgtccaacccgcaataagtgcggttaggtgagcgccgctgtgctcacctaacccacacacgtggcgccaacaccatagggggtcggggcgccccagccctcggggctgagacgggagcggcccgacccctcggggagacagagggaggggtggccacgtcaccctcgggcccgacccccccgagggggtcaggccacgtgggtgagcgcggctgcccaagcctctagtcacgatactcccggtcccatgtcaccgacagtagcccccggcgttatgccagggcgatcgcccccctcgagggaagcgctcgggcgtgacgccactccttggtgacaggtggggccggtctctactggcgggcagaaagccagcgatcgcaaatcgtgcgcatcggtaagggaaaaccgactgacaataatgagcggtctcttcgcgaccgctacattagtcgagcagcgtgcgaatcgtgctgattcgtttcgcctggagacatgatgatggcgcttcggtcggcgagtgtagttaacgcgtgctcgatctgtcccatctcgactgccacggccgcacatccgcctcgtgcgccgcaaacgggcgagtgggattagtggaggcgtgggcgcgagaaacgagggggcgagatagtgggcgcgggaaacgaggagccgggcatagcgttggcaagggtataaaggcgccgaggaagagatttgtttccttcctctcgccactattccccttgctttcgccgcttgcgctctaactcttcatttcctgtgccctacccttgccgctctcgctcgctctcaagctttttcctccgccggcgtcatggcacggggctccgcactgctcgacggaagcatgctgccgccttctcgcatcgtgagcgagaggcaggccgggctgctgcgccgattcatgccggaatctgccaccggccgggaggtggtcgagctgggcgagggacgcccggcgccacactacccggggcggtccgtcttctttctctctttcgcaatggcagggctggtcccgccattctcttctttcttcatggatgttatggagttttataatctccagatggcgcacctcacccccaacgtggtaatgatgttggccatcttcgcgcacctgtgcgagatgtttatcggggtgcgcccatctcttcggctgttccggtggttcttcaccgcacagccggtgtcgccgccgtcggtagtcggtggctgctacttccagccgcgggggccggtgctgagccgctacattccctgcgtcctccgcaagaagtgggacgactggaagagcgactggttctacaccccctcgccgacgaagcgcgcctccgacttccgagccagcccctggcgcaggcctccagctggcgggcgccggtagatctgggagacggctacgacgtcgttcttgaccgcctggcgggtctgcgatcccaggggctcagaggggccatggtgtacggcgactaccttcgtcgccggatcgcgccgctccagcggcgtgcccggggcgcctgggagtacaccgggtccgaggattacatgaggacccaccaggggggcagatgggactgggcccctgaggacttcaagatggtggtccaacgggtgttgaatctcagctccgtggaggcatccctcatcccccaaggagtcctccccctctgcagcgatccagatcgcgccaacatcctgaccatcatgcaggcggtcggggcgtcggaggagcgggctcctcgaggccacgatggcgcgggtgggagccgcaggggggaacaatctaccccgggagggggtcgtgcttctgggccccgcgacgggggcccgaggggcagccgccctgccgacgcccgggggaagaggaagcaggagggtaccccttccccatctcctccccgagggggcggggcggtgcgtgccagcagcaggcgcccggagagtgccgtgccgacgccgcggcccgagggggagcgaaagaagaagcggctccgcaagatgggggagaccgaaacatgccggggaaacctcatctcacccccaaggtggtcgtttagccgacctccccgcaggttcgtccccgcgcccaccgcggccgtactcattctcctatctcccaaggcgagttttcacttacccgtttctttttgtcttctggtttttcttctgcttcagcgagatcccgtcgcgcccccctcgccattccaagtccggccgatctgaggccgaggaggcggcgaccgcggaggcccggaggcgggaagctgaccggcgagaagccgcagaccgtctccgggaagccgaggaagctgcccaggaggccgtcccggttcgccaggctgaggaagtcgctcgggaggaggccagactccgccgggccgaggagtccgtccgggaggtggaggcggcacgcgcacaccaggcggtctgccaatcccccgacccgactccgcccgaggcgacggcgacttccgaggccacccacgacgaggccgcgggcgcaccgctcgggtccgacccctcggacgacgttcggaacgagccaacttcgggggacgcccccgagtccggcacgtcgatcggcgggccgagccgcgcggcgcccacaccgaggcggctctctcctctgccttctgctgccctaccgagcgcggagcccctcctgcaggccttagccgccgcgaacaccacggtgttggacgggttaagcgcccagatggaggtcctgcaggcggagcgggtggagctcgacgcggcgtgggcacgcgtcgaagaggggcgacgctcggtggaggccatggtggaggcgggccgcaaggcacaccgccggcacgcctcagagctcgaggcccgtcggagggagctggcggagatcgccagggaggtggaggaggagcgggagactgccctcatcgccaccgccgtgctcgacgaggtgcgggacgacctccgtctccaatacgggagccgggcggtggagctagagaagaagctcgacgccgcccggggagtccttgacgccgccgctgcccgggaacggcgggcggcggagaacgaggcggcgtccggcggcgcgaagaggcccttgaagctcgctccacggcgctggaagagcgtgcccgcgcaaaggagagggacctggcggaccgcgaggccgccctcgccatctgggaggccacactggcggcgcacgaggccgcctgcgccgaagaggagtccgcactctgcctctgcgaggatacgctcaccgagcgggagcgagctctcgaggaggccgaggccgcggcgcagcggctggcggacaacctgttcttccgcgaggcagcgcaggaggagcaggcgcgccgcaatctggaaggcgcccgcgccgagagggccgcactggctcggcgggccgctgagctcgaggcgcgggctaaggagctggacgcgagagcgcgcagcggtggggcggccgcgggcgacagcgacttagccgcccgcctcgcagctgccgaacacaccatcgccgagctgcagggcgcgctggactcgtccgccggggaggtcgaggccctccgcttggcgggcgaggtagggcccggcatgcttcgggacgccgtctcccgtttagaccacgccggggggcaggcgggcctctggggcgagcggaccgcgaagtacgccgccaaccaggggggcctcgcccagcgcctctcagagatggctgggaccctccagcggctcctcgaggagctcgagaagacgatcaagtcatcctcgagagacctcgcccggggggcagtggagctcgtactggcaagctaccaggccagggaccccgacttctccccgtgggcagcgctggacgagttccctcccggaaccgaggacggcgcgcgcgcgcaggtccgggacgccgccgactacatcgtccacagcttcgagggtacggcccctcggctcgcgttcgccctcgactccgacgaggagggcggtgacggtggtgcggatgacagcgacgacgaggctggcgacccgggtgcgtcgaagtgagcccctagggcccccgccaatcttaatagctttttcctttttcttctgaggccttcgggctcccttcttgtatagactaatttaatctgcaatcaaataaagatgaaatttctgtgtcaattctatttgttgcgtgtatgagacgaggatggtctgtgccgcggtccttctgcatcttggcttgaacaagggctcgtgcccaggtcccagcctcaaatggcgcgggtcggggctagtgcctgggaagatccacgtgtcgagactggccaggccgggaacgtggtgaccgagggttatgggtgacccgattgtgggcctttgccgattcccccccggagttcaccacgccccggggcacggctcggttctgggccccttttggcgattttagccggcccgggccaccgagggcaggatcgagcacgagcgtgctaattcaagccaagattcttcaaaaggaaacaatggcacagacacattccttaggaaatcgaaaatgcttttattgaaatatggaagagaaaaaaggtaagtatatatgcatgtggtagcccccggccaaccctgcacgtccgggggagtgcggggttggcccgagcccgagacctgacacccgactccgactaggggtagaagcgtcgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgatgcagagtgatcgggcccggacgtggcgctgatggtagcgccgcaggctctgctggtagcgcgcggctcggagggccgcgcgccgccttcgctcctccaagtagtcgaggtcgtctctgcgaagctgatcttgatcagtctcgcaatacatggtggcccgaggggaccttagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggtgaagcagagcttgatgcccatgtcttcgcagtagtcaccgaagagttcactagtgaactgggtgccgttatccgtaatgatacggttaggcaccccaaacggagcagtgatgcccctgatcaatttaagcgtgtcacgtcctgataaattcatcccgaaataaaaatcattctctaaaaggaataatagaattaattaaaattcgaaaagaaattggcaaacattaaaatacgtgcaagaaaaattcaaatgtggcccggagaatttttgttaaattctccttggtcaaaaaggagccctcaaattttagtggaattttcagagcacaaataataattattaagaaataaacaaagttaaaataattttataaaaagaaaaacactaaaaagtctttttcccccctccctccccctcttgggccggctcggcccatctctctccctctccctcctctcccccgcggcccatccggcctctcccctcgcgcgcaccgctgacgggcgggcccgcccgccaccctcgctgatgggtggggcccacctgtcatccctgtcctcgcgccgcacccgccgcctcgtccgtgccctagcgccgccgccgccgcggattccgccgcatcccgccgtccccgcgtgcaataaagagggggaaatcactccccgtgattccctctccctttccccccacttttccctctctctctccctcggattcgttcggaaaccctcccgcaaacttcgccggcgcatcaatggcggccggatcttccgcggccgattccccctcatccggtcgctctctccccctcccaacactatataaacgctccccgtgcctccctcctccgtttccgccgctcgccgctctctctccccgtcggaatcgagctcgcgccgtcgtcctctctctccgccgtcgccgccgagcttcggtccgccgccgtcgtcgcctcggacctcctcccgcttcggcatcgcctccttcggcttcgccgcgtcctcgccgacctcgtccaccccttcgtttcgcccgccgaccgccggaacgccgccgtcctcgtcgacccgaaccgcgccgccgcctctctccgcttcggtcgccgtttccgtcgtcgccgttgacccggggtgagccgtggaccgcccatttcgcttcccccttccctcccctctctcgggcgccgctccgtcgcgccggtggtcgccagcggcgaccatcggggcgcgggcgcgtcgcctcccgtcggctgtgccggcgaggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgagaggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccataacttggccatttgagctcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgaagtttgggaaagcgagcaaggcaagtcacatcatccttgagcatattgaatcccagtttataaaattattttgatttaaattaatgcattaccgctttatctaaattcccgcgttatcactgttttatttagccatgcctatttatcattgttaagacattattattgctattgttattattaccttgttcaccccaggaaaataaaaccccaactagtgggtactctatttatggttccactagtatgaacttaggtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38062 - DNA, 718 bp, Oryza sativa
cttgtatgtaagtttcacgtaattttgaatcgttagatctattacaagatttgttctatggaggaagaaaaaaatcacatcacacacatatatgaaagaatttgttcccacgacctctattttactgaaataacatgttaccgagagattcttgaaagttacatacaagttacattatagttacagtgtaattacatgcaagttacagtgtaattacactacgattgtactgtaattacatctgacaaatattagggggagaaatttgatgacaaatatctagcaaaatcgtaaaatcaaaggggggccagccggcttttgacagttcaaaagattggcaatttctcctttttttttcatgcattggcaatacataaaagcgaatagtttgcaaaagtggacaatatacttacatgttcatttaaacttcacggcacgagtcttcactgtattgaaatcgctgctatgggccagccggattgaattgggccatacggtggcctgttggacctgggtaccatatataggggtaattaaaaaaaaatttattgggaggcgccatggcccctgccaccccccttagttccgccactagctcacgctatcatccagatccagcagtgcccacccaacgcccgactccatggcgtctccttcgtcgtcggcggagagacgttccctgcgcaccgtgccgtgctcgccgctcgctcaccggtgt

SEQ ID NO: 38063 - DNA, 4099 bp, Oryza sativa
cctgcagcccctaataatatctataaaactaagatgttttattttaaataaaaagagttgcgcattatgatagtttggttaacgataactctaataacaccaattttacatgattgatcatttttatttttattttgctattaatagttaaagttaaaaatatttgacttgatactatactaaaaatatttatattttaggacggagggagtatcttataaaactcagaaaagtttgacagcatgttctataaaacatcgtactctaggcagctagctgttgttttagctatctcaattctcaactactccattcttcccaaattgatcatcatataatatcatataatggaatttaaaatttctcaaattgatcatcgtataaccgcacggacacacatttcatccgaatacaattaatgcagcatggaataatatgtgcatgctaaggtataattggcatggtgttttaatcgatgcatggattttagagcaagtttaatagtacagccaactactagctccaaatcatctatagccaatataatagccaattcatataatagttgcttactatactattaatacccggtcctacatgtcatacacacatttcatcttggagtccgtgctgcagctggctacagatctgtagcccgctgctcttctctctcttcctttatctctttaaaatatgtttatagctggcttatagtctgctattgtacctgctcttaagagaaaatgtgcatggtctcttgattgatgtgatttaaattatccttggtgttggtgtataaacatatatgatgattaatttggaaaggagccacgtgggtgaaagcggggcgagttcccttgcggtagttcatctattcgggagacgtgtcctaacccatttgttttgcccttgtaaaagtcttaagtatttttaccactaactttgttgtatcaatatatatgagatacaacttttatcctcttttttttcttaaaaaaagtagtttcaaaatataagtaacttttgaattttaggcacgacccttttaatatttttagtggtaaagatgaatatttttatgtacaagctgggtttttcctaggcaggcctgtaggtggaccaggcggcctcgtagatgagagcaaggctaataatatagtcgacgtgttggctataaggttctttatagccttctcttagcatacccatataatagttagctctttataattaatatatggccaacttgtctctctcacagaattttttggttcttgtgtccaagccggctgtaagtttacaacccgtttttcctctctctcctctcttctctcctccacctcagcatttagccggcttatagcctaatattatacttgctctgaatctgcgtactgaagtatggccggccgttgcagcgccagatttaatgcagcggctgaaccgaagagacgaggctcaggtgatcgaagagctcagcgcaaacccagagagatcacagctgcagtaacaataacgcgggaaatcaaactgctactcattttgatgacaaacaaggagaattactgctactcgaaactcgaggagttcgatcacactgtactgatcactttgatcagtgtatataatcaggattatgggagttggatactgttcgaatcgatagatagatacatctccgactcaatccctctcgcgattgcgttctggtttgcagctccatatgctggcatgccggactctggttctctcgagctcatactagattacgaggcgaccaaccactgtgccatcctcgtcgacggcgagacgttccccgctcaccgtgccgtgctcgctgcccgctcgccggtgttccgggcggagctccttggctccatggcggaggcgaagatgtcgtgtatcactctgcacgacatcgagcctgtgacgttcagagctctacttcggttcgtctacaccgacgagttgcctgcagacgacggcggcgagctcaatacgacagcaatggcgaccgagaggaagaagggaggaggctgcctactgatggggagaagggcggggagcggcaaccatcaggctgggaagctagcgagcgtgcgcggagagggaggaggcggggaggccgatgagcaggacggagagccgacgagcgggacggggcgaggaggccgacgagcgggatggggaggccggcgagcacgcgaggagagggagaaggtggggaaaggggcggagggcgatagccatcgggcggggaggccaatgagcttgcgtggagagggaggaggcggggaggccctcagcccgtcgatctccctatcctggtggccttgactccccacgtcttcgcccacgacgccgccggtagtctccatcctcacagcgacgctgccggtttcagtcatactacttttgccacaccctcggtgagcacccatgcacaaagcctctttgaaattgctaattagcgcgtatgcgccatcagactaactcgcgcgcgtttctagcccatactcatacgcgacccacacactcgcgcttaccccatcgcttcctttttttacgcttcttctggcgattgttattttgggtaaatctttccttttttttctccacatgcgtgattctttttaggatattttataaattaaatctttacctcccatttcacttgagaattttgaatttgaattgattttttttaaaatttaagttgaatgttttgaattttaagatgaaagttttcaaatttaaattgaatattttgaattttgaggcaaaagttttaaaatttgagttaaaagtttttaaatattgacttaaactttttttaagtttgagttgaaagttttcagatccgagttgaaagtttcaaatattgatttgaaagtttcaaatcttgatttgaataaagttttcaagtctatattgaaaattttcaaatccaagttgaaaattttcaaatccaagttgaaagttttcaaatctgagtttaaagtttttaaatcttgacttgagaatttacaaatttgagttgaaaatttcaaaaaaaattgagttgaaagtttcaaatcttgacttacaagttttcaaacataagttgaaagttttaaatcttcaatttaaaagtttgttgcagttaaattttcgtacctatcccaatttgtcgtgtcctaaataaaaggaataaaatgtgtgggcagttattttttcaaataaaaaagaaaagaaaaaagaaaagaaaagaaaagcgagaacgctacccgtactacccgtaccgccgatcccgcgcgcgagttaatctccccacgtgcacgcgtgggataggaggcccccatcctctttctcatatctcccgagcacaccggtggtcgagctcgatgacgttgcggccgtcgcctagcacctccccaccagccatcggccgccgctccgctagagagctagacagagatggggaagagggtgagagaggaagaagccggcgtgttgtatcagtgacatgcggagggacctgttgcatctggtattgcagttcagggaggaaaattgaactcggtgtaaagttaagggacccaaatgaacttattcctttatatgaggttgtgcgtgttgtccatgggcctggacgtgcaaagctgggcttctcctagacaggcccgtagacggaccaaggcctggtagatgccccctggaccacgtctggtttgcacgccgggcgaacaagcgcgcgagctgaaccgaagagacgagcatcgggtcaaggtgatcgaagagttcagcacaaacctagacatcacacagatgcagtactagtaaaacaatgatcttgttgtatagcagcgctgctagtcattttgatgaataagaatgagaattactgctactcgaaactcgaggagttccatatctcagtgctgatcaattttctttttcgaggtggagtaaatcactgctgatcacttgatcagtataagtataagggcaagttttataatagatgtggtggtcacctccaattttatccacatcatccattcaaaaaattaaaattaacttatataaatgcattgcatttaatacactagtcccaata

SEQ ID NO: 38064 - DNA, 978 bp, Oryza sativa
ttctctcctccacatcattatttaagcatacatggcactttggagtttgtgcttagaaccttagggcaagtactataggcatttaagcacaatcacctagatgccacttaattttaaatgatgatgtggaggagagagtagatgagagagaggatgagccacccctcatgcaaggggtaacctcttcataaacttcaaggaggaaggagaaaagagtgaggttgattggataagagtgaataaaataaatatttatgttgcattgagactagtatgtgagctgcccttaataaattagttgatgatgtggacaatattagatgtgatagtcacctctaacataaaacttgcccttatagtacttgccctaaagccatcaggattattgttcgatgcttcaatagatacatctccattaatatttgtgatgaataattggctttacaaaagatttaatcaataaattggtttgaaaatatgtatgaatgttggtgtgaatgcgtgggactaatgtgggtcaggttgtgatatctgtgcttagaaacagttgttttgtctgattatgtgcaggtgacctgaggtcagccttggtcaatggtgaggaccggaactatactcagggaggagcagattaggtctagtgctgttgagataccatgtgagaaggtgactagagtcagtattcttagagatcaacttcggttaacgctggggaccgggactagactcagggaggagttgagatccagacggtcaaagataccggataacgaagttggatacgagatggcacaccatggatggacatcgtgtgggagagatcttcgcaacaggtttcacaaggtgtgcatataagcgtcggtgttcgtgaaggagattgaaagaaattggagtggagtatatattttttttgaaacacagtacaaacgcaggcgctcacaacgtgcgcacactcacccccatgaacgcacacacgca

SEQ ID NO: 38065 - DNA, 1516 bp, Oryza sativa
attcctgcagcccaaaagaagtaacagcttcaaatcctattggatcaagtgtaggatttggtagttgagctgaaatacgtaggtcaaccttttcagcatctagaggttcttcttttgaaagccaaatgattatatggacatgtggtagtccacgcttttgaaattctacagtgtagacaactgtacaaaagggttaactattatatggatttgatgaacaatatatgtatctaagaattttgattgaaagttgttttggaaattacctgcatgtatgggaccaaaaaaaatatttttttaatgtcatccattaacatattcagcttcattttgaacacacggtcaacgatatctggacgatctgaaggttgttgtccaggtgctagagcttgtagaatttttggccaagatgcatttgatgtgaatgtgacaaaaagatctgggcaaccatacttcctacaaatagcaatgcagtcttgatagttttgatatagataccgagggcttccagtatgagaggctggtaagataacccgttggccagccgaagaaccagttgtaatgcctctagacacagagctggctaaagaattgaatggtgccaatctatatttgtgttgaaaactgggcaacctatagtgttgtatgcgctcaccttcaacacaacaatagccatcaaccaaataagattgggttaacctcccacaacgtaatggagtgttgaattggcccgctctatcatgcattatataagcaaagaattcaaccattgttgctttgttacgccgcaaggcagatgaacttgctgtttggttatacatgttggattcatggaaaccatcttcaccatatgggaataaaataggatattgcatggccataaattttcggtgtttttcatctatacgctgcaattgtgatgaatggtgttgtattattatatcccgaccaatatcagtcaccccaatatcccaacaactaatcctacaacctctgctgcaactggtgcactgtatatatctccatgtgcatctgtcgagccaaatagtcggatcttgtaatgatcagattcattttcacttaatctttctcttgctgttcggaataacttcacaatgggattgtgtgtatcgaacatttctattagagagcgaacaatttcttcattggcatggaaggagtcgcgagaagaagaagcaatgttgattatgttagagatttcattttctgtatcgaagatgtatagctgagcatattctggccgacgaccttgtgaaggtattaaagagcctactctgtggcagatctatccactaattttgaagacatatggtccatggccgtcgttgatggattcaatgattttagcccccattgaagtcatagcaaacatggaattgtatcgatgaatatgctgcaagaaatgatttgaaagggagctcgcagaagttaacaaattcaatatgggttctggaggtggattacaaattcaatatggctgccaagattaagtgga

SEQ ID NO: 38066 - DNA, 1735 bp, Oryza sativa
tcattagccaatggaggagtagatgcagatgaagagcctatttcagttatgttcaactctcgatgcaaagaccgttgttctgaagataatgctatatgttgtgaagggaatgtgggtacataattagataggctataaccgggtaactaaggtaggtaggcaacgataaactttacattactaaaaaaaaattgaaggtgtaaattggggaaccaacctctacctctatgggcatccaatatgagtttacgttttcgtcgtgattcagcagcagtagcatgatcagggtgaggtaccaaaatatgtgccagtggacgtcttgaccggcgacgtcctactggaaaacgtgaagtactttgcccagcatccatgggttgaaccctttgttttttagttttaatcaacaaagcatctgatcatatatttacaaatatcggatgtaagtttattatatttgaaaatgtaggagtatacgcataagatgtaactggaatatgaaatcagaaaagagatgtacaaaaaaatatgaaaaatataggatgagttgaacaacacacataccgagcaaggttatctgcttttatgacaattgtcaggcttctcctcaagtgatgaaacaaatgttcttgtatctattaataaaggataggtgaaagaagtataagctgcaagcaccatttttttaaagaaactaaaacagtactcaatgcataggtctccaacatgtgcaaaaaccacaatgtatgctcgaatataatataacctggcaaaattcatgtgaaattcacacatactgaactgaatcaccaaaccaaccaaaagctttcattttatcacactttttgcgacaaaaatgcatcataacatgaactatggatttgcatagtttgaaaaacagtataagctgcaggttctatttttttaagaaactaaaacagtacccagtgcataggtctcctgcatgtgcaaaatccacaatgtatgctcaaatattgttctgagaaaaatcatgtgaaatttacacatactgaactgactcactaaagcatccaaaagctttcattttaacaccttttttgtgacaaaaacgcatcataacatgaactatggatgtgcatagtttcaaaaattttgataacatttaacgtatgttttttaaatgattttttttcacattttaacaggaaacatgaatagcatggggtgagctcaacagaagacataccgagcaggttagtagcttctcgctatgtcaggacatctatgtagcaatcctctggctcctcaccaactgctcaaatacattaaagttataggacatataagtatccactgcaaatatcagtttattttttcttaaaaaactggaacaacaatcagtgttgaaatcataatgtttgctcaaatagaatatggagaaaattgatgtcaaattcaggcttatcaaatagaataaattctcacacttttttttcagaaactaaaatcacataggacatataagtatccactgcaaatatcagtttatttttcttaaataactggaacaacaatcagtgcataggatagggattatttctttaggtgtagagaatccaatttacaaagctttcatagtgatcttgcctggttgaaatcataatgtttgctcaaatagaatatggacaaaattgatgtcaaattcaggcttatcaaatagaataaattcacacattttttttcagaaattaaaatc

SEQ ID NO: 38067 - DNA, 14554 bp, Oryza sativa
  unsure (1)..(14554): unsure at all n locations
aactcaattcagacatatttttttcagaaactaaaatcagtacttagggcaaagaagtaagaaccaactcaattcagacatacaaaattagtaacgaagcctacatacaatgatctgacaaagtttgatccacaactaacctatcttgccgtgatcgcaatcatgtccgaattggagaatatgcttgcaggatgaagcgatgatgtcgagggaggtatggatctgaggcttgcggatggatggatgatgtctgacggagaggcacaggtttgaggagacgtctggtagcactggggattgcaagaggattatcaaaaggtttggaagaggcttacgaagagaaattgcaagaggcacataaatcgtattaaccatcgtgcctccagtaccataatgattttggccgtttctaatgtaaatgcacatcattaagggcggggaatgggaagaagcatggtgattaccgtttctgctagccaagaagatggggagggggcggttgatttcaccatggatggtgccagggttccagatgcttcttcccatcggatggatggcgctagggtttccgagtccagacgcttctccccatcgccgtatcgctggttgccgagtccagacgcttctcccccatcgccgcatcgctacacagctccccatcactacctcctactgcgaccgagatgagcgcggtccccaccaccacctgcgcgccatcgccgcctcctgcgaccgagcgccctgtccccaccgccacctgcgcgcgatcgcgacgcggtgggcgagcgctagggtccgtcgcactacgccgctgctgctctgctcaggaagtcaggaggagatgagacataccgaaccctaaaatctctcattggactgacttgggcctcctgggcctcacgacttgggcctcctgggctgcagtatatgtgttgtgttcgaccccgaggcagattgcatccaacggtgcagatgcaatctaatctaccgatctaagggctataaattaatgatgacgttgatcattgaggtttaagctctaggatcttaattgcccgtagtgggggataactttataggaaaaagggatactaaaaaaaaaagctaaaaaaaagcgcgctagctgtgcagcccagcagcagctaggccttgggcccttggcccacgcgtgcagcaacgcagcaagcaagcgagcagtagcggcagctgtagctagcttagtaccacctcggctagctagctccatctacactagcttaaataggaaatgttgccggtgactgtaacatatcgattccagaatttatgcagcgtgttacagtgttaggtgactaagagtatgttggaaaactctgttcattttttaagggtatgttgtcttatttctgcatgtctcttagaagtcaaaatttataaatatttagtaacatagatcaatttgtgatatgtcactatagaaatatgcatgttcaaattcaacttactttgatctatcttactttttttatggcattttaaatgccatgcacgaatgttcccttgaggaatttttttaaaaaaatccacttcctgtttggtttgctaccaatttttattcacgtagttcaatctctatactaacaatttgataacgcaaaaattgagtccaaatcaaacaagttaatttcgcgcatctggatcaacttggatcccgacagaaactcctaaactccattaatattgttgaagtaatccggttttgctggggatcatggcgtgtgtatcgctccgacgcatgctgcgttcatgcgggagctctttccagttttttagtgagtgcgtgcgcttcgtgtgttctccgatcgtgggatggcgcggtctagtcaggaggcatggcgaagtggcgggagtttaggaacgcatggcaacagcttcggtcgtgggatggcgcgatcaagtaggaagttgtgggcatgtaatttactatttaaagtttcctaatacaacagaaaacgctgccaagtttcttctcgctcgttctgttttgatcggctaaacttgcggtagttcgctaacaatcttcatattatatatgcagcctgcctccatcacgaccacgacgtactcacaacctcgccggagatccaagcagcccgttcgataataatcctatcggcggcggcggcgatcaccgaccggccaagcagcatatataccttcggtttcgtaatttttctctcttgttcgttctccatggcggcgaatttcgtctgcttcttcgccggcttgtgcatcggcatatcgatccaggcgaacgacgaagagcagcagcggcggcggcgcctcgtcgagctggagcggcgcggcgaggagcgggagaagcaggtcgccgagatggtgagccgggaggaggatcgcgagcgggagcggaagaagaacctggacaagctcgaccagatcgtccagatcctcaggaatctgtgaccggatagccgccggccgccgtggagacgaggctcgccggagctaggagagatgacaataacagtgttattactactgtactagattattactccctccgtcccacagtataaggaattttgagtttttgcttgcaacgtttgaccactcgtcttagttatattttttttgtaaatataaaaaacgaaaagttgtgcttaaagtactgtagataataaagtaagttataaataaaataaataataatttcaaaaaattttgaataagacgagtgatcaaacgttgctggctttctctgtaatcatttgtcccatatttttcgcttttctttgtgatcacttgtagtaccaaatttaggctttgttctaatgtgcaagtcatttataagcttttcgccaaccagtgcgtaaaacgagagaatcaatcacaccgtttagtagtttaaaatatgtgctaatgaaaaccgaggaacatgacgtttgaagtttcagaaaagaacgctgcctttaacatgaaagttccaattcttacattccttattgatgtttgttgaaaatatatcctacagaactgcatgatttattagccccctacattcaaaaatataaggaggattttgattgtctagttctatgctttgacccttggtaataaaataatatataggttttgctatacaaaaatatatttgttggattcatgttcgaaactcctatttaatgactatgatttcgtaacagtaagaaatttacggtgaaagcttgtctttggagtaaatattaagaaatccagacctccattgctttgttttccacaaaaattctctgaggttcctacgtttgaatcgtgcctaatagcctacacgagagagagctgtgtgcgagtaaaattaagctgatctccatgaggctccagtatttacaagcttgatgtatgcatccttgaagtcggcaaaaaatttagcttggtcctgtgcatataaattgatccatctgcaagtagtttggcatatgcccaatgtcaatggcctgaccaaacatgtgagcatgaaggaaccttgcaaatatatctatttgtcctataaatttgtgacttaaaacctaaagcctaggtcctgactgaaagaattgaagatagagtaggattagtgcatggagtttggaagcttatgattatccctagtacttcttcagagcttgtaacaagtaagcgacattatttagcatatctagttcaagaaaaaaaataccttaagcattcatcatcttcagtgagtgcccaatccgttcgcagtcctaccattgccggcatgccagcttcatagaagaacacaacacattgtattaaggtgatttacaaataatgccaagtcgattgtacattgtacaaggatgatttacaaaggcatgagctaagttgagattcagttatggcttatggattcatgatgacagtatttaaagggcatgatggaaaaaatgaatggacttacatgaagatggctgtggcttctcaaggagtactttaaaataggagttgtcgaaaatatttggattcccgaatcctttacctccaattgtgtgtgctccagataacacaaccatctcctgtgtcctgccaagtatcaagtttaacttcagacatggaaggatgctaagttttgaggaacattttgtagaagcctagaggggaaatcatgtgcagatacgtatcatgtacagatacataatttttaaccacgcattagtaaattttcataaataggcaatgggaattgaattcacaagatgtttgtgtaagtagagaaaaggaggactcacgaaaagccctttttgctgaataatgttttcagcgcagtggcatccaatgtttcttcaggaagtttaccagcaggatcagcagtactacagagtcaaatgcattatttcataagaatatgggtattactttgagaaaatatggatacctacatgttctttaaaaaatatggatgcatactaaatagaagcactgcctggaaatgaacagcctaaaattttgccaacattgcaagggaactgttaaatgaacaaaccactgtgatgttgcacctggaatctaatcgacctagtcttactggaatttctggccctccacatagcgcaactgactcagcaccagccacggcaatcaaatccgcccatgatactgttagcaaagtaacggtatatgtgtgcttgaagatacatcacaaccgaagctcaaaacagaaagaacatataaaaagggtgtaaaccatgtaccttgctgcacaaggtcaattacttctttcgcttttcctaatacctgttcagttataagtcattaaaaacagatatgggaagtcaaaacatgttgttcttcagtaaggatatgttactactatttatgataaaaagcaagaaaaaaaaggaggaaaaaaacctttatggatttatttagcccagtattttcaggtctatcaacttcataaattatagatccattcatgccacctgcaagatattgtcataaatatccatctactgttttacttctcagaattcatctttagataggttgaagtgtagttattcgtagtttgttcttgtttgcaatactctataattctactttatacacattcaatttttgctctaaaactgtatatagaacttcaaccaatgaagacattaaagatcgaacctgatttatcagcaatatcaaaagtccctgcatcatggaaagccaaacgaagcatgccagcagccttgaccttggataaaacattcctcacaccgttttgaataattgaaccatcaattggctcagccctatagagtcaaacataaaaaaacttctctaaaagatgtcatactgccgttttacgagaatgaaactactttgagtaggttattcttatacacaaatagctattgtaggtatactttattgacctgtggttcatttcgacttttgattctaggccatgcttccacaattgaaccaattaaacataaataaaaatactcatagaaatgtaaattaatacggttagcaactcatagctatggaaacttagagcagaataggaatatgattatggttgaatactgcacttacgcactcgctatatgaacatgaggaagtatgaaagggagcagagcaacagaagcaaagtccctccttgtataacaaagagaagatatgggacctgtggtcaccatacacaaagcaaattcagttgggcagaaatatatcagtaggcactggaagcattctctcagttcttgcaatggaaacaactcatacctgaaaagaaatctgcattttgctgctcagagggttctgaacaagcagaatcatcactactgcacctacgaccagcagcagaagctcctatcctcgtcttcccacttcttctaatcctgtatcatcacaattttcacaggtcatgtgccttccatgaacaaatgatggcacggttggtatcaaagcatgagagaagatgcaaacattacctgcaggtgcaacgactgcagctggagaagaagcgggaggaggctgcaatatgggggacattagtgagctccattcccgtccttctggccttgttaactgtcagcaatggctgctactatcctgaactgaaagaggaaaaggacacaactcactagtcactagtcagccagcctatctctacctggctatacatgtgtggttcccaactgatggtccccaagaaagcactttggataagctgtacttcagtggtaaatatctgcccaattgtagttctgaagaatatgcctctgatactccagtgattatttttagaattcataaatgccattaatgtctcttcctatgtggatatctttctttcaccagtaaatactcccatctgttcattaaaccttttatggtaatagagtatgatttgaactgtttgtgccttactaaatttgcaatttcaacacaaatctataaaacaagctaagcaaaaaagaaaaaagaaaagaaaagagcaccaacaattaacacaatttagaaaacaaagtaagccaagatcccaccgttaaactcaattacaagttactgctgatgccaagaaatcatgttcacagaacaagtgagaaaaatcatagtttgttgatgtaaacaggtagtacagaactttctaagcaaactgcaatgaaattatatgcttatttacaacagtcattgcatgtttgaatgtgaattatctgcttcagtgtgtaatatgtattgtcacatataaatgagagaacatagtggacacttacataaataggctacaaatttcgcaaacaaacacaggtggtacttgggagctattaaaagtaccatgtatacgcttttctttgtttgggaagctagctgtctgtgcctcaaatttacagggaattatccgtctatataacacagattgcttaggagtccaaattctttgaggatggattgaacgccacctggtcagcacaatccaagttatctccagctttgtcactaccaacacccatcaggtcgagataatgttggtagtgggatacaatgacgttcatcttatcgatggagccttgaccacagatgagatcgccatacaggatgttcattgtagcaccaaagccaggatacctcttggacaaagtgtcattcttggttggtttccagttgccaacgaatacatcatgggctgatggttgcttcctcttcattggagtcatccacctccagattgctgcttcaaatgctagggtcgcattctgttccaataactctgggtggttcaacagatcctgtttgataccctgaccgataataccatagttgtagttcctgaataccatgtacaagcagatttaattagtcagtaccttaacctaatcagttactaatcaacagctatcaagatagggataggtcagcctaaccagtaaacaggaagagcgcctcgaccataatactcgactccttcaacacaaggatacaattcgttgctgttgtcacaatagctttggcttgggctcaattcatggttgtagcaaagcccccaagccaatggaccaccagttgcgacactatatccacctgtagaaatcacaattccaatactctatcagatgctactagcctagggtttttttattcatctgaagttcacgtgttcggtgaacaacagaacatatcacacagttggaacgaaacttctgaagattgctaccaattgaacaaaccttaggttacaatcttctttacaaatcaagtacatattcaaatcggaccaaagtccactgtgttgtgatattcagaatttcagatgcagaattgcagttgtctacttttaatatggaaatgccaaggatgatacacgatgccaatcaaaactaattaacatgctccacatatagctgcattcggcagcaattaactactagctgagataaaaaattgttacctcccattctacacacggatccagattactttcagatcttaaaagcaacactccgcagagcacctatcctaaagattacagtaggccgcaaatctactaccaattcgtccatttcccccaatctatttctcgatccacgcaacatcaaattggtaaaatcacagtaacgatcagcgagaagaagaagaagaagagcagcacacgtacaggaggtcttggcgccgacgtggccgaggaaggcggcgacctccttcatcccaacctccttccctcccgtggtgccgaacccgcggggctcgaagagcgcggcggcggtgatgaaggcgtggtagtcccagaacccggcggcgtgggcgagcgagcggtcgttgcggtgggcgaagagctcctcgaactggtacgccttgaagtagtcggtgatggtgtcgttgcagcagaaccggctcccgctgcactcccaccccttgtcgcacgccttcgcctcctcgtcgccgctgccgtccttgtgcctcctcccctccgccgccacgagtagcgccaccagcagcagcagcggcagagatgccgccgccgccgccgcacgcgacgtcctcatcgtcgccggcgatgcggatgcggagcgcgtgatcggcggaggaggagcggagaagagagagtgtcggtggtggggtgggttggtgggggcaagctggaagggccgatgtgatatcgctgttcgggggtattttcgtaatttggtgttattgggttgtttcgaacttcagatgggccggtgttctccggctgtctaaaaaggcctcaaggcttaaggcccattntgtgatacggctttcattggagtgaaattgagcaatttcatagaagaagttcattattcatcccccaattatagccccaaattgattcattcaacccaaaaaccagatatggagcatcccaaactattaaaacaagatcaatttatgtccctaagcggtttggtgattttatctaacgtggctgcttacgtcgcatttcattttagaaaaagaataaacaaagctattggtggaccccaacatttcaacaacactcatctctctcctcccttctttctttcactttccattttctgatttcaatggcgacacacattttctttcagacataggatagggcattataagttctgcaccgtttctcttagtacgtgtattcattcatgagagttaagatgtgttattttcgcaacggctattattggaaaaagaaatcaagtgtactatagtattttctattgtttattggtaatccaatgtactaaacaaagagattaagtaaatacaccatatctttttactaatacaaaaagatttatatgttcggcttttggacgtacatctttacatgtaaggataaaaatagtcataaaaattctcgatcgatctagaattgttttcgtatgagtggtaccgtttctgaccattactattttaaacctaaaaaaattggtttttctaagagtgaattacaccttgagccacctttgattaccattgttacaatttggactaggctaaagccaaacttttcactttgggccaggtatctttacatgatgtttcaatttggactcccttcttcttcctccaactctcttccccctctctccccttcaatctgtaaagtcttccaaagaattcaaagggtagtttgcattttcaatcatcgactacctagtgcttgtggcttaatttcaaggacagcggagggtgcacaacaagtattcctactggtagcaactagcatacgaagaagctggccggcaatgacagacagttgctgctactttctgaactgacgataagaactaagtcaagtagcagatagccatgctcaagctcatgctcgacctccgctagtgctacatgttatgctgcacgcctgcgctaaatttccacatgtgtcgctcgagcttcaacaagttttgcaacgctcaagctccgccttcgtagtgccgcctgcatttgagctcgaaatcaacttcggcgggtggctaccctatgaagaagggttttgcttcttgccttttcatgcactacacctgatcgagaaagagaccttgagctgtacagagaaaagagagtaagaaagggagttggaggaagaagaagagagtctaaattgaaaccttgtgtaaatatacccggtccaaagtgaaaagtttactttttcactggttcaagttacaacacaggtaagaaaaaatagtccaagatgcaatttactctttttctaatttcgttcggtgtcgcattaatctcgatacttaatattttaattgataaatattatcaattattaaacagataagcgtcgttttcgaagatacgttaccgattccaaatgttctcatccttattcttatcgacttttgtttttctccatttgaccaaagcgttttgagacggagggctttgttgttcagccagcaaataggggagtgtttccagtgtttttccaccgaagaaaggcgaaaaaaaaaagagaaggcagcgaagatttctctagaaagagagacgattgtcccatatccaccgatgccggattagatccggtggactccaccgatccacgggccgggggcccattccaacttgcccagccactggtgggcccaccggccacctcatttccctcaccccccaaccaaaaagataaaaaataaacaaaaagtttaattcgccgccacgcgctttgccggaaagccccaaaagcccgaccaccactgccgccgcgccgcctcctcctcctccgcctccgccgccgccgccgcccgccggccatctccgtcgatccaccgtccggcgagcagacagcagcccggcagatctgcccccaccacgggatcgaatcggcggggggaaccgaatcggggagcgcgggaggcggggagcttagtttgagctcggtcggcggcggcggcggcggccatggtgaaggagacggggtactacgacgtgctaggggtgagcccgaccgccaccgagtccgagatcaagaaggcgtattacatgaaggtaagtaggattcgtcgacttgtcgtcgtcgtcgtcgtcgcttgattttggtctgatttgtgtttgctggtggtggcgcaggcgcggcaggtccatccggataagaaccccaatgacccgaaagccgcggagaatttccaggtaggtgttccgccattgttctactactggcaacttatacccttataatcaactcggtgcaagcagctcacagggtagtgtagaaccctcgattgaatcagattagatgcttatttagctggacagctgatgcgcaaagtccgagatgttggacagattagatgcttattagctggatagctgatgcgcaaagtcactatcccagcacgctgttctctgcggattggtttcgtaagcagtcgtgtttttgtttgtttggctagttaatcagtaatcactttaagtttaaggttatacagctaaatgcttattagtaaccaccattccaccagtctctattactctgaaaacataaaatgtgtctttgccttttttacgtttgagatttggttaatggtgattagctatatatgctaaactaagtgtttgcctatctaaactgctctgtgaaactcaacatcaggaagtttaatatctaacatttggaatcagaattatattgctgagatatatagtaagttctagttaggccattcaacttaactatgcagatcgaccattccacaaatgaaatctgtgtaataacatgccagttaatgatcgcgaggttatgatatgatatctctaatctacttaaaaaggcagtcgtccgtccgcactcccctccctccaccacgcacagtgagagaaaaagaggcatgcagcgcatgccccacttgccccacttgctccacatcctcgcctccccaaaaaactggatttatttaacagctgacagaaaacatgtaaaaacaattaaaaaaattggctataaacagaaacagggcacaattaatattttataggtccgttgcaacacacgggcatttttactagtattagtaacatatcacattcttctctcctccctaactccaaagcagcaatgaatatatttgaagctgttactgcatagccattgtagtattatatggcattggctttattagaaagggtgctttttttttttttgcatattttcctattccgtactattgttacttataggaattctcattgcaggcactaggagaggcataccaagttcttagtgaccctacgcagcgccaagcttatgacgcacatgggaaatctggcatctcaacgtatgtgctgattttctcaaagaaattatatgatgctcttgcaaaatattgaaaagctttataggattttcatggttattaatttgccatttgtggcaaagcaacgccagtactatagttgaacttctttttttttcttccattcgagagatgcagatttttgtgggatacttagtgattacctcttttttgttttgaataataataccagacaacaatgttctagctcatttggttttgaaattctatagggaagggataattgatccagcagcaatttttgcaatgctatttggtagtgagttgtttgaagattatattggtcaactggctatggcatcaatggcttcacttgataatttcggtgaagatgaacatattgacacaaggaggttgcacgagagaatgcaggcatgctcctttagctggtttattttatatcatcttccatgctcattgaataacatgaatacagtcaatggacattaatgtatgattcttttggcagctttcttttcatatttgttgcatttttcatattcttctgccacaatattctgctgagtagtatacttcaattcaggctgttcaaaaggaaagggaagagaaacttgcagagacactgaaaaaccgactgcacatttacgttcaaggaaataaagaggaatttgtccagcttgctcaagctgaggtgaccagacttagcaatgcaggtttttgtcaatactacccaccctcttcctcaactctgacttccccccttgctctcttcctttcctgcttaagtgcttattgctgcaaggacttgctcaacacttatcttagagaagttggcatatgatatttaaggaactgtacctatttatcacatgattgaatagataactgcataataagatatcttgacaagcatatctcatgagatggcatctagaatcatccacttcagctgaaacagatccaaaaattagtatgctattctttggctacacatacttcttgctgagcttattaattgaagtgaatatacaagcaccataagctcattctttttttttttaattatgcgcatgttgtaaaaggatgtgaatggcctatatgctattcctgcaagtatatgatgatgttagctcgatggcatattaccaattttccctatattaaagtatatttgccaagttcgtaaatagaacccattaaatgttcgttttggtatattttgttgtttttgctctgttgagtgctcattgtgacttcggttggtctttaagctacattatgtgaactttctcattctgtttggtcatgttttgcttcttgtgcagcatatggcactgttatgttaaacactatcggctatgtatattcgagacaagctgcaaaagaacttgggaagaaagcaatattcttgggtgttccatttgtagctgagtggttcagagacaaaggccatttcatcaaatcccaagtaacagctgcagcaggtaacataactcatcaatatatttaacttgaaagtatatgatacagctaatgtcatctattgtgctagcattatattaatcataaagaatttggttgtctcatggttctgtaggtgcaatagctttgatgcagttgcaagaagacttgaagaagtatcttagtgctgaaggccattacacagaggaggaactagaaatgttcatgcaaaaccacaaaaaggttatggttgattccttgtggaagcttaacgttgctgacatagaagccaccctatcacgagtctgtcaaatggtctgtcccagcttacccatcaccgttttactcatggttattttttaacataactagtgtgatagtgaattttgaacattgtatggatgccaggtgcttcaagatggaagcgtcaggagggaggaactgcgtgctcgtgctaaaggactgaaaacattaggcaaaattttccaggtatagcttgttcatttgttcattaaagttttggtgatgctgttgacattttcattatatgacttgtatttacccttcacttagcgggttaagctcaacaatgatgagggggaagcatcggatatgaggaatatagataacatggatgacaatgacgggagctcccccgatacatcaccaagaagggaaccaccatacaatcctatccctaaccctcctcatgctcaggtagcagctcattatgattttttacttctgtcgaatttctcaagatggccatttgccactgtccattatcatggtgccttattgattgactc

SEQ ID NO: 38068 - DNA, 3407 bp, Oryza sativa
tgtacagttgttaacgctcgtgttgaggcagtagtaggtcagcattggtgtacatggtttggtgttaatctgcggcctcgttccgtttagcttgacgtgcatcttctatggaaaatgaagctgagaaataaaatcatgtttatagttttgggtgtatttcatggaaatcattgtgaatgagtttgttggcggcaatgtcgaataaccataatgttttggaaatatcatttggatgagaaactgttggtctttctgcttactgtactatggcataagatttatcaagaacaaagaaaattcacagcatccagataatagagggaaaatatattataataattcgcacgaacagtgctcgtcgatgcttttggcgatgttgtcgccgacgtcgaagctctgcgtctcctggtaatctaggttgaagacgaaactggaggttaacatgttggcaataatcttgcaagcgaccgatatctatatgtaaagtttttaactctcaatccgttttttaatctcttcaataattaacgggaagtcctgcctaagatgaaagtagccattggtgacggccaccttcttgaagttgctctccgccatcaagaagttgaggcacttgctctttagctccgggcaatggtacgtctcggcgtagcctagcgtcgtcgccaccgtctccaccgacacgctctcccacagcttctgtgcacacatcagcttcaacctctccaatgcgtacctgtccgccgccacgagcaagctctcgaaaaaaccggtcgtcgtcgacgacgacgacgacgacgtcgatggcgacggcaaggcgtccgtgtacacgaagtgtagtagagctttgaacgtggccggatcgatgtcgtgcagggtgacgcacggcatggcggcctccgccatggacccgaggagctccgccttgaacaccggcgagcgcgcggcgagcacggcgcggtgcgcgtggaacgtctcgccgcgacggagaacgacacgtcggagcagtcggcgcggtccacgatgccgccgagctggccgccgaggttcgaccgcgggacgggtatagggccgccgtcgtcgtcgtcgccgccgccgccgccggcgtcggcgaagaccacgacaccgcagacgatcgtgaccacgccgtcgacggcgtagagcggctcgaggtcgctccgcctcacgaggtgccggaacgcgccgccgtagccgcgggggtggccggggacactcatcgggaaggccctgtccgagcagatgatcgacggcgcgccgacgccgccgtcgcggcgcatcaggaaggtgtggaagatggccctgacggtgttcgatctcgccggcacgccgatgcgcagggagacgtactcgccattgtcctcctcgcggtagccgcgcgggtagcatctgatgacccacgactgctccccgtcgccgacggcgaagctgttcgtcgtcgtcgtcgtccctgggtactcgagcttcaactcggcgaagctggatgatatcatcatcgtatttttggtgtattattaattaattgcaaaaatatgccgccaaacggacaaattaataaagtttatatatatcgaaaatctcacggacacgctctgcgtatcatgacgtgaactagagtagttcatgacgtgaaccatagtacgttgtaggaatttattttcggcaagataaatgattccttttttatgtacgcatttgagtcatattttgattggtaggagataataagtacttggtgttttatgtttatgctaaactaaacatgtctatctttaactattaatttttaagaaaatgtatggtttaacataataagatgttatgtttttagattcaccatgaaatatatttttgtaatatagatatatttacatgttgtcaaactatatgattttttttattgtttgacttcagatacaacaatgaatttgtcaattttatggattagatatgtcatataattggattcgtaatcaccatagataccacatatatacctaatattatacgataaggtatattgaaatataggaaaatagcagataagaacaacaactcttcgtacttgagggaaggggattgggagtttacacgagggaattgatggtgagattaagataggaatttgatttttcatcccagtctcttgtttggtagaggtaatggaaattgatagggagtttagttggagattagatcattaatgaaaatggatggctgagatttgtttaggcgaagtaaaggagaaatttcctcccaattacctgcccctacccaggtattgaaaatgagggagttcatttctcaattccctatccccatcccactaaaattcccatgtcccccaaccaaacaaaacagttaatagcctcatccctctaaactcccaatcccttctaaaagctccctccaactaaacgggccgctaaggaaatatatataggttgtcaaaatctgacctaaaaagggcaaggtcttatttactcaaagttttaacacgaagtgtagtagagctttgaacgtggccgggtcgatgtcgtgcatcgtgacgcatggcatacggtggtctccaccatcgagccgagggactccgccttgaacaccggtgagcgagtggcgagcacagcccggtgcacgtggaacgtctcgacggaaagcttctggtttttctttcaaggagtaagggcaaaagctctgccgaaggatttcattaagaagggaaaggcctaaggttcacatcatacagattacaaggatcaaaagatcccagacaaaaggcttctggctattttttggtagtcaagtttgtactcgatgaaaccggaggccagcatgttgccggcttgccgccggcgaaggatgaactttctcgagagagaatttttttacccacagcaatgtgaagaagatcgatggtgaggaagcgacggtagttgctgccgataccgctggcggtttaggcggcccatgaagtgcgcagacctagtcaaggcccaagttactccagtctaaagaagtctaaccgcaattcccaagccaaccaaactattcgcaaaataacttttttctttttaaatctagggcctgaacgtttgcttttggagtggttctccagtgctgggaagttatatggttcgttaatcaactaaaatctaatggtccacggagaaaggtatcttccaaaaggtagtaaaaagtgggccaaggtacttaattgatagattgggtggaaggataaataagtaattatcttaattttacagcgataagactactgagagagagtaattcaatcatgagtggcgtgatcgggaattttttttatttttaattttttttattaaaagttttacaaaaataattttccattttgaaaattgacggaagta

SEQ ID NO: 38069 - DNA, 3066 bp, Oryza sativa
gatcatgtaccctgggagtataaggagaacgaggtaattgacggtgcaaggtatgcttataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacatagtgacaaagtacatggaagaaaaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttacttactcacacgttcttgctgctgccggtgattgtggcatatctcccaatgtgtacatctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcattagaaatgatatggatgagtcagaagcaggcgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcagacgattccatggtgtaacaatgctatcgatttaggaaataaaatgctgttgtgatgtgatgagtgttcggactaaatacttctatcgtgtaatttcaattgaatgttgttgtaatgagtacctccgactattgttgtactagtagtattgcgaactattcggtgttgtatcataatgttatcgtgatgagtgttcggactaagtactcatatcgtgtaactgcagttattgttgtaatcagaaatatttcgtatggtaacacttttgtttgtttgtactcttgtttaatatgtgttagtaattcgcttatgaacatttattacttatgttgaactaattatttatatgtttctgatcaatctatttgatgcaagtatggcgtacgacacaccgacgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccatactctacagtcgggcctagcaaggcttggttgctctagttcactgaaagtaaataagttgttattat

SEQ ID NO: 38070 - DNA, 12183 bp, Oryza sativa
agtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctgcgagagcaccgctaggactttcgtcgttgtgcacacgcgaccaggcttactggctcaccatcctgctgatggtgttcgacattttcgttgagccttactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactacctttgctggtacctttctcgcactcgtgcgcgtgtgaccttcactccagacgccccagagccgcacgttgccgctgtgacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcactgcagtccaagtgaggttgaacagaggtttgcacttgactgacgttgagcagagggtgaccttcgaccggatgcaggagaagatgcgtgcggtcatgcgcgtcttctcctgtcgtagcgccgtggacgtcgtacctccagctggtccggtacaaccacggcctcgcgcgcctaccgtcggagcaggacctcgacctacggtacctgtttcgcatggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagagattagttcatttttatttcagcttttgcacgaatatgtcaccatgttttaacggcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccgagatcttcggtactggggcctcttcatctcaagccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccatttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctagttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggcggaaggatgagcatgaacgtcgaattgctgctgaggctttagaatggcacgtaaatcccctaggactccccacgtggcgtgagcgtccggagtgtcgttgtggtgactgttgttaggtgataaggtctgtaaggcaccgaactcgaggacaaaggtgtttcgtgtgtccaaacattgtcgacaatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgatttgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagtctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatgtttgtacggtaacattccaaataggccctaaaaaataataaaattgtattttaccagtcttggagattttaatcttgtatagttttcaatataaaaagatttgataactattgatatttatacaaaaatataaagcacagtataaaatcgccctcccctagggcggcaagggggccgcctgcaaaattccaggccccccgccgcccatttgcaggcggccccccgcatagtacaaaatcgccctagcagaggtcggcaagggggccgcctgcaaatttcgttgacggccgtcgcccgagagcgaacggccgtctgccacgtcactttcgccgccctctgggatggcgatttttaaaaatcgccctcccagagggcggtaggcaaccacttctgtcaattttcaaaatgaaaaattatttttgtaaaacttttaataaaaaaaattaaaaataaaaaaaattcgcgtgatcggcagggggtctaatgcgccactaacctcacgattagtaattgtgtaattaatgataaaactgagaaactaattgataatcgtgtacatattttcctttaatctatacggtcatattgtaacaaaagagaaaaaatattctcatactgttatattcacgccgtttcatattataagttgttttgactttttttctagttaagatttgttaaacccgaacaaattcacatgaaaaaaatagtaacacttaaaatattaaattatttttaaaaaatctaatattaaatatattttgataatatatttgttttgtgttaaaaatgttattatgtttttatataaatttggttaaatttaaataaatttgattagaaaaaaatcaaaacgacttataatataaaatggaaggaatacattccaagtcacaacaaaatgggaagaaatgattgacatggaaattgaatgattgccacgaacaagtatcgcaagcactacagattaacagaagccgcagaggcagattagagacggaaacatacattggtaggaagtcacagtactatccacgtttacaatttttttattcctaaactatccttattgaatcaatggtgcgtgttcatccgagagggaggtactggaggtacctctcaagcacagtaaaagcgttttgtgcactctcttcggtgaagacctgatagtaaaattgagtaccaaaaaagagaagagcgtgccactgattcgcagttttgcaggctaataacaacttatcaacatttagaacatctaattgacgctatcaaccgaataaaagggcgaaatgtagaatactcttgccactaaatatctttcaggtctcatctctcaagtctcaagccgttcttttattggtaaattggaaccatgccattataattttgcaaagtttaagatatgtcatcggtatctcaatgatatatagaacccacatgagtcaatgacacgtgggtcaggatggcatatcttaatttttacaaaattataatggcatagctctaatttttccttcttttatctcttcgataactaagggaaaattctgtataagaagaaagtagccgtcggtgaccactaccttcttgaagttgctctccgccatgaagaagtcgaggcacttgctcttcagctccgggcagccgtgcatctcggcgcagcccagcgtcgtcgccaccgtctccactgacacgctctcccacagcttctgggcgcacatcagcttcagcccgtccagcgcgtacctgtccgccgccgcgagcaaacgctgatgatgaagcagatgatcgctcgtgctcgccgtcgtcgacgacgatgagccctcgatgatctgcagaacgtccgtgtacacgaagtgcagcagagctctgaacgtcgtcggctcgatgtcatgcagcgtgacgcacggcatggtggcctccgccgtggagccgaggagctccaccctgaacaccggcgagcgcgcggcgagcacggcccggtgcgcgtggaacgtctcaccgccgacggagaaggacacgtccgagccgtcggcgctgcccaccatggcgccgagctggccgcccaggttagagggcggcacggctatggcaccaccgtcgccgagaattacgagcccacatatgaatgtagccatgccgtcgatcacataaatcgactcgagatcgctccgtgtgatgaagcgatgccatccaatggagcgatgccatccgatgaaacgatgccatccaaggaagcggaagccggaggatgttcccctaattacatctatagagctattctttgcacagagtgaagatggtttaccatctttgttcatcaagaagacctcaaagataacattgatcttggggtcgatctcagtaagcagcaggaagacagcgatgtactcaccattacggccctcacatccacgcgggaataacaaaatcgtcgcattgtgctccccggccgagattcttattccgggcaagcactcgccgatggcaagtttttgggtttcgaggtaatcaagtttgtactcgatgaaactagaggccagcatgcttgctgccgtgtactccatatttgttgtatgggggcactggtggagaaaccctttgtagtcccggttcgtaacccccctttagtcccggtttccaaaccgggagtaccaatccgggactaaagatcgagctgacctttttttttttcatggccctgttgctgcatggtttatatatatatatatatatatatatatatatatataaaccatgcatatatatgtttcaatacatatatatgcatacatatatatatgtatatatatattatattatattatatgtatatacatgcataatatatatgtatttatacatatatatgttatgcgaatgcatatgtatatagatatatatatgaccaaaatatatttacattatagaaaatgtgtacacatgcatatagaaacatatgtagtcatgtattaattacaatccattatatgtcctagctagctacgattttgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcactacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacagaaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctatgttgtatggcaacagtatgaacgtcttgtaatgctgcgccttcaggagatggacgagattgtcctctgtttcttgtggatattggtcgagcattgcgacgtttacttttcgagggtcgatgaatccagtatcgaaaaccctccgccgtcgggccctttgaatctccattctacaatgataaaagggagtatattattttctatagtctacttatatacaaggacctaattaattaaaggaggtgtatagtaagaaatctaactgaacgatatacttacaaaatccagcaactcataatagagacgtcgagggcgtccagctggtatagttcgtagattcccctgaaattgttccagagaatgtcatctccttgcaagaagtccgtgtccctgatcctcgctccgatcatctctctaccggtggcgctcatctccatgtacagctgatggaacttgtacatttatgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcatcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactgggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagtagatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcttgtgtttgcatggcgtccatgctctgtgatcctacctgccccgttgaggcgcagctgctatggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctccacatccgactcctgtacgtgtggatgtcctccttgaaaccaatcttccaaggaatcacccctttccctcgtgttcatcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctactcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatccagcacaacctaaccgttgtgacgtacatagttcttggcggcttcggccggggcactaggacgtccatcttcttccacttccgttatgatgtgccgaccctcaagcttcttcgctgcacctcgttgcccgcgtgccctcttttgtccaacggagggttgactaccactagcctcctcctcctggttcccctccacatccttttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatatatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatatatatgctaagtgtttcgtgcgtatatgctaagtctaattaagactacaatagtcaattgctacttgtcgcaccaattccgtagtcaataattacatactaagtctaattacaaataaagtaatattatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaatacgtcttttctgcaagatacaaaaagatgtattaggataaatgcgaagtaacatatatatatatatatatatatatatatatatatatatatatatatatatatatatatatatatatatatatatatatatatgtatatatatatatatatattgcatttcacgttaacgttcgtcctcgttcgttcgctcgttctcattcatgttcgttcgcttgttctcattcacgttcgttccctcgttctcgcttgtcttcgttcgatcgttctcgttctcgctctcgttcgttcgatcgttctcgttctcgttcacgttctcgcggcaacgtacgttgacgtgttcgttctcgctctcgttcgttcgatcgttctcgttctcgttcacgttgtcgcggcaacgtacgttgacgtgttcgttctcgctctcgtttgttcgatcgttctcgttcgttaacggcggtgtggcggcatcggggcggcggttggcgcggcggcgtggcggcggcggcggcggcgtggcgacggcggtggtggcgtggcgttgcggggccgtggcggcggcggcgtggcgtggcgtggcggcggcggcgtggcgttggcatgcggcggcggcgttgcgcagcggcgaaggcggcggcgtggcgcgtcgtcgtcgtggcgtggcgtctcgtggcgggcggcgcgacggagagagatcgagatcggagagatcgagatgcatgaagggagatctggcggcggcggctctcaccccagagatgcggcggcagcggaggaggtggaggcggcggcgaggacgacgagctcgagacgacggcgagatacggcggcatcggcgcggggatttgccctaggcagtggcggcgaaggagagaggccgagagagatcgatcggccgaaaacgtctaagtgttggtgaagaagacgagggcgcaccgggaatatatatacccccggatct

SEQ ID NO: 38071 - DNA, 1989 bp, Oryza sativa
cgggagtaaatatcttttcccgctatttcgaaattctttttaaacccggttagggttaagaaccgggactaaagattatagcactgcatatgattttcgcttacatatctgtttataaaatagaagttaatgcattaacattatttaaagtacaaagattaatgacaattacttcgaaaaattatttttgtctgtaataaattaagtggataaatcgtaataagcaaatataattaataaaaattcaaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattatcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcggtcttgtcctcaactccgacgatttttattttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttgtggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatacatcggacttaccgatgttcctggcgtgaactagagccaagtgctcctcgatgtaaggagctaccaatgaagtgtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaat

SEQ ID NO: 38072 - DNA, 306 bp, Oryza sativa
tcgtcgtcgtcgtcgtcgacgacgaccggttttttcgagagcttgctcgtggcggcggacaggtacgcattggagaggttgaagctgatgtgtgcacagaagctgtgggagagcgtgtcggtggagacggtggcgacgacgctaggctacgccgagacgtaccattgcccggagctaaagagcaagtgcctcaacttcttgatggcggagagcaacttcaagaaggtggccgtcaccaatggctactttcatcttaggcaggacttcccgttaattattgaagagattaaaaaacggattgagagt

SEQ ID NO: 38073 - DNA, 1506 bp, Oryza sativa
tgggctggcttggattgctggcggcccacgttggtatgagatgcggtgggctgcagggcagcctaggtggcccacgtcgagaggcagcaaggcatcggcccagctggcctgtgcggctggagaggaagcagccgtgcgcaggtgaccgagcaggagacagagaaggaagtccgactcggtgtgattgtttgtggccggtgcggctgcagttttgttaaattgtaaaaggtttggaaattgaggtattgagtcctagagtttttttttataaataaatgaggggttgagactaaatggatattgactttttggtagagaaaagttagggtttacttcgaggtttcaatcctagttcgtgagttgagagaggagtaccttaggtgcactttgtaaacatatattgatgcaataaagttgatatacttttaagtgtttcgtcgatacgtgtttttctggatcccaacggtttgaccggaggcgattcattggtctaaccggcgggcggtcacatcggcggctcaaccagcggcagtggcagggaggcggttcaaccagcgaccaggcggtggttagaccggcggcgtgcgagcggtccgaccagcagcgatagaactacatcaagttctccattgatttgagggtaacttttatttccgctaaaagtttttgggtttttggttttatcaactattcacccttctctagtaggcttggttactcgtgttcgatcctacactccgtactctctcgagtgcgttctggtttcagctgcatcgtctgcgtagacatgccggactccggttttctcgagttcaaactagattatgcggcggccaacaagaactgtgccatcggcgacatcgtccgctctgatgtctttcctgccggaggacacgcatggaggataaggtgctacccgagtggtatagtaaagaagataacggtgagtacctctcgctcttcctcgagctggtccgcgaatccacttccaacaatgtcagggccatttttgacgccttcttggtggaaaaagacgacgagccatcttccacccacgcagacaggggcgtgcatgttcacccaaccaatggctataccgcatggggatggccacagttcgtgaagcgaagcgatctcgagtcgtcgtcgtcgtcgtacgtggtggatggcaaggtcagaatcatgtgtgtggtcatcgtcatacgagacaacaccgtgcccgtgccaccgtctgacattggtgcccatctcggtggcctgctggaccgcggggaagggacggatgtctccttcctcgtcgacggcgagacgttcccggctcaccgtgccgtgctcgccgcccgctcgccggtgttccgtgccgagctccttggttccatggcggagtccaagatgtcctccatcactttacacgacatcgagcctttgacgttcagagctctacttcggttcatctacaccgacaagttgcctgccgacgacggcggtgatcagctcaagatggca

SEQ ID NO: 38074 - DNA, 4017 bp, Oryza sativa
ccgatggtatgatttgagcaggttaaagttgatgtgtgcgcagaagctatgggaggcagtgtcagtggacacggttgcgacgacattgatccacgctgagatgcatggttgcccagagctgaagagtagctgtcttgacttcttcgtgcaggacaagaacttcaaggagaccgtgctaactgagggctatgtgcaattggtgcagcgttttccctcgattaaggatgagatcagaggtttgctgagagctaaatcaatgtaatggagtgatattttgtctggccgttcaaatttgcctttttcaggacctgtactgtcaggctctagttttctcattttatttctactcaaattaatagtccattcctcgatatccacattgatggcaatcgacatgtctctttgtgatcaaagtttggagtttgtatgaattaagaatatcattactttttaccagaaatactcaaagttcattacatttaaataatttatcaaacaaagaaaataatatttttatatgaggaattttacagtccttgagaaagtactttgaggtacctaaattttacattaaaatttttggtaccttgagatacttagtacctagaggtaccaaataaaaacaaaatgtggggtccacatgttggtcaaacaaaaggaaaaaaatagtgggacccacatgttaatgggtcccaccctcctctctatctccaccacgtccttctcccttctccctcccggccatcttttaatcctcgagctccctcgccgcctgacaaggtcgcaccgaaaggaagaagggcggaggctgcctgctagcggggagaagggcgaggcgcggcaaccatcgggttgggaagctggcgagcatgcgcggagagagggaggaggcggggaggccgatgaatgggacggggaggccggcgagggggcgaggaggccgacgagtgggatggggaggccggcgagcatgcgaggagagggagaaggcggggaaaagggcggagggtgatagccatcgggtggggaggccgatgaacgggacggggaggtcggcgtgcgcgcgaggagagggagaaggcggggaaaagggtggagggcgacagccatcgttgcacggagggggaggaggcggggaggccctcagcgcgtcgatcctggtggcctcaactccccgcgtcttcacccgcgacgccgccggtagtctccatcctgacaacagcgacgctgccggtgtccatcctactgcttctgccacacccttggtgagcacccatgcacacaacctcttcaaaattgctaattagcgcgtatgcgccatcagactaactcgtgcacgtttctggcccatactcgtacgtggcccttatttttttggaagtttttttagcccttcttttttgttttcgtcttttttagggagtcggactttaatttgttttttgcctttttatttattttattgggaaaactattgacgttggacgacagaaacactacgaattttttaaggaggtaaaagggtaaagataaagatctactaatcaaaatttataaaatttttacataactatgtaaacaacatacatatacctaggtgccgtagaaaatactatcccctgggagactttctactatgcttggcatacattagagccattgattgctcttaatctaacgaactaagggtgtgtttagttccacgccaaaattggaagtttgactaaaattgaaagtttgaagaaaaaaaatagaagtttatgtgagtaggaaagttttgatgtgatggaaaagttggaagtttgaagaaaaagttaggaactaaacccagcctaagataattgtctcttatcatcactttgaatcatcgtatagttaaggaccaatcagtacatattctagggtttgttaactatttcttcgttgttatgatcaccttatagtagcgcatgattttactggggtatttaaaatcatttcattcggagtttgaagaaaattaagaagcgagcttgggttaggactgagtgatttacttccatcctagttaccgatgatggtgaaggaagatggattatatcgatgaagtgattgtgtattgccaatgggctagactatgatgctagtctttgattaacaaaaaaagataatgggtgctagaaagctatgtgtagctttggtctttgggctgctggcagcagacgtgatggtgtgagccttgctttgcttttctacattgcatggctgatctatcctctaatagaacaagcatattgaaggggtcgtttgttttgatgttggtgcccaaaagctttgaatctgaccacgcaagggttcgtggccagcaacaaccgaaaggtgtgtttgctatcaggatcagcaatcatccccgagaaggctaaatggctgtcgaatgatttttaatagctaaatcattcatgttttaatatattcagaactgttgttttattgtagtaaaatgtttcatgaggtgatttgattatgattcatatttttaaaagattaaaatatttttgatttacttggtgaaacaacgcctaattggcttcaaaatctacatgatggaagcctaaaaaaatcatgtgaatcccatatagactctttctcgatgtactcggatttgttttacgtttcaatatattcggaaccgttgtttcatacgttgtagtaaaatatatcatagggtgatttgattttgtacagctttttaaaagattgaaacattttcgatctacttggtgaaacactgcatgatggaagtctaaaaaatcatgcaaatcccacatagacagtcccattacttaattacttaattaggttcgagtgatcaacaagtttggaggttttaacttgcaggcattttgccttaatttacttgcttgagcattatccggtacaagctaagggcttgtttagttggcaaaaattttgcccctgcatgtcacatccaaggccggtcctgacatttgagaggccctaggagaactcgacactatgggcccttaaggcattaaggctaaatatttttacttctaatacatatactctataaagcacatatactatatagtgacacaaataaacatttctaacatggtaaatagtaaatcaaatagtttgcaagttgcaatacaacaatttattatcgataaataatatcgatagtataattgacaactaaaaaacactatagaaacaaagtagtatgaatacattaataggagaccacaaacatcctatatcccttataaaaaagagcttcttcacgtatttcttgaagcgaaatcatttcttttgtgaaccgattaattgatctccccgttttcttttgtttcttttctgagcacctgacaaatgtttttttggtaacattgtaacacctgaaatagtaaatatatatattgtaaagtaaattatacagcaataaccatgaaaattatagcctaactaacctaatttttcgagtggaaaaatcatacaatgatgccaagcaagaaacttcggtttgttgtttgcctaattaacctaagtacctaactaacctcagtttgccaagggcttatggccggcaacaccgcaacaggagactgccagactggagacggggagaggcgtgtgaggctcagagaggcttgggcgttcaggcgttggcgattagaggatagaggcggccctggcgtgccggtggccagccggcactcggccaggcgcccggcgacctggcgccatcgacgcggagagccggagaggagacacgtcgcggtcgcggagttagggagtcactcgtggaagcggaatcgtgattcgtgaggagaaaaacagaaaacgaagcgatctagcgattagcgaagtggcgtcgcggccttctgcatccctccctcctggcttgcgcgtgggctgatggctgggctgggctgctgggggaggggggttgggggttggtgatgggcccccagccagcctaggcccagggccgaccctctcatcggatatatg

SEQ ID NO: 38075 - DNA, 1740 bp, Oryza sativa
cactagaaaagatacccgtgcgttgcaacgggtgaatactattttaatcttattattgttatacggtttggctagggtaaaatttactgtgggaattcgcttagatattttttttctagaaaatcatgtgctgcaattaggagtttgacattcatctcaagttaacatgcaagtatttttaatgagatttcttatacgactccttttgtatttctaaaagtaaacgaacttaaaatccgactcaacatggatatgtatttccaaaagcaaacgaatttaaaaaccggctcaaacatgaatgacataccaaaataccagcaaaaacatcttcaatttttataatagtagagatagagataaaaacttaaggtgaacaaaatatggtaccaccaaatatcttactattactccagtatttcagaatcggatattggatatacgtcatatgatacctgagccagggggattttggttttgaatcacttgggcgtttccaggactctgttgagtctttgtctccaaagagagcatttttagagacaacttccgcaagtaatcagactggtaatgcaaaagaatacaatggtaagatttggctttgtaataaataacttgccaccctaaatcctggtggttagcacaattgaaacatatgcttcgtttttttatactatgatttaaattatacaaattcttatctatacagcaagctactttggcatgaataagcctgatgaagtatgaacaggagaacaattggaatatggagattatgaaaccctatacccagccaaggaagctcctacaaaaatgtttaccaaaatgaagtactaacacaaaaggaaggactggagtaaaccattgtttgatgtttcatctcggataaagggaatattttacaggtgatttatacaagcatgaacagatgaaatgatgggcttacagaactcaaggtacaactcctgtacttttaacatggccaatgagagaaaccagtctcatggtaaaaatattgtttagttctataattcattattactaatttactattgagatatgttattaatgaaaaatgatgtggggacatcaacacctctagcataggactgaatcagtcttagtccccgtattaaggcgcaaaggagattttctaccgataaaatggaaggaaaaagtttcagcagccttggataatctggtggaggtgtgaaatattaccatcggttcaaaaaaaaagtggatacttcatggtgaaactctaacaaacttcaaaatcaacagacatatttgcaaacatttgaagatcgatttcttctactaagatcccaaatgccatgcttgagccccacaactgaaagattggatcaaccggaggaagttagcaagaggctaagtgtacccggctggtggctccagtatagattttctcttcaaatcgcactgctaacttttgaagttcattcagcccctcaggccctgatactggtagatgcttcttcagagtctccagtctgtacatagattgcaacaagcaagtaaatgacaaatatatcccatgcagaaaaaaaaagagagagatatattgcttttgagatgttttgtgcaaaaaaaaaattgtcacctaaggcataatgtgtcggtctaccatttaagatgttggacaaatgagtgggaaaatatgtaatgcaaaccacatatatagtggaaacttggaaactaccgttggattgggaaatggac

SEQ ID NO: 38076 - DNA, 11967 bp, Oryza sativa
cgccagagtcaaccatgacacaacgaaattacttagctgccctaccaaccactaggtaccccgcggcggaacgacgttagtaccaacaggcaacaggtaccgatcaatcatttccatccgattaaccttaatcaatggctgagatttgatacctcccctctcaagtactaagcaagttttaatagtatagcccactattaactccaaatcatcatagccaatgtactccctccgttttataatgtaaagcattctaccattgctcacatcatttaacatatatataaatgtgggcaatactagaataactctcgttatgaaacagaggaagtaatagccgatttatacaatagctacttgctataatattaatacctagtctcacctgtcatacacacattacgtcttggatttcatgctacgcctgattacaaatctgtagcccattgttcttctctctcttcctttatctctttaaaatatgtttatagctggcttatagcctgctattgtacctgctctaaggctgcgtttggcagctggagaaagcatgctgatctactaaatagggtgttttttgcaaaaaaaaaattctatatgtaatttgctttagaaaatcttattaatccatttttgaagtttgaaataattaatactcaattaatcttgtactaatggcttacctcgttttgcatatcttctcaatcgtctcttttcccctcatctcaaactcaccctaaaactcctcttcctacgctgagttttctccagctcttccgcgcacatgcttttcaaactgctaaacggtttataaaaattttttatatgaaagttgctttaaaaatcatattaatctattttttatatttattttagctaatacttaattagtcatacactaaacgctgctccgttttacgtgcgaagcagagggttcccaacctcactccctaacacagccctagtcacctagtcagtcccatcgatatgggtcagtggtgatgcgcctatgcatctgaactggcctagatatatttccgtataggaaagtgaatcgatctacggatctcaaaaaacagaaaaatgatactcataattactcattagtatatgtatacattgcttttcgatctatctccccatctcgcagactgtccatctgccaccaccatgaacatggcgccggcctccggttttttggagctcaaactagattattcggcgaccaacgcctacgccgtcggcgacatgctcacctccgacgtcttctcggccggtgggttcacctggagtgtagactattacccgcgtggttacgagaaggagggcaacaatggtgattacttatcgctcttcctaaaacggcggggatgggacgacggacgtctccttcgtcgtcgacggcgagaggttcgccgcccaccgtgccgtgctcgccgcccggtcgccggtcttcagggcggagctgttcggcgtcatgtccgaatccacctcgtcgtgcataacgctgaaagatatcgacgctgcaacgttcagagctctactccggttcatctacaccgacgacttgccggccgcagacgccggcaaactcaatcatcagggctcctcgatgggcgcgttcttccagcatctgctcgccatggctgacaggtacgcgctcgacaggcttaagctcatgtgtggccagaggctgttgcacagcatgacgtcggattcagtcgccggaatcttggcttgcgccgagacatacgattgcccggagctgaagaacaagtgcatcgacttctttgccgtcgaggagaatttcaggagagccgtgttcaccgatggttttgcgatgctggtgcagaaattcccgctcatagctgctgagctgaagaagaggattgtgaaaccgtagctgcatatatatcttttagtcctctatcgcgttcactgcacttgtgttatgttttttttttctaagttatgtctggctttgaacttgtttttttttatcatgtttaattatattgggggtgttatatgtactagctgaatgctcttgcttttcatcagaatttgtccaactacttcatcagctgatcttggggtttgttggaagcttcatgcatttctttggttccaaatataccaccaggcgcctggaatcgaccatattatcaattgggtatttttatcattcttaagatacttagagatgctatatattctagggagacgactccgtgtcggacgtccgatattccaccaaatatcggacgcccgactgtttacgcgtcatcacaccacctacgtatgcaatatgcaaaaaaaaaaaaagaatcagtcagtcaaatgttccaattaactaacgagtgaaatatcaagttatatagggttaaaaaaaatcagcaactgaaacatttaaaaagtttatgaaacatggtgaagatacacgttaaaacatatcgctatcacatatgaaacaaccaatgttaatggattgaaacatatgtttttctttcatcaaaatataattatgcgacattttgttgtaaagatttaattacaaagaatacaacggtgtgatcagattatagattgaatgagtatttaagagaaaaatcgttttaaatatcgttaaaggtgcatgttatatggttggaggtagagatataggcttggatatgtgtatgtgtgtcagaggctgcctgtccgatttttgtcattgcttcgaacgttcgatgagaagcattttctattttctagtgtaaaatttgatacctctagatactataataagtttcttaaggtaccaaaaattatagtgcaaaatttaggtatctcaagtattttctaaaggactgcaaaattcatcttatcatgttcatgtgccgggcatgtatccgaatccaataagactacgacacaacaaatcgatcgacacatccaaaaatcgatcgacacgacaaatcgattttcttattatggaaataccgaaataggagtttgtactatccaataagaaaatcgatcgacacatccaaaattagagaaagagatcacaatacatatatataactcatcacatcggcattatacggtatacacattggcgttcgttcgatatctatctatccttctcagtctttctgctgaaatcacacgtacgtctcatctcagcacacgatcgatcgagcatggcgccggcctccggtttcgtggagctcagactggattactcggcgacgaacgcctctgccatcggcgatcccatcaactccgacctcttcaccgccggagggctaacctggagggtgaactgctacccgcgcggcgacaaggcagacaacaatggcgactacatctcgctctacctcgagctgatcagcaagtccaagaacatcaaggccatcttcgacgccttcatggtggatgaacacggcaacccgtccgatggatcgaacaggttagtgcaggtctacccacccgcgggctatcccgcgtggggatggccacgattcgtgaagcgaagcaatttgtcatcggtgttcgtggtggatggcaaggtcaggatcatgtgcgtcgtcgtcgtcctgcgtgacgacgacggagacggcgacggcaaccgtgtgccgctgccgtcgccgggggtcaccggcggccatctcgacggcggcttattgccgctgccgccgccgaacatcggggtccatctcggcggcctgctggacagcgaggatggtgcggatgtcaccttcgtcgtcgtcggcggcggcggcgagaggttcgccgctcaccgtgccgtgctcgccgcccggtcgccggtgttcaggacggagctctttggctgcaagtccgaatccacctcgccgtcgtcgtcgtgcattacgctgcagggaatcgagccggcgatattcagagctctgctccgattcatctacacggacgagttgcctgcagacgccggcaaactccatcagggctcctcgtcgacgaacgtgttcttcaagcacctgctcgccatggccgacaggtacgcgctggacaggctaaagatcatgtgcggacagaggttgctggacaacatgacgccggattcggtcgccgcgatcttggtttgcgccgagatgtacaactgcccggagctgaagaacaagtgcatcgatttctttgccgtcgaggagaatttcaggaaggccgtgttcaccgatggttttgcactgctcatgcagaaattcccggtcattgttgctgagctgaagaagagggttgagaaattgtagctgaaatatttatatatcttgtactagctctctagctaccacgttgactgctcttctgttatgttttttttttctaagttttgcgatctcttgatttgaactcgggtgattttcacatacacctgatgcagacggatcaaagacctgcatgtgaaaatattttttagcggtatgaaaaaaaatccttttttatagtgtatcaaagatgctcatataccaaattttatataaaaaatatgatatctcccggtaattcccaagtagtacaaaatcactcatacattagcttataaaattattagcaactaatagttgtgtgtatcgggaaactgttttaatcacctaggtggatgtccacccgtttattgcatgtcatctaaatggttatgaaaaaaaattaaaataattaataagatagatcaatatgtaatataccacttcataaacatgcaagttaaaattcaacttctataaattgtaacaattaattttgttatttttgttataactagcaaatatgcccgtgtgttgcaccgggtgaatatcaaacaaacatggatgcttaagattgctttgtacttataacacatgtgcacaaaaatattgaatttggaagcgtacatatcagaaaaatatgcaattaattaaatacaaatttattgacatatttggtatttttaagtaggtatgtgtataattaaataaatttacaagtaaagcaaatgtgagaaataaaataacatggttaaatttaattttattaaattctccatgattagttacgctctttagaattttattggaatttttagagcttaattgttaattttaataatacaaacatcatttaacaattatttaattggaaaaagaaagaaaatccttcattttaggtttgattcgaaataaacacattcaataactataattgtaaatgcttctgaatctttttcttcggcccgagggacctaaaatagacttcttttcgtcccttgccggtcggcctatggccttttgcgcatgcgcgggcgctctacccctccccaggccgcaacctaggcttgggccggaaaagtggcctcgctctcgatccctcttgggcccatttcggcccggttgacggcggccgtccgatctctagggttttgatcggacggccgagcgtcgagatcggggaaacaaaaaccccctccctctccttagccatcaaaaaccctagcccatttccttctctcccttctctcgcttcgccgccctcccctccgcgcccctgatgctcccgtgacaaagcggcggcggcggcggcgcctctctccccgagcgactgcggcggcgacgccgcctctccccccgagcccaagcggcggcagcggcgccctccccccgaacggcagcgggggcagcgccctcccccgagcccaagatgcggcggcggcgcccccccccccccccccgagcagtggcggtgccgccctccccctgtgagcggcgacggcggctcccccacaaccggcagcggcgggggctgcggcgcccagggaggcatcgacagcccgccagcgtcccagcggcggcggtggcggctcgacggcgacctcccctttgatccttttttgatatatttgtgtgtgtatattgcttcctccgattttattttatttgtgtgattgattgaattctgattgggaagtttttttgggtcggggtgatggaattccgactaagatttaggagaggcgagggggacaaaaaaatcaccgcacatatgaggtgacgaacgaaaaaataagaatatttatattagttatatatttgtagaagttgaatttgaacatgcatgtttgtagaattgtatattacatattaatttattttatcaaatattttttaaaaaatttataaccatttagttaacatgtttttactctatagtgattagaatccggtgtgtatccgcagtttcgtttcatttgttttttgactatcaatcgcactgacacgcaccaggcgtccaggcgtcgtcgtcttcacattctcgacgctttggaagaggcgttgtatggagacatcatggatcttctcctctccgcggttggaactccaaagcgttactaattactccctccgtaaaaaaaaaagaaagacaaaccttgattttcgtgtccaacgtttgaccgtctgtcttatttaaaaaagatataaaataaattaaaaagacaagtcacgcacaaagcattaatcatgctttatcatctaacaacaataaaaatatgaattattaaaaaaaattatataagacggacagtcaaagttggacatggaaacccagggtttatctttttttgggacggagggagtagaccctgtttagatgggactaaaacttttaatttcctatcacatcggatgtttggaaattaattataaatattaaacgtagactattaataaaactcatccataatcttggactaattcacgagacgaatctattgagcctaattaattcatgattagcctatgtgatgctacaataaacattatctaattatgaattaattaggcttaaaaaaattgtctcgtgaattagctttcatttatgtaattagttttataagtagtctatatttaatattataaattagtgtctaaatacagggactaaagttaagtccctggatccaaacaccacctaatactttgcatcgacctaatactttgcatcgatgcgtatgcatgcattgctgtactataaattctctctttagcagtctttatgtcataatttggctcatagttgattttatttgagcaggccaaattatctaaaataacttgtactatatgtgttaagtggtttgctggaaagacattatctaattatgaattaattaggcttaaaaaaattgtctcgtgaattagctttcatttatgtaattagttttataagtagtctatatttaatattataaattagtgtctaaatacagggactaaagtaagtccctggatccaaacaccacctagtactttgcatcgatgcgtatgcatgcattgctgtactataaattctctctttagcagtctttatgtcataatttggctcatagttgattttatttgagcaggccaaattatctaaaataacttgtactatatgtgttaagtggtttgctggaaagacaaatttatgtgtgtcaggattagttgtgatgcactgggattatatacgtaattgatggaaggccataatggctgacttagcttggagacatatgcttggatcattgaatttcacagcagacaactcggctcctgtactgatcgattgcatgccgaagctgtggatgtgcgtggttgccaggagtggaagatagatatttttggtagtttatttgttaggattttctggtaccttgtttccgtagatttctcgtctgcgccgtagcagtgcatatacccttataatcttatacatatcaggggttttagattcgaggacgaccccgaacattaccgatctgctatttttctcgttcctttacttttccgttattttctattttacttttatgcctgagttatagcaatcctaggatttggttgatctttaccgttttgcgctgaaaaacggttgtgcttctctataaaaatgaggaggttatcctttgctagtttactcggaaactagtcgttcgtcgtcacgtaagtacgatattatcttctttactaatttgctcgtaaattagctgtgtgattccatgaaattgaattaatctcgaaatcggttccgctagccgattttgatctatcgattttggcaactctgttaattataccgtaaatcgttaggtgatcttgtgttggccgtgaaaaagtgtcaaccagcagatcaaataataatactactactactcaggcggtcaggtcccatagacgccagtagcaacatggtgtcctccggtttcatcgagtacaagtttgactaccaacaaatccacaagctagccattggcgagagattgccagcaacaacaatctcgacaggggagcacaatgcgaagatcatgtgctacccgcatgggtttgggtacggcaatggtgaatacatctctctcttcttcgtgatgctgaaacagattgaccccaaaatcaaggtgatctttgaggccttcctgattggaaaagatggtacaccatcctcgttccatgcgaagaggactatgcagtgttgggcgtcccaggatggctacgactggtttgggtggcatcgctttgtgatgcgaagcgatctcgaatcactcgacggtatggtcacattcatatgtgggctcgtagttctgcgcaacgacgacgacggcgacgaccatgtcgccgtgccgccgtccaacctgggcagccagctcgccgccatggtgggcagcgccgtcggcggcgagacgttccacgcgcaccgggccgtgctcgccgcgcgctcgccggtgttcagggcggagctcctcgggtccatggcggaggccaccatgccgtgcgtcacgctgcgtgacatcgagccggcgacgttcagagctctgctacacttcgtgtacacggacgttctgcagatcgaaggctcttcgtcgacgagtacaactgatctgcttcagcgtttgctcgcggcggcggacaggttcgcgctggagaggctgaagctgatgtgcgcccagaagctgtgggagagcgtgtcagtggagacggtgatagcgactctgtgctgcgccgagatgcacagctgcccggagctgaagaacaggtgcatagatctcgtggtgacgaaagacaacttcatggaggtagcggtaaccaaggactactttcatcttgggcagagttttccgtcagttatcgaagagataaagccacggcttaagaagtgaacgttgaaacattatactccctccattccaaattgatctatatataacgtttagcccttttattacgtcgatagatatcataattattatttgaatattgcttattagtcttataagttgcaaaactgcatattaatccgtcgcacctcgtgcatttcttttaataattccgcgtttgtactgtctattcacgtctgagaattggttgtgttggtatttggttggtcatatgggcgtgacgacggcgggcaggtagaagacctccttccccacgccactccttcgatctcgaagtggttagcaccaatctgcaaccggtgggcttgcttgttgcacatgattggtggatgcatcgctctttcttttttttccgtttagatgttatggctgttttgggcaaatgaatgagccgaaatgcaatttgagatgctattttttgagatttgttcttgtctgttttttggggaaaattttcaatctgggtatgacaccgagttggccacggcttatggagacagaaacgcatacgcggtctcaccgatacggatgaaaatagcttcgatttttttttgccctttattttatcaccaatcgaccagagtccggagatgatctgtttacaaatcctaattaaaaatttatctgaatcccctgtcgtttattcctcaccagaccgaacaactcatcgctactttcggtagtataaattgtcctctctctcgtatgatcaaattaattctccttttgggatatccgcacgcaacaaaacatacgccgccggcgaccatgctgtcctccggtttcatcgagtacaaatttgactacctagaagcctcttggatgactgtcatcggcgaatgggtaccagaaagaagaatctcggccggggagcacaatgcgacgattgtgttccacttctactcgcatgcagggtgcaagtacatctctgtcttcctgctgctggatgagaatgagatcgaccccaaaatcagcattatctttgaggttttcttgatggacaaagacgggaaaccttcctcgcaccatgcaaagaggaccatggggccaaacatggagacagcatcgggtctccggttcactgggtggcgtcacttcgtcaagcagagtgatctacagccggatcatgtcagcgacaaaggcacggtcacattcgtgtgtgggttcatggttgtgcgcaacgacgtccacggcaatcctatccccgtgccgccccccaatctgggtgcccaactcggagctatggggggcagcgccgacggctcggacgcgtcgttcgccgttggcggcgagacgttccacgcgcaccgggccgtgctcgccgcgcgctcgccggtgttcagggcgcagctcctcggctccatggccgaggccaccatgccgtgcgtcacgctgcacgacatcgagccggcgacgttcaaagctctgctacacttcgtgtacacggacgttttgccaccattgttaggtacatccgacctgcttgagccgcttctcgcagcggcaaacaggtatgcactggataggctgaagcttatgtgttcccaaaagctatgggagctcgtgtcggtagagacggttgcaacgactctgatctgtgccgagtgtacaactgtccagagctgaagagcagatgcttcaatttcctcacggctgacagcaatttcaagaaggtagtggttaccgagggatactttcaccttggtcagagtttcccgttggttattgaggatataaaagcgaggattgaaacttgcgacttctttgagaagtacattaaaggccctatttagatctggagggctattaaatagccctatgaaatcttgttatttaggagtattaaacatagattactgacaaaacctatttcatatctcctaggctattttgcgagacgaatctaacgaggtatattaatctatgatttgctacagtgatactacaataatcagccactaatcatggattaatatacatcattagattcgtctcgcaaaatagcctaggggttatggaatcagttttgtcggtaatctatatttaatacttctaaatagcaagattccggagggctatttaatagctcggaggatccaaacaaggccaaaattaagcgggatatataagttataccgtatcatatttttgtttatgtgatgaaggttgaagaaaagtgagctacaaatttatagtcagctccagtacgggctcaaacaaactatatgagagagattagttgattagacattaattacttatgtggtacatatatatacaattaactgttgtatgggtggactattaggttggttatagataatgttttaattttggagctagtagttggctatattgttaaacttaatcttatacacttcctcgagtcataaatattttatctgtaaaataagatctatttaaattttagtttagtttttttttaaattctatccatcgacagcctattaatctttataatcttattataataatactccctccgggttgataatacttatcgttttggacaattgaatgatctccaaaaaccaactttgtccattatttttcattataatatgtataaaagtgttaacaaatatatggttttattaaagtactttttaatactaatttatacatatagtcaccatatttgaaaataaatattttaaaaataattcataatcaaatattctaaagtttgacctcacccttatctaaaactacaagtattatcagcctggaaggtgtaaaaa

SEQ ID NO: 38077 - DNA, 5450 bp, Oryza sativa
  unsure (1)..(5450): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacgttgtgttcggcagctgcgaggcgggcgactaagtcgctttcgcccgtagccgccccgccgctgcgcttcctcgcatccagctccttttctcgcgtctcgaggttagcagcctgttgctccagcgcggctctctcggcgcggatgcattccagattgcggcgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcctccagcgccatggcacgggcttcaagggcctcttcgcgccgccgggacgccgcttcagcctccgttgctcgctgctctcgggcagcggcggcgtcgaggaccccctgggcggcgtcgagctttttctttagctccgcctcccagctcccgtgttgaaggcggagggagtcctgcgcctcaatcatcgcggtggtggcgacgagggcggcctctcgctcctcctccacctctcgggcgatctccgccagcgccgccttgcgggcttcaagctccgagatgtggcggcggtgggccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggtggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccctgtcgcaagccgccccggaggttgtcgcctgagcgtcacccgagggagtgggcccgagcgacgcgccggcggtcttgtcgtaaaccgcctcggaagacgccatcgcctctgcctggcgagcccgggcggtttcctcccgggtggcttcttcagcctgacaagcccgggcggcctcctcccgagcggcttcttcagcttggcgagcccgggcggcctcctcccgagcggtatcctccgcctgccgaacccgagcggcctcccgggcggcctcttcagcttcccgaaggcgatctgcggcctctcgccggtcagattctcgcctccgttcctctgcggccgccggatcttcggcctcggattggccggacttgggatggcgggagggacgcgacgggacatcgctgaagcagaagaaaaaaccagaaggcaaacaagatgggtaaggtaaaacttgcttttgggatagaagaaaagacggtcgcaaagagagcgggacgaacctgcgagggggtcggttaaatgaccaccttggaggggaaattaggtttccctgggatggttctgtctcccccatcttgcgcagccgtttcttcttgcgctccccctcgggctgcgatgttggcgcggccccctccgggcgcctgctgtggcacgcgccgccccgccccctcggggaggagatgggggaggtattcctcccagtttcctcttcccccgggcgtcggtagggcggttgctccccgagcccccgacgcggggcccagaagcacgaccccctccgggggtagattgatccccccggcggctcccacctgcgccgccatggcccttaggagcctgctcctctgaggccccgaccgccgtcataatggtcaagatggagacgcgatctgggtcgctgcagagggggaggataccgtgagggatgagggacgcctccacggagttgagatttagcacccgttggatcagtatcttgaagtcctcgggggcccaatcccatctgaccccctggtgggtccgcatatagtcttcgggcccgatgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcaccgggggctggctcggaagtcggagatgcgcttcgtcggcgaggggggtgtagaaccagtcgctcttccagtcatcccactttttgcggaggacgcaggggatgtagcggttcaacaccggcccccgcggcaggaaatagcagccgccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggagaaagaagacggaccgccccgggtagtctggcgccgggcgtccctcacccagcattactatctcacggccggtggcggattctggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagttaggggcgcaaacggcgaaggaaaggggaatagtggcgaaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaaattccattcgcccgcttgcggcgcataaggtagatatgcggttgtggcagtcgagatagatcgtatcgtgtgtgcgttaattacgctcgctgaccgaagcgacgttaccatatctccagacgaaacgaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgattgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccgaccccgagggccgaggtgccccgaccccctgtggggtttgcactatgtacataggttgggtgaacacggtagggctcacctaaccgcatttattgcggtctggtcaagcgtgtcacgttgcatgcagcgcaatgcagcgcgctcttttatccggtctgtgaccagtcacagaccggtcggatcaacggttaggtggcgactggtggtctgaggcacgcctcgccccgtcccgtcaagacgagagcctttaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggttgtcccatcgaaatgtcattcggacggcaaccataccaatctccgtccataaagagaagaaaagtccagtttggaaaggaaagggtacatgtggtatccccttaagatataaaaggaggaccatgcccacaaagagagggggctggattttcccgagagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagcgagggcttgagatctcaccctaagcccccggccgaactggcaaaggggggcctgcgcggtctcccggtgaggagccccgagctccgtcaaatgccatttcacaattattcgaattaattcaaagttgaatctttaaactagcatagcttggatttgaatgaaacttaaacctaaatttatctaagatcaagatctatctgatggtatcacttttatcatttattttgtattatatgaatttatggtgattttatttgaattctattcgaattcaaataaaatctttcgtgtctaaatctagatccctaggaagttgatgagttgagtgaagaccagggtcagcaaggctgtgagcaaggcaagtcatctctaatctttgagcatgttaaacctattgtgaagttatgttgatttaagtaaaatttgca

SEQ ID NO: 38078 - DNA, 28417 bp, Oryza sativa
  unsure (1)..(28417): unsure at all n locations
gtaccgtcacgggttggaggatgtctatcgacaatagaaaactcaaaaaggctacaaagtcagtccccgttgctctttgttgacagttattaaataccaaatttaaaccgtcaatacatgcataaatctaaaaatataaaacatccaacatagtggtagggtttaattccagcaggaaaagcagaactcgaactacacacaagctccaagtnnnnnnnnnnnnnnnnnnnnnnnnnnnntgtgtcactcgcattgtgttcactctaatatccttcctgggtgccaaccataacttgtttacaagatttcatttgtgacttggtttagcagcacatccacccattgcagcttgatgacttgcctcctatgatttatgtagaactaaatgacaccccgcgcgttgttgcgggcataacttgatttacatagtagatttttttaaaaaaatctactgatcctcatcatcaagcatcgaagttgagtactcctaccttgctcagaaagcgtaaaaacatttgacatcaatgatgcaagaaatcactatgagagcgaagaaaattaaatataaagaccttttgatcattacgattttcaaatgaatgaaatcacagcacatgttagtttgactccatatgcatttgcatgagcttgaggtagcacattggggaatgcacatggccacaacccacaactatgtatcaattgtatacaacaaaatgagaaaaaaaaacagcttgtaaaaatagataaaatagaagaaatgagtaaagatctgcacaagctgcaattaaatctttggataattacatatccaatattattagtttttacttcatgtgctaaaaaaagtgaactgaatgatttatcatgatcagaatatgaattttcgtcgcagattttcactgcagtgggatcaagttccatagtgaaaaattaaagcattcaaataggttcctctagcagcgaatggcttaaattcaagaattgagtaagggatgttagaataaatgggctaggcccgatttttctattaaaatctcaagggccaataataaatgttaaggataataataccagcttaggaattaaaagtggagtatctcaacttaaatagggagttattggaggctccctgttgaccggtcgaggtggggatcggaaagccacacgcgcgccgagccgagccggccgggccgaggccatgggcgaggcgtggcgtgcgttgcattgggttgggttgcgttgcgtctctctctcgatccttttgcaatggaccggaatccaaccccgcgagattgcctctgtaacgggcaggcgattcaatacgcattgatcgcgtcgttactatggcaacgggcggattcctctcttgcgctattaggaaacagagacccccgatcagatctccatgctttctctcccatttctgtttccccggttctgatcccgattagatctccacgctttccttcccatttctgtttccccggttctgatcgcttgcgcgcacgagagatcggaacgagcaaggcttttggggagtgcttccgcacgactgctcctcttcttctgttcgttgtccgttcgtctgcatcacctgactgctcctcttcttctgttcatcgtccattcgtctgcatcaccatgtcttctggagatggcgcacccggaggcaaagctggcgcacctggagctggagctggcgcaccgatcgacaacaccaacagagacagttctacctcacaatcaagcgaagggactttcacagggtataacattttgtcgctatctctgtttttgttacttctgttagttgcaatgttattgcgttctctacatgatgatgatgcttattctatcttaagcatgctcctggttatgtttaattttatcactagatcacctcacattgttcatgtcatgattattgtcttaatattttggattaaaatatgccgatatatgactatatttccaacaatccaaaaacctgatatatcattttcggtagttgtctttgttgctgcactaaaaccacatacttttgatggttctaattataaaagatggaaagcacgtgcactactgtggttgacagcgatgcaatgtttctatgtttcatggggtaaccgaagtgaaccacctctctctcctgaggaggaggttaagttcgaggcttcggattgcctgttccgtggagcattgatcaatgtactcgctgacaacatagtggacatgtatatgcacaatggcttcagggaacgacatgtgggatgcacttgaggccaagttcggagtttctgacgccagcagcgagctatatgtcatggagaagttctatgactacaagatggtcgatgaccgttctgtagtggaacaagctcatgagattcagatgctggctaaggagcttgagaacaacaattgtgagttgccggacaagtttgtggcgggtggcattattgccaaattgccacctttttggtcggactttgtcacttctctaaagcacaagagacaagagttcagtgtttctgatcttattggctctttgggtgttgaggagaatgcgagggcaaaggacaacttgggcaaaaaggtcgagagaggttctagtgccaatatggtacaaaagaagaaccctcaagcatcccacaacaacaagaaagttaagcctgatgtcaaacccaaggctacaaccaattttaagaagaaaggcaagggaaaggcaaagggagactgctttgtgtctcgcaagtctgggcattgggccaaggactgtcctgaacgcaaagacaggaagtctgctaacatggtcattagcaagggcggaggaacatcggggtacggtaaaattttacctacagttctctctttttttcattcacctaattggtgggttgatattggtgctaatattcatgtatgtgctgatatttccctgttttcttcttatcaggtcgggagaggtttctccttgttgatgagaaaagggtcacttgcggctgttcatggtgttggtacggtcgatatgaagtttactttgggaaagaccgtgcagctgaagaacgtgcaacatgtcccttcaataaagaagattctagttagcggctctctactgtgtagagaaggttttagacttgtgtttgaatccaataaatgtgtcgtatctaaatatggaacttttattggaaaatgttatgacaacagaggcttgttccgcttttctttggatgacatgtgtaataataataatgttgttaaccatattagcgagaatgatgagtccaatgtgtggcattcgcgactttgtcatgtgaatttccgttgtatgacgcgcttggctaacatgagtttaattccaaaattcactttggtcataggttccaagtgccatacttgtgttcaatcgaaacaacctcgcaagcctcacaaggcatctgaggcgagggatttggcacctctagaacttgttcattccgatctgcgtgaaatgaacggcgtgttgactaaagggggaaagaaatattttatgacactgatagatgattgcactagattttgttatgtgtatctattgaaaacaaaggatgaagcattgcattactttaagacctataaagctgaggtagaaacccaagttgaaaggaaaatcaaacggttgagttctgataggagtggcgagtatttttccaatgagtttacatccttttgtgaagagtttggaattattcatgagaggacgcctccctattcaccccaatcaaatggggtagctgaaagaaagaatcatactctaactaagctggtgaatgccatgttagacactacaggactttccaaggaatggtggggtgaggcagttttgactgctttgtcatgtcctgaataaaattccaatgaagcataaggaagtaacaccattcgaggaatgggaaatgaagaaattaaatctctcatacctacgaacctgggactgtttggccaaggtaaatgtacctatagccaaaaagcgtaaacttggaccgaatactgttgattgtgtgttccttggttatgctattcacagcgtgggttatagattcttaatagtaaactctggagtacacgacatgtgaattggtacaattattgagtccagagatgccacattctttgagaatgaatttcccatgaaaaatacgcctagcacttctagtcaagaaattgtcataccccatcagcactttgcaccgataaaacacaatgatcaaacgcctgagggaaatcctgaggaggataagattgtagatactcgtaagagtaagagacaaagggttgcaaaatcctttggagatgactacattgtatacctcgtggacaacactccaagaaacatagaagaggcatattcatctcctcacgctgactactagaaggaagcagtacgcagtgagatggactcaattatgtctaatggtacttgggaagtcgttgagtgtccatatgggtgctagcctgtaggatgcaaatgggtttttaagaaaaagcttaggcctgatggtacaattgaaaagtacaaggcaaggcttgtggccaagggttatacccaaaaagaaggcgaggaattttttgacacctactcaccagttgcccgtttgaccacgattcgagtactacttgcattggcagcctctcatggtcttctcgtccatcagatggacgttaagacagctttcctaaacagagagctggaggaggagatctatatggatcaactagacgaatatgtactagaaggtcaggagggaatagtgtgtaaactgttgaaatccttgtgtggccttaagcaagcatctaagcaatggcatgagaagtttgacaccacacttatatctgctggttttgtcgtgaatgaagctgacaaatgtgtgtactatcgctatggtgggggagaagaagtgatcttgtgtttatatgtcgatgacatattgatctttgggaccagcctcaatgtgattgaggaggtcaaggactttttatccaagagctttgaaatgaaggatttgggagaggctgatgttattcttaacattaagctactaagaggagatgagggtatgattacacttgtgaaatcctactatatggacaagattttaagtcgctttggctacagtgactgcaagccagctgctactccttatgatcctagcgtgctattaaggaaaaaccgaagaatagcaagggattaactgagatactcccaaatcattggttcattgatgtacttggctagtgcaacgaggcctgacatatcatttgctgtaagcaagctgagccggtttgtctcaaatccgggagatgatcattgacaggctctggaaagagtaatgcgctatctaaatgacactataagctatggaattcacactaccgggtacccaaaagtactggaagggtatagtgactcaaactggatatatgatgctgatgagataaaggccacaagtggatatgtgttcacacttggaggtggtgctgtttcttggaagtcttgcaagcagatcatcttaacgaggtcaacaatggaagcagaacttacagcactagatactgcgacagttgaggccgagtggcttcgtgaactcctgatggatttgccggtggttgaaaaaccagtgccagctatcctaatgaactgtgataatcaaacagtgattattaaagtgatcagttcaaaggacaacatgaagtcatctaggcatatcaaaagaagactgaaatatgtcagaaagcagaaaaactccggagtgatagcattggactatgtccagacggctaaaaatctggtagatcagtttaccaaggggctactgcgtaatgtgatagacagtgcatcgagggaaatgggcttgatacccacctaaggttgcacaatagtggaagcctgtccattgtgatcggagatcccgtgaatttggattgcgaaacaaactattgtgtggctgagagaagagactcttgaaaaggagatattgaactatatgccacttttagatgtggcaattaactatttgccactggacccacatgtcatagacacatgtggacctacatgtcattgagataggtgtggcaaatagttaattaccaaatctaaaagtggcaaatagttaaaagcccccttgaaaagggctcattttcatgatgtacttctcttctattatgcatggtaggatggcttatgccttaatgtggttcaagtggcttttctaagcagagatattgacctgcaaaacatctcagaaggaacacacctatatgagttcgactgctagtcacagtctatgagatttgggcgatctctagatactcatgaaagggcctggagtttgacttatatgctccaaacagagcggatgcaaacggcagcccagtaccagtcaagggtttgagtgaaacctgctcacacaagactgacaattcaaggcatagtccattgttcagttgtggtctgatgtaactcttttcctaggtggaagttcaacttaacagtctccaccaaaacactggtatatcaaacaggttgaactttgagaacatttcttatgagccatgaaatttgttggggattgttagaataaatgggctaggcccgatttttctattaaaatctcaagggcccataagaaatgttaaggataataataccaccctgggaattaaaagtggagtatctcaacttaaatagggagttattggaggctccctgttgaccggttgaggtagggatcggaaagccacacgcgcgtggcgtgtgttgcgttgcatctctctctcgatccttttgcaacggaccggaatccaaccccgtgagattgcctctgtaacgggcagacaattcaatacgcattgatcatgtcgttactgcggcaacgggcggattcctctcctacgctattaggaaacagagacccgcacccagaggcggagctggcgcacctggagctagagctggcgcaccgatcgacaacaccaacggaggcagttctgcctcacaatccagcaaagggaatttcatagggtataacattctatcgctatctctgtttttgttacttctgttagtcgcaatgttattgcattctctacatgatgatgatgcttattctatcttaagcatgctcctggttatgtttaattttatctctagatcacttcacattgttcatgtcatgattattgtcttaatattttggattaaaatatgccgatatatgactatatttccaacaagggaaacctaactacttaaatcatagccaaggtgacaacatcctgaaactaataagtcatgtaaatctataatcatccaaacgattaccctaaagatgtacaatagtaaaaatataattttagtgcagtggtgacttatacctttgagagattaaaaaaacagaggtcatcaggaaactatgatgccttgtgaaagctacaatttatcgagcagaatcagtggcagtagaccgccaccgttattgaaagttgagagtggttagctcgaagctgcactactgatgataattaatggccagaaacatcagagatgatgaaaaattcagtttgcagcaaagcaatgaaacaaatgttgtgtggtgctcaaatgtctaattatactcatatagcaagcaattgatctgacatctggatatatagtgacatttatgcatgtgtatacaggttgtgcacttgtgcgaaaggatacagcatagattcattaagtaaattcaaaggaagatacacatagaaaatgtcagttacagatgatgagagaatcaggctgagcaacagggcaagtacatggtacttcttgttggtgatgcgatgggatcaggggaagatttcaagtgacgcagaagaactatatattgatcggacggtctatatatattgagagtaagctggcagctagatcgacgataatgatcgtgataatttctgggttagtggaggaagatggagaggattacatggcgcaataaaaacaaaaacaatcgtggtgatgggtggaataaaatggattaaatgcgatcattcgcctgctctttcatggcgacagtttcagcattggcgaatgatttccatgggtggaaggagcgcagctttaccatttgattaggaggtgggtctacctgggctgacccagcaatttgggcacgttttcttgtaggtaaatgaagatctaatggtatatatctgatgtacatattgatcgaatggctgatatgatgttaatgacgtggcgaattggaggtagctttgggttttaactttatagaaagaagggataggcaaggaagaaacccaaaagcataaatatttaattagttccacggaatgagaaaacaatttatttctaaaacaacactaatatctaatttggcagatagaccactgaaaaaatctattgttcactgcattccaaacaaatcgagaaacttaaccacatgtgcatgcatctcctgatcaactcatcccccctttacttaatcatctaaaccttctttcagaacttttgccacggtataaagggtatgatattttcatgcccacaaagatgcagcttaatttaacatacactcacctccaccacaggcagcgcatcagtccaactccctgacttaataatctaaccttcttccgctgcctgatgcttgccctcgctgacccagccgccgccatcagctggcgcacgtggccaggagttaggcggagggggacggcgacagcggcgcataagttgatgagacctgaggtagggcaattgtaggtgagcgagccgacggcgtggaggagaggtgattctagtccaatggagacgagatggggagaagggaaatcacggccagagaaaggcgaaccgtcctgctcgatgactccgctcaccctaactgagccttctcacaatgcgcctggagccgagcggcctgaaccggatcccgactccatccacgcgtcgggcatccgactcgggattgcagggattggggtttgcagctggtatccacaacgtgcgcaggcgtgaggagacgtgcggagtggtgggtcccacgcagagtgggagagtgctaattggatgagagcaaggctaataatacagccaactacttactgtatagatctttatggcatatctatcagctcactcatatagtggttagctcttcagtataaatatatagttcatctatctatttcatagattttcttggttcctgtacctaagccagctgtaaggttacagcccgcttctcatctctctcctttcctctctcatacacctcagcatttagccttcttattgccctctattatacttgctctgatggatccaactcttggtatgaaccattggatgaatagatctaagagttagaaaatgcttgttttgatgaaactggtgtgttttatattagtagagatagagatgttgggtgactattgcaacttgattcttgtcctgaacaaaaagacacaagctcatcaattaaggtcaataagcagcagcatcgcatgtacctaccctctcaccaattaggagaccgcatcatctcggcactctcgccaggcaacaaccaccaccctacgcctagaagggtgttggttgggcgctggagtgggaagcgatgacggtgccgatggcctagggcatgtgcaggaagaggcaacggcttagtatgcgcgagacgggcagttgattgggccagtgaggcatggaaggaaaccggcgagtaaccgcatcagtgaaagccagggacaagactcgagcccccctctccctcatagcgcgaccaagatgtgccctcgtgatcgacagtgtgtgcagtggaatggagactagagagcatgcatgaggcggtgggctaggggtgagtgcagtaggcggtggcagccgggtagggcaagtgtgggaggaggcgacagcggcttagtgcgcacgatggtagcggtgggctggattcggtggagcggcgttttctggaaggagtcaggagtggagaagtgttattttttaaccgaccactattttggcggtgtgtagtggacatcgaggggagggatccctaattgcagatgttgaatccaactcgtaatatggaacaatgttagattaagagatcctatggataggaaacatctgtgtacatttttctacgagatgaaactggtatattttatattagtgtagatatagaaataagagaatagatgtatggggagtgagttcagtcaatgacaagtgggttgagatgagaccttgttaatcttaccattttgctagctagctcacattgtccaatagaaaacatacagtaactatatacgtctggttcagcactgaacccaacgaaccactgaccaacttggtgatgggtcgaccaccggtccagtttttttcactatggtgtccacgaaacactcgtccgcgtcaacaaaggtgggtgcatgtataaatagtcaaatgggccaccagacacgtcctggcccgagcatgactcgaggaccgaccaacttgtcatgacgtgccgtgcccgcccaccgactacacctacggcccaggcgcggcccaataaagcacaggttgtgccatgccagcacaaaggcacgatcagcccactgtgctcgtccttcaataaagtctattgtacctcactcatttctttggtccatgcctcatatggctggaataagtttattttacctccctcatctctttggacagtaccttatatggctggaataagtatatttttctcccttatctctttggcctgctgatcgttgggccgtgccgtgccaggccagcacgtcatgctgagaaaaaggcctaggcatggtccaacggtcaggccatacctaggcagccatacattggtgaggacctagcactatggctccgtttctcctctagtcgaatgcgtcgaaggcctcaagttactgtcttatggggctggaataagtctatttcgttttccttatctctttgggcatgttgatcgttggggcgtgccatgcttggccgacacgtcgggctgacaaagaggcctaggcagtaggcacggcccaactgttgggctgtgctgcgcatgtgccaagccaaatctccatgctgtgagtcaggctattgggctgcaaaccttctggctaactataggcgcctaggcggtgacacatcggtgaggacctagcactatgactttgtttctcctactagtctaatgcgttgaaggtctcaagctaatgatatggcttttcctcgtcattatccaattagagacaaacctactggatgcatggattgctcatcctcgttgtcctaggagtaggggaaccgaggaaatgatcttggcgaaactgcagcagatgtgaaggggggaaggggagaagaaaatcacgccttggaaagagtgattcatcattcaaagggacaaattgagtgggcccgaggaacaacgatgaaaattttgtggtaggagagaggaggacagtacatttgaaggtggcatatggacttctagatacgattatgtttccttttttgcttctcccgcgataacaaccatggacggacttcacgctatatgtgcattcccaagccagacttgtagatgacagactaaacgaaccaactgtgtgtaacgaatcatctttatttttataatagataaagataaagacataatagatagatagatagattgattgataaataatattaatatatactcgctctgattcatattataggtcatttgactattttactactttaggtcgtttaggtttaaccaagtttataaaaaaattatcaaaatctactatactaaattagtttcattaaatgtaacattgaatatttttagataatatgaattattctattcctctcttccttttcgtaaccgcagattagtggaggcgggatagctaattgcaggggtgatccaactcttgatataaaccgttggatgaatagatctaagggttaggagagacaggtgtttgatgaactcgtactttttatagtagtatatatgaaacggagggaataatagatatgtaacgtaggccgctccaaggttacaagaggagtttaatttaattattttcttttatcttttccgtcataagtaatagaaacaaatttataaaaagctcacattacaaactataatgagcgaggtaactttacaagttaaaagtatgtgcgcatacattaaagggaggggtgtattttacaattaaagaactgatgaaaatccaatagcctgtgcagatgaacaggtagacacaactgaatacaattacatatattgtagtactccactaagtaaaccgattgtcccactaaattagatgtgcacaactagatcgatcagaaatgatgaagtgacagtgataaaaatgtgctttggtgaccattagctgtttaagaacctttgcttgaaatgtgtggcaacaactacagcgaactcataattgtcaagctcttcttgtcatctttgttcaacaaaacggccatctccttcttgaacctcgccatggccaccctgggcagcagcatcgacaccaccgtcgacacctcgccggccgagttcttgcacctcgtgtggtcgcttccgagcttggaggtgagatcgcctgcgagcggtatgccgccgccggcgaactcagcccacccgaacttgagcaagttcacggtggtccacttgatgtcggagacctcgtacaccctgtccatgctcgacggcggccactcccgcagctgcgccaccgtctccaccatggcgctcatccgctcccgcgtcatcccgcgcttggtcctccgcacgagctccaccgtgtcggcgagcggccgcccgaggaggtcgccggcggcggcctcggcgacgggggagacgtgcgcgttgccgtagaagccgcgcgggagcggggtgtgcgcgttccacctcccgcgcgcgttcatggtgatcattagccggacgcggaggtcgggcccgtacccgagcgccgccgtgcggcaccgccacatgacggcggtgagcagctcgaacaccgtggtggagtccgccaggtgcgccggcagctggccacgcaggtaggacacctcccgtggcccgaacaggaagtactccaccaccatccggtccggcggggtcgacagcatcgcgtcagccggggcggcggcgcggcgagcaccgttctgtagtgccgggctcgacgccgaggccgacgccgccgccgccgatgcaaagggcgtgcgtgccaccgcgccgctacctaggcgtgctgccgtgagtaggtccctcctccatacgggcagaatggtcggggctggctcaccacgtgcgaggtcggctatggccatgatcagctgcgccatgccgaagccgtcagcgatgttgtgacagatgtggaagcccaggacgaatccgccgcatttaagttgcgtcacctaatgaaaccgccacatatagaaatcagtaacagtcaaattaattaattaattagacatggtaagtatggtacctccatcctaaacacttctatatgacattggtcagctcaatcagaaataagaaacagaggcagtatatattcttataaaacattaaaagaattcttccgtgctcgagtattgtcagtattatgtgaaaatccgaccttttatgttagtatgaatatatagtcggaccatgcaacttgatcccatatgtatatgtgtttatatatctgtacaaattcatatggatgctagtgaatttaaatgagggatggagaagctaaaacgttttataatattgaaaataatacaacacaacattaccacattcttaattcgcaatcttaatattgccggcccatatatatatcatccaactgcaacatcacactccagttggaacccctcttgatgggcccaaagccagtccaactaatcgttgtgttgaataaccatttcaatgcttttctggtccaatcccattcaccactacttcagactaaatcttagttaatgtggctgttgtatttgtattttaagtttttgttatcaaaatatgatgccacattcattgtatttctcatgtttgtggcagtgttcaaaagaaaagcagtttggcaactgaaaactataaaaccaattgcacagaaaagagatttgttaactccagaactaatttgtgcataatcaaatctgcaaatctaaagttggattatttcttgcgtaaatgaagatcagtgggttgctgtaattaatagtaggtacaatccctaccaaccatgcacgaagctaccatcactgttctcgtaacaatgtggcgtccttacgaatccttattaagatcacggtccctagtaccagtgaacctaaacccaaccaaagtaatattgttgtcgaatgaatgaatcttgatccatgcctacaaccaatccatagggtaaataagatggactgtaaattaatcatgtcactaaaacacaaataaagtatttagctacccctccaccataaaatatagcgatataatactggattagagacatcacaataaatataaatttaaatataccacagttcagatctgtaatattaaaatatgttttatttagttggttatatcttaggacggatatatagtagacaggttagttaaacattaactgagtggtggattgtaaacaaaaatgaaagaaacaaacgtacgtcgtcgtgggtgttacctgcatgaggagcaatggtttgccaacgacagccctggtgtcgccggcgtcgcagagcagctcgccgacgcacgggtacggcggcagcagcggctggccgaagtcctccagccgcacgtcggcgtcggcctccacgaacaccaccccttcggccgtgcagtccaccaccagccggttccccgcgccgccgccgtcggcgacctccctcagccggccggcgacggggtagtagtacaccagcgcctccgcgagcgccgccctgatggccttggccgggtcggccggtgcgccaacggcgccagctgcgccgccgtcgcatcggcggaagaagccgaccaccgtctcgtagtaccgcagcgtccgctggtcgtcgaggtcggagagctgcttcgtctcccgcggcgtcggcctcgccggccggagcagcaccggctcgctccggcgagatgtgaaggtcaccaccatggcgttggcacactttggtaatgcgaatgcagcgaggttgggcgatgctatctatgttcttcggtggttcatatgtgagcttgcttgatggtggcgcacggatacgtcggttttatatccatctgaaaattaacattggtttaattttctcctgtaagtaacacttggagaatattaaatgctttcaaccattaaccagaatttactctggcagtcgtttctagggctaattatacgatttttatcacttataaaggcacggccccaaaaaagtaatggacattcatgagttacagcatattcatgaaaatgtatattctatctggtcataaatatttactacttaacataagatttagataaaagacccatgtcaagttgaaccgaccaatgtacccttcgccaaaaactacttgtgtactggccatagctgtggagttattgcttgaatccgtatagcacgcccactttaacaaactcttgtccactggatgtaagcgataatgggggccctttggacaaagagatggtctgacgagcaggaactgccagtgaagtgaactaggacatacatgaaagactcagacttggaaccccatccagtcatgcaggagtccaaaacaatcagacgttgcgttaagggcatgtactgctgctgtctgattaacaatgggtatggattgactcacttgcttaaactaaatgaagtaaataggcattgcaaacaagaattgttttgtttaggctgagtacgtatgggcaactataagcaatattacctccttgttccatgcaaaagttttatgtatagacgaagttcctagaatataaaagaataaatcatttttgtaagcttatggtaatcaacacccgatttatcacgcgctcatgacttgcctgatttcacataccgtcgaaaattctaacccaaccacccaaacgaactcaaagtatactccggttcaacagtaggtaatatcgagtaaatttaatgacaaataatacctccattcaaaccttatgattttaaagttctataacaaatatacgattcatacaattcgccctggtaaggacctaccattttctatatattcggctgcgctattaattaagtcaattcgatcttcgatctatttactgtttcagtgttcgatcgcatatatggcctgttgtccaatggacatagtacaacgcagaggagggaattaactaaaactaccggtaggagagaatgccagttggaaaagatgtagatatgaatgccgatcgaacaaatcctgtacgtacaccaactgacatgtcatgtacatatgctggcttatctgcattaattgtatctctggaaactctgatccggaacgcattctatgtatactccgcgcaaaccatctactccctttgttttaaaaaagtgcagcatctagttcaaatttaaattagaggactgcgcttattttcagacagaggtaataacaaatttcaacaaaaaaaactttagagagaaaagtatgcatgtactgtcaatagtattaattatacctatatataaagtctcatcttcaattcattatatgttagcaaaaaaaaaaaacaaacttctatcagtgatatactcataaaattatcatatttcctttttgttatggctagaatataatgaatttaaagttaatattttatagatatatacaacactattgaaaatacatgcacaattttcttctagaactttttattggtattagttggtgtgcacggagtacgggttgtaagcttgtgctctcatacttgtccatgcatatatagctagctctaactcatcagagatcaatggccgccggccaggacatcagatcgatggagccagccaggaaatcaaatcaatggatggcaattggcatgcatgaacactacaaccaccacgttatgtttgcaggttgtgtgcatttgatgtcattgaatgtttcatttcttttccttttgttaacttgttccattgctttgtaaaagtgggagatcccgcgtgggtgtttttgcattcatggttccaaatctaggtagttaattacatgtccatagcatgaaacctattaacgacaaactggcaagaagagtttaaaattaaaattttaagttttgtcaaattgtataaaaaatcacttgatattaatcggacatcaaaatcatgagttgaatttaccaaccgtcgatccatgcgcgagattgagctgtggccgttctatttgttgccagtgtcttctccgatgacgaagatagtgataatgccaccggattagggttcgaggtggctagttgaggtggtaagaggagattaatcgtgggatggtaggcgcatgagagaaaggggctgggccggtgtcggcagcaaggattaatgatcatcgtaggagtggctagcccgtggtgcgtcgtgaggaagagagttgaatggaggggaaagtggaggaatggaggttggctggatccatggaggggaggaaaggagaagagaaaaaggagggggaggagagaaaaaggtggggggtcggggaaaaaagagaggagctcatgaggcgctctcttcgcgcgaccgatgcagggactcaggcggaggatagtaagcaccacatgtgaaaatcgattctcacaggtgagttttgaccggacaccctttatataattttgcacatggaaacttttttagccttgtaaaaataaattaaacggtggctgcgaaaattatttgtgtggtagtgcatcatcaggatgagattttgggcagagtaggaggataagttagggttataaagtttgcatgtaaacctgaccgttagaaaggtgagtgccatttagcatagaatcacttgatccgttttttgaatcatttgactagaagaatagcgacaaacttccgtgagtgatttaaaattttcgcaacaagcccgcattgcatccttttccaatgatgcaaatttatcctctgcaactaattaatttgcatttcgtgatgaggtggttacaaatttccattggatgccaggaacctgttgtggtgtactccctccgttttttaatagatgacgccattgactttttctcacatgtttgaccattcatcttattcaaaaaaattatgtaattataatttattttgttatgagttgttttatcacttatagtacttttaagtgtgatttatatcttatgcatttgcataaattttttaaataagacgaatggtcaaacatgtaagaaaaagtcaacgacgtcatctgttaaatggaggtagtatataattaagatctccaagcccatgctataacagatcctgttcctacgttatatatatatatattttgagcactgttcctacgttatatatgtccaactaacgcatcctactacattctatcgtccaattaaagccaacaaatttatcggctcctatgttcctcgttaatttgtacatatactactgtagctatagtccatgcgtgcacaaacagctggtagttagcagttacaagttgatcagctgcatgcactgtgtgtgcatggcaatgtggggttcgcacacaactagataggtagatctagtatgggttcatcggtttcatggatgcatgtacgtagtaccaagtggaaattaagaattagtctaggcataatggtataaacagtagtgtacagcacgcctcaatatataatgttatttactgttgaaaagctgttattattaggggcttatatatagatacacccccatgaccccatagatgaagacttcacgctccttgaagcaaagacgagcttaaagttaacagccactatgtcaagctcatatatatctcgtatactccctcggtccctccaagcttcaaattacgctttaagcttatattaagtcaaacattttaaattttaacaaaaattttcatatagtttaacatcagaagattatatttactatgagaaatacttttgtaagatataatttatatgtcaaaaatactgcatatgtttgacttaggacatacctcgaataacaatataatttgaaatggatggagtatgtagcaaaacgtatagagttcaaatcaacaacaaaatcagcaagattaaccttgcagtgcgattttgaccttgttcgcacgcaccaaataagttcgtgcaccaaaataagcattttacaagttcatgtactatattgcacctacctgacaagttcgtgtaccgccgatgcaatttactcttaatactaatacaaataccttatcttttttccattttttcatctttgagttgagtcggaccatacaagaatacgaaaataaaattatcaacaatctccaaatagaaacccccggccaaacctatgctactcatcctagatctagaggaaatgctagtcaaacacagtagtgtcagtttgccacatcagtatcctctttgatatcctctttgatttcaaacaagctaactactgatcaactagttacttttaacactacataaaaaaaacagtgtggttgctccctaacctagataagaaaaatctccaataagtaatattagtatcaattcgttacgataaccggcactaacaacattatttttctgtgtaaaattttcaaatttgggttaggttatgaactgacactgatgacccttatcatatatatttatacaaatttggatatgaacggaactttttcatctggaccagatcatttgagacaaacttttgtgaaaattatagctctcgatgagatgtccaattttctattggacaacttttaagtttgatgccatttaagggctcaaatatgtgtgttgtcgaaatgacaaccgcatacatcgaaagacgtggttactcaacagtggtaggaagaaaacgaagtgtattaaattttgagtttcccttctttccttttttcccattacatggccctagaggactatttatagccccattataggttcttactagtaggctctaggttatacaggggaatttacatgattacccttatgaaagggacatttatagaggtacatgatgatataggggctcatgggcccctgatgggccgtctggcgatcgccggccctattgcccctaggcttgataggccgaaaaggcttcttcggcccttgcgggggtgaacttgccaacgcgaagtcatcttccttcggcagatagtcttcgccttgcactcttcgcctgagacgcctctggcctggcaaggcactcgtacgactcttcgccttccgccgttcttgccccatagccttcgccatgggtttcggcagatttggtcgaagggcctcatgccatccgccaacaagcccctcacgggcaagggtgagattggagcttcggccgagaccgtgcaaaccatgtggtatggtatgcggcgccccctttcgaccgatgctcctgccgaaacctacattattcctgtgagtgaagtttgttatttgtgcggctggtgttattttgccgcgcttcgcctcctgcgtttggtggcatattcatatatatatatatatatattatatacattttttatatattttcttttcccggaccgaaaggaacagtattgggctttcccttcgtgggcttttcactgtgccgctcggacggtgggaagttaccgtttcgcctacccttgcgacacgtggcactttattactggtgggtaggcgaacgctcgcccgggcgagctatatattctcaccgacctttccttttcaccgccacacttgccattttaccgcgtgcgctctcttcctccgtttctttcttccaaagcatctcttgacccctcaagcgtttcgcccattctctttcttcgccaccgcaaacgcaccattcgccatggcccctcgcaagccaaaccctgcttcggcgaaagggctggatcccggccgagtcgatgacgacagcaccgtctttttgggggtctctcttgtggacgacgtcgagctggcgaagctggtcagctctggggcgttggtcgaggggcaggctttcgccccagtgaaggccgtggtgccgaaacctatcaacaatcggacggtggtattcgccgtcttttttgaagcagggctacggtttccctgcaacgtgttgttgccggagatccttcgcctcttccaggtggaacttccatagctgagcccgttggcgcttgttcggatcgctatcttctactgggcgtgccggacttccgggtttgagcctaacgccgagctcttcggcgccatatttttcgccaccgtgaactcgaagacggtgattaccccggctagaacgaagaagacagtgttcgggagcatgaactttaacgttcgtcccgagtggtccgatctctggccggtgaacgctgccatgtcaaagtgggaccaccattggatggctaggtggttctatcacaccatccccttcgaggctggcacttactcggcgaaagccctccgttgccggcatagggcgatcgcgcctaactggaaacccaagatcgccgtggacggcgctatggaggcgcggttcgttctactgcggaaggtttgctcccgccttagctgccgtgacttggtggaggaattctgtatgcttcgcatctttcccctctcccagtcatggcaagttacagttgatcaaggcgaagaggttgacggtttgccgaacctgattcttcctgaagggacagacagtaagactgttctcttgccatacactgctgtgctttgttatcttgccttgtctaactgttaacatagctacacactttacttttgcagcgttgaccctcgaccaggctgaaaacgaggcccgcaggatgatcggcgacgtgtcggtcgtcgagtatagccagttgctaacacgacaagcggctgggcgggcgaaccgggtttacaacggcgaattgcctcctcgggcaaacccccacaaagctgacgacgatgcagggccttcgcgaatgtgaatgtgcggacaagtgaagcttgcccctaggagaggaggaagaggaggaggccgtggctgataaggccgcgaacgaggcgatcgaagaccgcgtcgacaccctcggctacactcctaccccaagtcctggtcacaacgagaccggggtggagtttaacagctcccaccttcgacggaaggatttggaaggggccaaggccctagttgcgttctcctcgggcaaggcggcgaagggaggtccggtgcagaagatctctaaaaagaaaggactcgtcgacatcgcccgcgttttcagcgacgacgaatcttctgacgggactccaacttcgcccgctggccgcagtttagacctttcgactgctcccctcgctccgctcggcgttgctggggcaggcggtaatgccgccggggcttcagcctccaccgaacggattgtgtcggctgtggcgagggttttcgggagccctctgcgtgagccagctatttcgccgctagtcaaggcgatggggaagtgtgcggccaccgaagcatcttccaccggagtattcccttgcggcgccccacttcgcccctggtgatttcgagactcgggtggaccttattccctttatggagggggtgagcaaccttgtcttgcccgccggcaccccgagcttattcaccgaacttaatgagttcgacgaggggtgttccgccattaaaagcctggcggttcgggtatgccttttcttccttcttcgttttcctcttcgtcccttttttttttacgtctgacaattaaccttttgttcttttcacccgctcctatctttcatctagattcttgtggctcactgttcgacggagcgaaccgtacgggcccgttttgacggttttaagagccgtcttcgggccaaggacgacgaaataagccgcaagaacctggaggtggaggccctggccaataccctcaaggaagcgaaaactgaagtcaaacgccttcagtctaaggccagggccgaggttgatcacctcaaggccgaactggagaaggagaaggaccattcagcagtgctgattgactactacaaccttactgagccgaagatggaggttctttgcctgaaggctagtagggccgaagcgagcgccgcggaggagtcgcagcggttcacaggagatggcgaagaccaccgaatccgcgagaacggcttgccaaacgctccgcctcgcccttactgacatgggcgcgaaagtgcggggggtctctgctgaggatcggtttcggactgcgccaccgcgtacggcgattgctgtgagcatgtatcggcggccttcaccttaggacttttgcaacagttcggctgcgagcacgtcgccgagttccctacctatgcgaagggggactgggagattagtgcgcagaacatttcgcccgctcttcgcgcgtggcgaaaacagttctggcagaaagatggccggtccgctgccaaagtgcgccttctagagcaactagcgaaggcggaggcggcagatcagggtgaaggaaagggcacgacaggcgaagaggttggaggcgatgcccaggatcacccagaggttttcctccctcttctgcgtttgcctggagaggcgaatgatgtacattcggcaggctgccgccaaaccttaaaaaaggcttttttgtacaattggaatatatgacacaatcttaattactttttgatgatcgaagtctttggcatattattatttcgctcatctcgcattatgccatacctcccccttcttcctcctattcttactatgtaagctgtgttttgctttttctgcactgtccatcagggggttcgccaaaagtcatgcatccggccccctttcgggagctggcgaagtcaaaacaagaaatttgtggcagtgaagggtctgccgaaggtgcgatgtccatttcggcctatttatcgcgaaatggagataaacggtcgcagctataaggttttcatggttgccgactggctgcgggcgcaccccgggcgaaccttagaagattacgatcttgttcattcaagacgtttggaggatatggctcgctttcggcgaaaccatcagaagactaaacgtcaggaaacgatctttcaacgtcgttacagtttagtctgtgtttcgccccctactcctcttaaggttgtgtattatattagtagtgatgatgaacctagttcgcctgatcattccttagggagtgatagtgattatggggacgaagatgtaatttacatgtaaggtgaattgtatcgtgttgtgaaacttctattcttcgattattttttttcgaagttaataaagacgtgttttatttccttttcgctattgtttgcatcgtcacattttgtgcttttgttaggtcggaacatgccggcccctttgcatatattagcgaaataggtgtactgactttttagcttttcgtcgttcgttttcgatctgtagcattctgtgttgaaagaaacgcttttgcttttatgctgatcgaacgtaacatcgttcggctatttattttccgagacaagctgttgcggtttcaacgttcggcgagcgatgcttcggccgattcgtttcgcccccctggcctttttcgctgatcaggcgtttgccttggggtttttccacaaattatcaatcacacgaaaaaaataaaaagaaggcggaggacacatagattttatactggttcgggcctccatggtggataatagccctacatccagttttttttcttttttctctctttcttctttttttttcttgctgaaaggctttcatagtgccaaagggcttacatagtgccgaagggcttacataacagtatgtacatttttacaagttggcgatttgggtgccacccattctagacatagaagcgctttagagaggtggcgttccaggaatggtcgaactcctcgccttcgagtgtcgctaggcgaaaagatcccgtcctggacttgtgtttgatgaggtatgatccttcccactttgattcaagcttgccaaccgctactgggttcgccttcttccttaggacgagatgaccaggcatcagctccgtgggtcgaactttttgttgtaagttgccgaagtgcttgtggtgtacttgtgcatgtgctcgagtgcttcgactcttactccttccaagagttcgagcgatacttcgcatccctcttcgcccccagagaacatcacccttggtgagttagcccctagctttactggggtcattgcctcatcgccataaaaaagcataaacgggctaaacttggttggtcttgtgggggtcgttcgaagggcccagagaactgatagcaattcctctggccatttgcctttcgctgccccctcgagtcttttctttagtgcttctaggatcttgccatttgtacgttcggccgccccatttgactgcgggtgtgcgaccgacgagaacctgatttccaggttaagcccttcgcacatttctctgaacttatcatagtcaaactgcttgccgttgtcagtaataaactcttttggcactccgaaacggtaaacaatgtttttccatacaaacttctgtactgctgccgaagtgattgccccaaggggttcggcttcaatccatcgagagaaatattccacagctacaattgcgaatttatacccgtttcgcgccaccgggaatggcccaatgatgtccagtctccatctggcgaagggccatactggtgcaatgggctgcagatcatactggggcgcggcttggcttcggccatgacgctggcaactttcgcacttcttgatttgctcaacacagactttcaacacagtgggccaataaactccttgtctaaatactttggaggccattgttcttgcagcctagtgcacgccacatagaccctggtgtatctcctttgccatttcttcgccttcggcaaaagagatgcaacgaagtaaaggttgaagtaccccaaagcggtaaagctgacccgagaccatcttatacttcgtggctctgagttgcaaatgcttcgcttctgcttcgtctaccggaagccagccagtttcaaggtgtttcacaaatgaggttcgccagtcatatgggtcttcgcccagtttctcctggtcgattgccatgacttccaagctgtccatgggcacacttggagcatgtaggactttgaaaaagatgccaggcgaatgtgggccaccacaagcagcagatttcgccaaggcgtctgcttcctcgttctggtctctaggcaagtgttcgaccgttatgccggtgaagcatttttccatggaccgaacagcctccagatacctcttcattccctctttttttacctcgaaggatttgtcaacatggcctgctaccaacttggagtcagttcgaattagcaggcgccggactcccagtgctttcgcctttcttaggcccaggagaacggcttcgtattctgctgcattgttggttgtgtcgaactgcagtcttgctacgtaccgaatcggcacaccattcggcaaaaataggactgccgcaatgcctgctcccctgtgcgaccacgagccgtctgagcacatcacccagaattgttcggcgggctcggggtcgggggcaagtaccggtgtccattcagctacgaagtcggctagcatttaagacttgatagcagagcgtgcaacaaaatttaagtcgaacggggatagctctgtcgcccacttgctgagccggccagtgacttccttgcctcggagtatttcgcccaagggatactgtgatggcactatgactttgtgggcctggaagtagtgcttaagcttgcgcgatgccatcactagggcgtcagtgagcttttccatttcaatgtaccttgtcttcgctccttgcagtgcttcggagacgaagtacaccggtttttgtccgaactctgtttcttggacgagggcagcactgactgccaccggcgaagctgctaagtataatagcagttcgcttcctgggggtgggcttatcagaactggcgggctttgcaagtattgctttagcacgtcgaatgctgcttggcactctggtatccaattaaactttcctgcgcctcggagggtcttgaagaagggcaaacctctttcggctgcctttgagaggaatcgactgagtgccacaattcggcctgcaagcttttgtacttcatgtacgcttgacggaggcttcatttgctggatggcatcgattttctcgggatttgcctcgatgcctctttcggaaacaaggaaacccaacaacttgcctgcgcggacgccgaaaacgcacttctccggattcaaccttgtgcctgctgtgcgcaagctgtcgaatgtctcctgcaggtcgatcgcatggtcgaaagccttgcggctttttacgatgatgtcgtcgacataagcttccacattctgccccaactgcttgccaaggaccttgtacaccagcctggcaaaagttgctcctgcgttcgttaagccgaaaggcatcctgaggtgacaaaatgtgccgaatggagtgatgaaggatgttttggggatgtcgagcgggttcatgtggatctggtggtaaccggaatatgcatccaggaaactcatgagctcgcatccagctgttgaatccacgagctggtcgattcgcggcaaggggaagtcgtcatttgccgttcaggtctgtgaaatcgacacacatgcgccatttgccgtttgacttccgcaccagcactggattcaccaaccactccggatggtcaatctcttggataacccccgccctgagcaatttttgtacttcggctttcgccgcttcttggcgatcggcagacatcttgcgcaacttttgttttcttggcttaatgtccggcttgactgctaggtgatgcatgataagatccaccgggacaccccccacctcgttagggctccaggcgaagatatcgatgttctttttgagcacctctaggatactctcaacttcttcttcgcccatgtcgcccccaagtgatacgagctttgtggggtcggcatcatcaatctacacttttgttatcttgccgtgaggggtgggctttggtgtgtgcttcggccgttcatgcggttcggtctcaacactgtgcactgctctgttgattatggctagatgggctgcaggaa

SEQ ID NO: 38079 - DNA, 18782 bp, Oryza sativa
atcacccctgtcgggccggcatcttgagcttgagataattgtggtgggaaatggcttcgaacttgttcagggttgcacggccgaagatggcgttgtagttgtacgggatgtcgacgacgtcgaacagtatttgctcttcgcgtctattctcccccgagccaaaggctatcagcaaaagtgtttggccgagaacttgaactgcttctctgctgaaaccgcggagcgatgctggtgctggggtaagggcttgggtaggcaaccccatcttggcatatgcttcagcgaagataacatcggccgaactccctccgtcgaccaggattcgtcggacttcgaaaccagctatctcagctgagattaccaggggatcttgatgcgggaaaataactccttctgcgtcttccggcccaaaagaaattagctggttcagatactgcggcgccccttcacccgccgaagtgatgctgtggaccatacggatctgcatcatcttctgccgtttggacaactggcttggcgggtcagcccttgtaatcacttggattacccttcgctgtacatcttggcgttgttcggttgggggtgtttgctcctgaactgcttcgcggggtgcttcgacaattgttccctgctgcggccttaggtcttgcgcattgccacattgcctaatgtttcgacattgctccgtggtgtgcgaagagcatccgtgaaaggcgtagtagaggtcttttcggaccttcttgtgggctggctgctgatggttgctcgcttgctgggcatcgaactccttgcggagggcttgcacttcttcgaccgccatcacagctttgctcgcatggtctgttctgaactttctccaagttatgggggcttggctttgccttggcggctgtccttggatcgccggctgagactggcgaacgaagaggggaggtggttcgacaacttgaacttgtgcttgagcttgagcagcggcgatggaggctttgtcatactcagcttgtatagcttgctgtcgcttggaattctcctcgccccttgcgaacccgtcaatgatgcgaagtaggtgctcgagcgtctgaggctccttgttggtgatttttcttgtgagttcgtcctcgagcagaccggccgaagtggcatttataaccgacgcctcggttatgtcttgaacttggcaccgggcttgcaagaagcgacgcatgtactcccttatcgactccccctgcctttggcgaatgccaagtagatgttgttgcgtcttcggctcctcgttggtgcctcgaaagttaaggacaaaaacatcgtgcaattgctcccatgagtaaatgctattggctggtaaattgaaataccaagaacgggcgatgccgtctagagcgagatgtattaccttcgctttggtatttttgtcaccatgagctgcttcgatcgctgactcgtagatggagaggaactccttcgggtcagtttcgcctgaatagcgcgggacgggtgggaacttaaactggggtgggattggacgagtcttgattcccccacacagcggtagccctttttcgcctcccgccctgtttaccgcaccctactgcgggtacggtgtggcgaagggcgaaatcgcagcttgtgcgtgtggttgggccatggcattcggctgcccggctccaactggaggtacttgctgagccgccatggatgggtcaaaaattggctgtgaccacatcatggcagcttggattggtgcttggtttgttccgaagcctggagttggagcttgctgccgaacggttggcgcctgagcagcgttgatgaagtcgaactgcggtccctgattccacagcgaaactctcaggcccggctgaatcggtggcaaccaattaggcgcaccttgacttgtatttgtcgcgaccgagaaaaatacattttcccgaacgctagtgtattaatccccatcccagtaaaagccagggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagaattcttctccaaagcttctcttactgaagggggggggagattgagcaagaatgagtacaaccacagtactcagcaagccacaccggcagatgcatgattaatgcaagggggtacaaggggtaataatataggggttaagttttgcagaaaacagcatttaaaagtcacttagttgcccaaagacattttataaagacgatcctagagttacacagtgttattaatcaaggccgtgaaccctcacgaacctaccttaactcaaggcctacgatgattcagaccgaactggcaacccgaccctaggtcccagctcgtcccaagccaacccaggccaaccattccacattttagttgttaagcaaattttaagaattaaaacactaacttgggtacattgctaggcttgcccataaccgagggcgcggctattcgaataggttatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggcaggcaggattgagcccctagcagcaggacaccagccctgtgccatgacatctcgactaccgggccgcagctcgtgtagcctttatttgtcctagagatgtccatcgacccccgacttcgtcaatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactggtggaaccatgaatagagtacccactagttggggttttgtttatcctagggtgaacaaggtgataataacaatagcaataataataaggtcataacaaaggtaaataggcatggctaaataaaatagtgataatgcaggaatttaaataaagcgataatgcattaatttaaatcaaaataattttataaactgggattcaatatgctcaaggatgatgtgacttgcctttctcagagacaacgaccttccaaaccttcggcgacgaccacgaaccacgcttcgggaacctccggaacgatagaagctacgcgaagcacacaagcaaagctacaagcctataaagaagcaataacaatacataaaaagaaagcacacggttctttaggttataacaaacattaggagacttgaacggatcgattcggagctcgtatgaccaagacatggtcatccgaagtttaatgctgttacatggagatttgcggattattataattaggttttgcaactataaaacaagtgtaagcgctagcctggaaaagacaggaaggctgcgccgttgacatacggaccccacatgtcaacctaaaggaccgcggtagaccgagtacacagagacggtccacgggtcgacggaagcagatcccgtgtgtcaaccgaggcgagtggccgacaaacggactccactagacaccacacaggctgcacacgtggaaaccacgcggctaccgagcgggcacactaacacggtcaccacacgcacaagcgaacgactaccgacaccggtacacgggtaccggggtcgacaaccgcacaacgggcacgggcgacaccgaaaggacgaggacggggcagcgaaggagagatccttaccaccacgcgatggggcgagggaacgacaacaacgaacgggcgcggcggagacggccgggaatgacggagacgaaaggcgaggggacgacttcggcggcgatccttggacgaaggcgagacgcggccggcacgaggcttgacgacgcggagccgatgacgaagacaacgacggggctgcagcggctggcttgacgaacgtggacgacggacgagaacggcttgacggaggaacgaacgccacgacgaccgggaacgacgagaggacgacgaccggaaccagcgaggaggcgacaagggcagccggcagcggctgcatggagacgaggacggcatggaacgcgccgctgcgatgacgacgagggtggcggcgcagcgagaccacgtgccaggcaaccgacgggacgtcgacgtcgaggacgaacggagacgacgacgacggacagcggaggggttcggatggaggggaggcgaggccgagggtgaccttgccgctacgaggccggaggagacgacgacgcgatcgaccggggaaattccggcgaggaggatggagaggccggtgcggcacgacagttttcctgcaaaatacgggcgacgccgtggcctggccagggaagaggacggcgttccggtgccgggagaggcagcgacgacgaaagccgacgctccggcaaagcggcacaggcggctggaggtggtacagtggcggcaacgccattgtacaccagcgaggacgtgtctccgatggtccccgtgcgaaacggagggcaggccggcgtagagggacacctgcgaggccgaggaaggtggtggcgacgtcaaccgccgcacgggcgaggcggcacaggcggctggagggtggccggcgccgaggaaagagaaggaggaggcggggagaggtggtgcggccatgggggagctcgggaaggggctaaaacgagataacgcatggcgggggttccattttataggtgaggggagggagccaggcatgggagagggcggaacggcgacgggaaacacggccggcggcattggaaggcggacgggaatggcgcggccgttccgggcgattgggggcgccattcaagggggaaaacgggggaaattgaagaggaaggaaaggggattaattccccctaatcaattttggaattcccggtttgaatcgcgtggatttaggggaggaatcgacgctaggtttcacgggagagaagagagagagaggatgccgggcgggaggaaggagacgaccgggcaggtgggacccaccggtcaggcacgcgtcgtcagcgcacgcacgtgcgcggcacgggcgggagggcgccgctcggcttgggcaggggcgcggcttgggccgggcggccggcccaggaggagaggagggggaggcggcctgggggagagagggaggaggagggagtgggagagaaagagagggaggaagagaggactttggccgcgggccgagagagagagaggactttgggccagacttggcccaaagggaggagggggattatttttaggttttctttttaataaactttgttaattgttgttgttgtttaataaatatttccggtgctctgaaaattcaagtaaaatttgagggctccttttagacctaggagaatttaacaaaaattctccggaccacattcgaatttttcttgtacgtattttagtgtttgccaatttcttttcgaattttaattaattctattattccttttagaaaatgatttttattttcggatgaatttatcaggacgtgacagtattcccctccgggtgggccgatggggttgtacttgaaatgcagtggggttggttgagttgctgaaggaaagcttggagttgcgcctgcagagccaaagccccttccgccactgtttgtggcgcttggccgggtggttgatggtgtactcgggcagcgactgcggctgattcctgcccggcgaagtacattggcgcttgtgcgacttgaggcggaaagggctgggtcgtcacttgcggatggacttgaggtgggacataacctgttcaatactgaaggattggagccgacgtgaccttggtccgccttgccgcctcgtatgcttgttgttgttcttgtatttggcgaagcatgtcttggagccgtgtcatgttctgtcgcatggcttccatgtcggcttcggcttgtgttttggggtcagggctgacttgggcctgcacagcggcgagcgcagtcggggccgctgtcggctgcgatggtgcggcttggggcaccaccagttggcttgtcgaaaggatctccgccctagtctggagtgcccttgccaccgcagccgccttcgccacgtcggccgcgttcggcacttgcacagaggtggcgagggccgaaggcggttgtgatggcgcagatgtggaagcgaatggtcctcctccatcttcggccacgggcgccgaaggctctgctccctcctcggcggccatgtccggtccggcgttgctttccttccaccttgcaaccttctccttcacgaccttcttcggtggcattcgctctcagtggtttcgctcggaggtccccacggtcggcgccagctgttgtcgaaatgactaccgcatacgtcgaaagacgtggttactcaacggtggtaggaagaaaacgaagtgtattaaattttgagtttcccttctttcctttttttcccattacatggccctaggggactatttatagccctattacaggttcttactactagggtttaggttatacaagggaatttacatgattacccttatgaaagggacatttacaggggtacataatgatataggggctcatgggcccctgatgggccgtctggcgatcgccggccctattgcccctaggcttgatgggccggaaaggcttcttcggccctcgcaggggcgaacttgccaaggcgaagtcgtcttccttcggcagatagtcttcgccttgcacccttcgcctgagacgcctctggcctggcaaggcacttgtacgactcttcgcctcacgccgttcttgctccatagccttcgccatgggtttcggcagatttggtcgaagggcctcatgccatccgcctacaatgtgatgattgtttaaccattcaaaataattactaacaatcacagattgcaaaaaaaatgtacataattattatttattttattgtgaccttttatcattaaaaatacttttaggcatgactcattaatttgtgtaaatttgcaaaaattatttaaataagacgaatgatgaaaacttatgtctaaattaaagttgatggtgttatatatttaaaaaaatggagggagtaaaatgtaagacccacatagcgataattgcataatctaagtccatctttgaatattaattcctatgtccacaactactatcagaaagatctgagaacacattaatatctcatttaactagctaggtgtactagctgcaacatttttagttgcagaagagttttttagcattgctaatcatatattagcataaccacaatcaccaaccaaacttgtcgattattttacaatctattccaaggatgataagttgggatgtaatccaacatactgtgggatctaataataatgatcatacatcctaactaatttgacaaaaatgtaatagctttaacacaaaatgattacaaaagggtgatgttacatgtactaaaaaccaatttctctagcccttttatctttatctctactattacttcgaatgctcctgaagtcctgatctatggacgtctacagtacacgaatgaaaattcaggaaaaaaatgaacactgacaaaatctgtttggatatagcttcatgcatttcatggaaaagattgctgacacctccctcgccacctcttgtcgaaacaagatttcggcaatactaaaaggaggtggctatcaagctggaaaagtggatgggtttagagggaaagaattttatacaggttcaggcctttttaatcaagaagtaatacgctactcttgtccggcgattgatccgccgagtgtattattgatcgtatgatctgggagaaaaatcgtgttcctagagggacccggacccctccttatataggggaaggggtccgtattacaaaatacagtccatatccctaacggaatatataattacagataaaatataatcataaccgactaggatctcaggtatttccttgacatacaagtttaaaacttaacccgagtcctcttaaagatattctatctatacatggtaccctgtacctagtcggactatacgtgccgtgtagatatagggtatccataatctccacagtagcccccctgagacctttacagtcgacgaaatagccttctcttggaacataaagtaataatccgagtgctttaatttcttctgtatagatctccgagtaccaaaatcaaagactgtgaaggtctaaaatagaaaaaaccgggtgcatcgactagatgcacctaattaggtgtagccccccgactatgtggttagttaaaaaactaaacatatagtcaagaaccgagtggttttacaaccgaatatcatatagcaaagcatatgcggcattcaacaaaacatccagtcgactgcttttagctttaatataccaaaaatgaaacatggaaaggtccgagtgataaacactctaaaggtccatgaattcacatatttgacaagaatccgaataaaaactctcaaaaagatccatgaaatgtggtataaatgtgataacataattagtgataagtctaaatagcctaggctatgacccacaccagaagaataagcatataacatgccaagtaaataactattcaaaaaccaattatttcaacaaacccgaacagcttttgcagcctaaagagacttacaaaatcaatataacacttttctgttgggtacctttttgtccgcatcgtagtaattccaaagaatcatctaactgcattaaaaaggattttaacagcatcgggctatactgttgtgagaaaaaattgccaaagcaacaatgcctaagtccctaaggatcacaactaaccacactgataatagaattgggctgaagtactgtataggctcaggcccattagcactcccgataccctggcgaaataaacgctgaagtcaaagcgtcgctttcttccccgccgagactctcgccactttccccatttcacgctacagtacaaaagcactcccgcggaactagggttctccaattcgctcaaattcaccttccaaaactccacagaaatcattcacgcacccaccgcatcaatccctcatacattctcagccatttccaaagcaaatcgcatcacctaactcgcatccatggtagaggagagagagagcttcgagagccaatgggcgccctccgatgtaacggaggaaaacctgaaggagatggtggcgcatggtgttcttccggcgaaggagatcattggatggcgtctggcattcggcgaagcattcccgacccccaacactcatgaagtcgtggtattttctcatttcttctatggcggattttctcttccaacctcaaggttcttccggggaattctggatttctacggaatcagtttacatcacctaaacccaaactccatagttcatattgccaacttcatacacacctgtgaagcttttttgggcattagaccacattttgccctattccgtcgcatcttcttcctcaagccccaaccgaacaaaagcaagccatccgtagttgggggagctggattccaactgaggggaactctgagccaaaagtacttctccatgccgtttaaaacttcaaacaaaggctggcacgcaaattggttttatgtacaaaaccccgagcctgcactccccgagtactcctatctccctccagtttatcaggacacctggaattcactaccaatgggagaggaagccgtccaagcggtcaccctgatggatcgcatgctgaagctaaaggagcaaggtctgcagggagaacaaatcacccggcacttcatcaagagccggctggccccgatcaaagaaagatctcgcacagcctttgaattcgacggcaaacatgatcctaaccgcgaagatcccaaatcccttgaattcaaggtcatgaaggagagaatgtataaaatcttctcaaatgcaattgttgtcagctattctcacttgctgcctgtggtgccatataatgccttcaatccccctccaccggtatgtatttaaaatcccagctcgtttctaagcatgcttttatcatttgcaaggttgataaaaaagcttgaatcatcatacccaggaattcgccttgatgaaatcagaccctccaattacccaacgccgatcacctcgccagtagacaggtcaggcaagcggaggaccaaaaattcggtctgaaactcaatcaaacatctcaagatcaaccatccagtcagactcgcgcaagaggaaattggtcctgagcgacaatgaaggcgatgatgctggaaaaaccggcaataaagaggtgaccggaaaactgccaaggcaaaccaaccctaagaagaaaacatccagtcatccaatgctaaagatcaggaaatcttccagatatgaatcgtttgaccatctccctcgtagcgctgctcactcactattgcaataataataatggcatgactcaaacttgtaggaagccatctgacatagatcctactggaaaagactctgaaccaactgacatggagacgggtccttcaaaagaaaccgggccgactgcagaagatcacccgagtgacaatcagccggcaaccgacaatgtaaaacccagcaacgaaccctggaaaccagtcggccgaagttggaatcggggttaatcaggaacccccaactggaaaccagtcaggcgtagaaccaaaccgagatgtccctaaagttgaaacccaaacggacagccctcctaaaaaggatactagtaatgacccagtgtccagctctcctattaaggtacaagtgccttctcgtccccgaccggaaatcatcacaggtaaacatatcctccaaaaccattttgatttaaccgacttcattcgattgtttcacctttattcatggatacacaagggccaatgactagtgatgaagaagaggtcctctggatatgagcagctgaagattctcgacctcccattctagtaaagtggtgggatgacgatatgcaacctcagggaatcgtaataaacaagcaaaaagaagatgaggaagtatgtctgctgaaaaaggcactcagccaggctactcgtatcgtaaacgtaagtttcctcatgcacggcctcaaccatcctatttgccacttagctcaaatgccaataaaattgttttgcagagaatccatctcaggaatgaagcaaaaactgcgactcttgagaggttagttccccaccttggaacccttgaggccaccagaaaccagctgcacgaagctagggaacttgccaggaaaactgaacatgatttgagagatcggatcgccgaacttcaagactccaacttcgaactgagtggctcatcaaaaggtacacacaaactctgtccaacttacttatgctgccatccttgtaatctcaattaaccagaagcaatacagtgcaagccgccaagatatctgaactagaaaagtgaatccaaactctggaaaatgacaaggtcggattggcaagacataggaactcggctttgaaagatgttgaaggtattagcaattaatacttcaaaaaccattctcttctttatgcctactcatcgatatgaatttgtttatgcagaccgcaaaatcaagtctcaagctcaattcgatgtcttagtcaacaaaatcaagaggcttgaaggggccagggatgaagtcgccaacgctactaccccactcgtccaagccatgttctttaataacaatggtccgagtacatttgatgcttccaaaatcttcgacaagctgagagttgctccggatacatattttaagaatatcaaagaggctggaagtatgggggcaagcctggtgttggcaatgaccaagtctttatacccaaagatcgatattgacgccattgatggctttgcagatgggacgagcgaagaagttgctcttgacctcatcaacgaagcgtagaaagccgccgataagatagcagttgataactccgatgatgaaaaaactgataccgattgatgttatatcataacaatgattctgatgatgatgatgatgatgatggaggcacaatttgtacaatactgatgtatttatgctgtgctcaatatttcaaacttagcttctgatttcttaaaagcttttgtcaaaccttattgagcctaaaacccgcaaaagctattaaaaagctttcagtcctcattgactaagccaaaaaatcaagcaaggcaatgataaatcaagtaagcaaattgaattgataaaaatcatactccattattattataatagcccccgactgataactcaagggaaaacttgatgttagcagtcaaaatagggaaatacaaaagtaatgcttaagcataaaaacaacgaagatgttcaatattccaagaattgtcgataggagtaccgtcttcgcgcttgagtcggtaggaacctggtcgagtgactttggagattatgaatggtccttcccataaggggataacttgtgccgatctcgtgtagtttgaatttttctcaataccaggtcgccgactaagaaggctagtgatcgaacgttatgattatgataacggcgcaacccttgcaagtatcgagccgactgaattaaggctgcttcgagggcctcttccagtcagttcaaatcatctactcggtcttctccgtagcgctcctcgttaaagttgcgaaaacgtaaagattcaaattccacctcactgggccacattgcttccgctccataaactaagaaaaacggcgactggcccatggcccgactgggagtggtgcgcaaggaccaaagtacagacggcagctgttctacccacttgctggcatagggattcagtcggtcgaaaactcgtgcctttattccttggagcaccatgccattagcgcgttcgacttgtccattgctcatagggtgcgctacggaggcataacaaattttaatgccgaagtcttcacaaaagtctttaaatactccgccagcgaattgagtgccattatccgtgatgatccgattaggtaccccaaaccggtgcacaatgttgatgaaaaaatctctagccttgtctgtcatgtttgtgatgaccggtttagcttcaatccacttggagaatttgtcaatagccacaaagaggtgagtataaccgccgactgccattttaaacgggtcgaccatgtcaagcccccaaaccgcaaacagccaagacaacgggatagtctgcaactcttgagctggtagatgagtttgtctggcgaaaaattgacaaccttcacatgtctgcacaatcttgtcagcatcggacacaactgtgggccagaaaaaccttgccgataagcgttgccaacaatggtccgtgcggcagcatgattgccgcagatgccagaatctatatcctttaacaactgtctcccctcctccaaagacacacagcgttgcaggattcctgatggacttttcttgtacggctcggtctcatgaataatatagagcctgctgcgcctggagatccgctctgcttcatctttatcttctgggaattcttgtttggtcagaaatcttataaggggctctctccagtcggcttcaatcatacctacgtcttgagcgtccgtggcctcgattgtttctttccttggtacggttggttcgtaaagatgttcaacaaacacgtcagaaggagctgcttcgcgttttgaaccaaaattagctagcctgtcagctgcttcgttattgtgccgaagaacatgggtgagttcgagtccaacgaacttatcctccaacttgcgtacctcttgccgataagcggtcatgttgtcatcaaggcaggaccactgtttcataacttgattaacgactaattaagaatctccacgaactatcagacgccgaatttccaaagagattgctatcctcagtccgtgaagaagcgcctcgtattccgccacgttgtgagatgcagaaaaatgtatccacaacatgtagctcaatctttctccagtcggggaaattaaaacaaccccggccccagtgcccgaaagcctcttcgacccgtcgaagtgcatggtccaatacaccatcttctcttcgggcataccttcttggcactcggtccactcggcgacaaagtcagctaaggcttgggacttggtcgaagtttgcggcttgaacgatatatccaaggacatcaattctagggcccattttgcgatccgcccatttgcttcgcgattatgaagtatatcgccgagtgggaacgacgtgaccactgtaaccgagtgaccttggaagtaatgagatagcttcctgatggtaattaaaacgccatacaatagcttttgaatctgaggatatcttgtcttggagtcggccaggacctcgctaacgaagtagattggtcattgcactttttgaatatggccttcttcctcacgctcaacgaccaggactgtgcttacgacctgggaagtcaccgacacatatagcagcagcggctcttgcggatgcggtgaagctaagaccggtggggtagtgaggagttttttgaagtcttcaaaggctttttgggcttcgggtccccactggaaactgtctgttttcttcaacagcttgaaaaagggcatcccctgctcgccgagtcgtgaaacgaaccggctgagcgccgccatgcaaccaatcagcttttgaacatctttctgagaacttggcggttccatgttgaggatggcattgattttctgtgggttggcttgtatgcctctatgagacaccataaatccaagtagtttccctaatggtactccgaagatgcacttttcagggtttaatttcatcctgaaagcgcggatgcttgcaaaggtttcttctaggtccgtgatcaaatcatctttctgcttggtcttgacgactacatcatccaaataagcttcaacgttgcgaccaatctgagttgaaaaacatctctggatcatgcgttgataagttgctcctgcattctttaatccgaaaggcatggtgatgtagcagtatgccccgaagggcgtgatgaataaagtctttaagcagtcggattcctttagtcggatctgatggtaacctgagtagcaatccaaaaagctgagaagctcgcagccggctattgagtcaactacctggtcaatgcgaggcaacccaaaaggatctttgggacaggacttgctgaagttagtgtagtcaacacacatgcgccattgtcccgttttcttctgaaccaggattgagttggccagccagtcgggatgaaggacttccttgatgaagcctgctgctaacagcttagggagttcttccttgatcgtatccttcctatcctgtgcaaagcggcggagtcattgcttgattggcttagcgtcttccttaacatgtaaagagtgctcaatcacctctctaggaataccaggcatatcggatggtttccacgcaaagatatctttattattttgaagaaaggtgatgagcgcgctttcctatttacaatctaactcaacgcctattacagcagtcttagtaggattagagggatctagaggaattttcttggtcttggcttcgctttctccactctttgggatcttggttgcaggcacttctccttcacttgccgtggttgcagccaatcggatatcttctcgggcgatcatgatctcgcgggtttgggctatctcacagctttcctagtcgcatgtgacggcttgtttgatgttgctctgcagggatatgactcctcgaggaccaggtatctttatcattatgtaggtatagtgcgggacagccataaatttggctaacgccgggcgcccgagtatgtcatgatacgctgtatcgaaatcagcaactttgaagcagacgttttctgtgcggaagttctcccgagtaccgaaggtaacccgaagagtgatctggccgagtggtgtagcggatagccctggaatgactccgtgaaagggcgcattactcggtttcaattctgtgcgagggatctgcatgtcgtccagggttttggcgaagaggatgttgagtgcactgccgccatcgatgagggatctgcgaagcttgacgttgcgaaccactgggtctagtaccagggggtaccgccccgggtggaccactcggtctggatgatccgagcggtaaaacttgattgttgtctccgaccaccgaagatattggggcgtatcgggctgaacagcgttaatctcccgttcagtcagcttttgttttcttttagattcataagccagaggtccgccaaagatgtggttgagctccttacgacggtctcgaaaacctatcggggcatcgtcgtcatcgtccttcttttttgacatgctttgatctccgtcggaggcctttcgtgcattcttggtgttttgttctgcaaactgtttgtagacgaagcaatctttggccgcatgattggaatttggatgatgcggacattgggagttcatgatcttgtcaaaagtattgacgcgcgaacgttgtcgggaggaatgtgtagtagttgcaacaagttcctcgggcttacgcttacggtccttgtgattggtacttccactccctcacgtagtcggcgtatctttcttcggcttctaagtggtgcccaactgcttggacgcgataatggcatcttcggctttggcatactcgttggctttttcgaacatccgcttgactgtcttgggaggcttgcgcccaaacttgccgactaaatcttcgtgacgaatccccttggtgaaagcagcaatgatgacgtcatcggtgatgtcggagatctggttgcgttgctcagaaaagcgtcagatataatctcgaagggattctccagacctctgagtgacgttgtagggatcaaactgtgtgccagggcattcaaaggtgccctggaatttggcgatgaagtggtcgcgaagttccgcccatgatccgatcgtgccacggggtaacccatgaagtcaggaccaggcagaatccgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagtttaagcatcttttactatgatgagaggtgtgagactaatcacgaaagacattgttagagccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattacttaactaatcacgattgaccatcgtgaactatcatgaaaccatcattaaataatagtgagtcattagttatcccgaatgtgtactaatgtttctaagcagggctaagcaattatatctaatatctagttgaaccaatataaataaagctcaactagtcaaattgtaataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatatgtgtga

SEQ ID NO: 38080 - DNA, 38560 bp, Oryza sativa
  unsure (1)..(38560): unsure at all n locations
aagggttgtttgggatctgtgtgacttgccttgctggccttggaactcttcaaactcttcttctgcgaaaacggactctccggaaacgacggaatctaagcagaaaagagcaaaatcaccaaaacagcacctaaacaagcatgaacagtatatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagagggtttattgcgtcagcgggctagggtttggtggaccgggcgcacgggcggcggttcacacgaacggacggccgagatcgaaccaatccaaaacggacggccgagatcgattgggtccacggcggctcacggcggacgaccccgataacgtcagcggtgacgtcaccgacagcggcggcggctcggcggaggagacggctcgaacggcgcacgctcgccggcgaacggcggcgcgaggacgcaaacggagggcaccaagacgaagcgggcggcacggcgaactgaccggcgaccaaaacgacggcggaaggtcaacggacggcgacggcgacgaggaggaagcggcgaagctcttcggcttgacgacggcgacgaagctccgacgatctccggcgacggcgaaggggcggacgaggacggcgacgacttggcgagcacgacggtggtcttcccgagcgacggcgacggctgaaacgacggcggcgcacggctggagcggcggcggcgacggcaaagctagggcacacggcgctagggcttttccgacgacgagaggcgaaggcgaaggtggcgacgggtagaggagacaccgggggtccttttaaaggggctcagaggcggcggcgaaggcccaaggcggcggcaacggcgaaggaaagctcggcttggagagagggaaaccgatccgtaacgaactcgattccacgaacttccaaaacgatttagccaaagattccaaaggagaaaaggtagaggagatcccggagattgtttcccctcaaacaattcggccggagaaggaaaggaacggccggatttggaaaggaacggcggcggcggcgcgctagggtttcgggcagcggcggcgcgacgaagacgatgggtccgacaggtgggacccacctgtcagcgaccgaacgcgcgcgcgcggcggctgcggactgggccgaactgggccgaggagagagagagcggttttgggccgactttcggcccaaagccaaaagagactttttaaaacctttttcaatttaaattattccttaaatgcaattccatttattaaaaatacttccttagctcaaataaatcccagaaaaatctaggaattatagaattaagcaaagtatttaatgaaattttatctggccccattttatattggaatttattaattaaaattagattttcttttcaagacttttaaaattatttctaaaaattccaattaaacaacaatttatatattttgaattttcagggtgtgacaatccgctagagccataggcaagtagtttgccatggctttgctgtctcctcctgctgcatgaattgcgagaccgtagacggtgagccaagactcgggattagtggtgccatgatacttctcgattccagtcggcttgaagccggctggccaatcgactcgacgcaggtcgctagtaaaggtagcgactccatccacatcgtcgtcatagcggtctggtgaatggtggtgggggtagcctcgtgctgcacggcactggttgattgtatcacgaagatcgacggggcgcctacgaggtggggagcgaggccgttcaactccgcgctccctgtgtcgttcgggaggcgagtggacagatcgctcatcgtaacccctgctcctgcgattggatcccgcgccggcgatgctgaggcttggctggtgataatcttgagatcgaagatggggaactcggctgccagtcgatgtgcggacgcttgcggagttaaccgggaccgaggcggcaatcatggtcttggtctggttcaagatgttgacgacgtgatcagcttggttgagtgcgtcttccttgaggagggtgtcgaggagagtgattgctgcaaccgcgttctgttgaggggtgcgaaagaccgccgttccctcaacgtcttgctgtccgataagttctcgcgctcgtcgcccggcttccaaggctcgttgtcgtcggtcctcagcctcctttgcagcccgttcacgttcctgttgctcgcgctgcagccgttctcgctcttgtgcctggcgctctgcttccagtcggcgtcgttcggcctcctgttgtacgcgtcgtccttctgcttctcgagcttggcgctgttctttagtctcgttgtcgaccatgaagacgccgaagtagagaggggtgtaattatcttcgaagctttcgtcgaagtcatcgaggctgcggttgtcgtagcgatagccgaattcatcgtactctacgacctcagttggtcgtgagtcgatgccaggggagctgaggtagccttccaattagtccgtcgaaatcgtgcctagtggtggagtatgatgccgacttccctggagctaggccggatcggggctaaagccagatcccgcctaggcctacggggagaagacgcccttgtagtaaagacggcagccagatcgtcagggagtttcatcaggattggcggataggccccatcgtcttgatctggtcgtgttggagtagattgcatctcgtccgagtggtttgaagccaactcggcggagatgaccttggggtagacctcggccgagttcggaataccaaacggggcggagatccggtctcttcctgagtggttcgaatacgagtcgaggagagaaatcttgccgaagtcgttggtgatgaagtctaggctgccgaaccggaacgcctgcctaggagggaagacgaagtcgtcaatgtcggagacggaacccatcgcacttagtcggcgaagaacttgacgctacccctacctagcacgccaactatcgaaacaagatttcggcaatactaaaagggggtggctatcaagctggaaaagtggatgggtttagaggcaaggaattttatacaggttcaggccttcttaatcaagaagtaatacgctactcctgtccggggattaatccgccgagtgtattattgatcgtatgatctgggagaaaaatcgtgttcctagagggacccggacccctccttatataggggaaggggtgtccgtattacaaaatacagtccatatccctaacggaatatgtaattacagataaaatataatcgtaaccgactaggatctcaggtatttccttgacatacaagtttaaaacctaacccgagtcctcttaaagatattctatctatacatggtaccctgtacccagtcggactatacatgccgtgtagatctagggtatctataatctccacacctctctagcgcaacggtcaagcataggcattgcatgcatatatgtcattaccactcatactctctcccgttccataatatattctagatggttcagataaggttgaggtcaaacatagaactttaactatcaattacttttagttgaagacactagaacacgagtatagatttctcttacaaatgactttaataaaattaaatatttaattatttgataatagaaaaccctagtttaggatatgttttggagaccgtatcgaatgtttaccaaaacgttaagagttatgtaatgaagggagtaactcataacactggcgccaaccatctatacttaacatacaccaatagcgcaacaagaaaataaaaacaagaagaatgtcaatggatatgttatctgtactacagtgaaagggactttcgtccatccacaccccctcccatcgtgtcacgcatagcggataattagtccacctggcataaaactcgcccctagagaaaaactaaccaaaccacatgaaaccgacctgcaacattctcgcctatcaaactcaggtggtggttggagtaaaaactacttttacatatgtcaacacagatgtttctattattttgcataactaagttgagtataaaatttgggtttctgttgtgacacaggggcagttaactaagtatgtattaggagagtatcggggcctaaaattgttttcgttatgatctagtagatcaggagtgagatagcaaaatacatgcccttaattagctaggcaaacatgtccctggatatgaatgttggcctttgagaaagggggcggagtaagctgggcaagtagttgcaaggctcatcttaagaataaaagataagatgggccaagtagtgtaaatggctaggaaaaatgtaacctatttggaattggataagattcattcctagcacctaaatttttatcaaagtccattcttttcacattaaactcaaaaactgatctcctctaaattttaaaatccgacatataacaccctaatctatgcttattggtagctttcatcgatattgttggtgtattttctagtcaacacggactcgccttaagatttacagtgttaacgagtcaccaattcgtgttggtgcattttttggccaacacaatactcacctaataatttgcagttttaatggagtcaccaaccactttgatttagaaaacctcttgacccttgtgctaaatttaggtgtcaacacacacacgtatgctcttttgacaaactggagagccaaaaagcatagaacttgtggtattacaacgataatctctatcggccacacgggtttagaagcacctagaaaattgttctctttgcagtagtgtcttgacaaagaaatagttttctaaaaacaattcccacaactcaatatagatcttcccaactaagggattatccactgagttcctagcacatggatcataatccaaaaatagttttttaagccatgtctctaaacttgaaacaattttactcaaattctaatcattgaacgcttattagtcaaatcatcgtcactaatgctcattgacaaataaattagcttgctcaacctaggagagccaagcggcaaaattaattatcttccaagcccattgataaattccaccaatgctgtatatcactttatccatagcaactccaaatcgatcagcataaaaattccacaaatctctatgtttcagcaatataactctttattaaacaaagtttatttagatgcttaccattgaactcttcaatagatcttctccgatcaaccctcttttttgcatcctttaaatatttaactagtgaaatcctccaattggtaacttgaaatcttgaagcatcactaaatttggaacaatcaagaatgggttgtttaatcaccttttgagcctatgcccctagctatatactgtgggcagcatttttcagtcaagccagcattagagctatagccaaattgtccatgtgcccagtaaaaccattaatgaagtcgcggtcagactagcatttgaagcatcagtgggaccagcagtgaggcaccggtcggatcagcatgtgtttcggtttgaccggccatgtagttgtggctagttcggtctagtccacaattacctctcacactttctaatgaagtatcacctttgcaatacacaaatattgcctttcctatcgttgtaaccagatgcttattgtgtcaaatgtttagataacatatattttctagacatacgaaaaattgtaatatccaaagatactaatatgactagatatttattcaagtgactattcaaaaataattatgaaggcaacaaaaactcctagccacttgatctatgaatcacccaaaagcaagtctctcacacctatgagttataacaactatatatgaacataacaatttgacttaagcatggatacaaaatattctaatagggccaatgttaaactaacatctctaggtaatatcataataaaaccaatacattggcctttcatacacgtcaaattactataaagcaaaacttccatggtgcaatataaaattgatctcattgcaagactaaatatgatgcgccatcaagacagatatgatttggcccttcaaggttttctcaaactcatgaaactgttgatgcaaaaaaaaaacacacacactggcctgagagatttgctttactctagtgcgggtccaaagatttgctttcggttcagagcatgctagttggtttgatcctgcaaccaacaacaaacaaagaatccaaagttaaatccataaacgatagccgatcggctagattgccgatgacgtatcgtttaaatcgagctgatgcaatatgatttggatcggcaatgaagtatataatgaataaaagattcaatttagtttaccggctgtagataccaacgatgtatatctatacttccaattatatttaaaccaagtgattgggatagatcggacagttgccgacacagtataaatcacttaagtctaaatgtacttaagagtaaagattacataagatcatatcatagccgattggtaaatctagcgtgtatcggatattgctccaatactcctttatactaagatatcactatagattaaatatgttaaacatgaatcaatctattgttagtttaatctaagcatattgatatcaagcttaatatattttatcttaatgagatcttgatataaagggcagatttaacatatcaagtagatagattaagaacaagacagctaaaccaggtaagatcggctgaaactccggtactatctctattaattatcatgaagcaagctagagattatggttctaaatattacttaatagatcaaacttaactgatgtagcattaagcattaaggagaaacataatatctaatgaataagccaatgaaaaccttttagacatggtagatatgctatataatctaaaccgacaaagttacctaaccctatcgggtgatttcgataatagagataccgacaaaactagataagagtatcaatctagattatatagcatatatgataactcgacgatttacataaacaagattagagtgtcataaatatgtaagcactaatcccgagaacgcaagctgccataacaagttttaccttttcgtcgaagatcacaaccgatgcagcccaactcgaaagcaagaactcgtcgaaacaatgaaaatagaaaagggtggcgatgcaccgaaagtgttattgaactgatgttaattgtttacaaggtattgggtcatatttatacccaaaatacataatatgtccttgtcggacgcgactctatttttattacaactctaaaacacgaacaagtccctttggtggactcttaccgaacatatctataaagaaactactagaatatcctaattaatagatacaattaccttcttcggactcaatccacacttgacaatacttgtacaggacctcagtcgatcccgacaatgattctataattatcctgccgaaatcggctacatcggcttctccctatccgatttggtatcagccgatgcagacagtagccgatgcaatctgtagccgacgtgcactctgtttcaaagaataacgaactccttccaaatccgcttaggctttgactccaaatccaatctatgatttaccaaatttggtcgttaacagaaacaaaacatatttaattgacgtatatgctctcttgccaattccaccatacagaattggcttcgtgacatcaatttgaaattattgatttgacaagtaaaaatacaggttctagatagcaagcaatgccttaactttgtataaacatgtcataatgtaagatataataaactcacaccttgtcttcacatgtagcaaacgacagctcagagatgtgttcatgtactctttgccattcacttctcttaacctcttcatcaaaatattgataccttgtcccttcatgcaaaattggctttcctatttatttcacgattttgaaggtaatgcaaacactatattgacatccttctcgctatgtgaattagaaccatctcttatgtccagtgatgactcttcattcaataaatcgtatttatcatggcttggggaaatcaccagtctttcaatgtttactaccttgggtctccactctttcctatgtttttattagaggcttaaatttatcaagcaatccgccccacaagtctttgtacttttttcctcgttttgttgatgcttggcttgaagacattgtaacatactcttctgagagtgggataagcgggaaagtacctacttcggctatgggtgcctctcggtcagaccaaccatgtagacaggacaggtgccatactacacagtctcaggccattctagacaccccgagtcggaccgacgtgatctcgaaccagataatgtcattctggtcatgcctggtggctggtcggaccagcctcagggcccagttggcacagagtcatgctaaaccgtcctagatggttatggtcttccctggttagatcagccttagagcctagttggaccggcaataccggaaattgaatcatcgacttcggtcttctttgcttgtgggatttctgttgtatttccagtaggtactgggacctcgtttggcttcaccttagcaacaatgacctctaaagctttggttcgtttcatcacccatacgttcttcatatttttcacctttgattgactggaccaatcctttttctgggaaatgcacttgactagagttagatggacaacttggtgatgagtacgaaaacgacatcagtaattgaggcatccactgcatttggaatataaaagtatacaaattagggttaattggatcaatgccatacaaatatgctatnttagataaatgccactactattcacgaaatcggttacgtgccactggaatttagggaaattggaactgtgccactgtaacatactagatttttcagggtaaaatttttgcaaaaatatttaaagtcgatgttctttgttctttcgaattggagcctcccaatccttatatttcttttgttccctctaagtttccgactcccacataaccttgtttagtttccctctccaaaccaaattcgagatatcccagagaaaattcccaaaaccatcagaagagcttgtgtttattttaagttataccggagtcatcgtgcaaatattctaaaatccccaatctcatcgatttcctattcaaaaatatcctaccaaagatctattcaaaaatttcttgaaaaattcaaatggatcactatctctccctgggctgaaatcaaccttaacccagcccatcaccttttcttttcaactcctttgcccatctccctctgtttgggccgtgcgaggccacgactattgttggcccagccgaggcagccgccccaactaaaccgctgctcgcttcactcggtccatcccgaaataactaatacgcgaacgttcgggttaattcctactcgcgaacggctcgacaggttggcatacacgaccgtgccacgcgtgtgaatgcaaccgatttccttttgtagctaaactgtgcatgcatatatatgacttccttaatcaccgagctaatctcaatagctcggtgattaaggaagtcatatgtatatggtttcctttagtcaccgaacttttgagactaatcacattggtgaattatgttttataatttgttacacgggacatgtacaaagacgagggataatttttgggaattctcactcaatgcatgtccacatttgctactttgtttttgcccaattgaaacttatttttttttggaatttattttaattttgttttgaaattcatctatatataaaaagtttgtataacgaaagtttttatatataaagtctgtgtatcaaaagtttatctacataaagtttgcatatataaagttcaattttgtgttaaagtttgtgaatagagatattagtaatttgaataggatttatttaaatgaaaagtttaaaaatttgggtaaaaaaattgttgagtagaagatgttgctataaaataaaaaattatgtataccttagttacacattaattatgtggtaatcaatgctttaattataaacatcacactgattttttcggtagcaaaatatgtacataccatcgacatatgcagataactataccctaagtacatgctagctaattaaagtgtcggcatgtatgcctacatgctagtactctagttcttatctagttgcaagatgtgtgtatgcgatgcgcttacaaatcgtgctgctaattaagagcatataagcacgaactgaatgatactaaaggtctgagcatgttcgtgatccgcgaacgttcgcgtattagcctcacccggtccagccaccgctcgcactacgcgcgcgtcgcctcgcgccaccctgcgccttgcttgcgcccgcacgcgcttggcccgcactagccgcgtgccgccttgtacctgcctgctctgcgccgcatgtcgccacgcgcgcggcacacgctcgctcgaagccgcaccgaggaactcgatcagatggtgtagacgttgtcgcacaaatcttaaaaaccgagcaagcaccactgctaccgtcaatctcaatctcccactacccaactatttaagcaggcaaggtagccatgctcatcctttttcccctctctttctcctttactcagaaaggaatcgagttcccaaaatttcttcaaactgccgtggtcgtcggccgatctgtcgctgcaggccaccggtcgtcgtctcctcgcgccaccagactcttccagagccggtgaggccatctccttgtttttcccctcctctccatgcttgtactgaggtcccatcgtgctcctgtccgtcaccatggctaccaccgtggtcagtttttttttccaacgtttcatctctatcaactaaccaaaaaatggaaccttctcatccgggaacacgttttgacgcgctcacccgcccgcgttcgtcaccggagctgccacttccatgcccggtgtcaccatagctccagatctggaattcgcgttccggccagcatgaacatcctctcagagaaccagcaacagcttcgagttcgcagcacctggggacgaaattacctcaagacgttcttactgttccgccacgataaccgtcatccaacttttctctttttatctctctgtctgtgttcgtggttcacagtggaagaagaacagtactagattcaatactgttccaccatggtccagcctgaccacaccacctgagccaacccaggtagttgttaaccaaaacaaaaccgattcatatcaattcttccatcagttcacctccagattcaaaccaaatcaattctagtatctgtaacaacaataatcccaaagtgcaaccactaaaacacatgctatcgatcataaccctaggataaatcgtttgacatccaagtcaattaactcttgatttaccattttcttttgttctcgctccgattcataatatttattttatcgtttatttgtagtatttttattataggcttatttggtcgtttcttcgtgtgcgtacgttagatagcgttgaagatcccaccggactcacaggaactgaagtgggcctagaaggatacgctgaagcttccgaaggccatgttccacaaggcaagccacaatttccaatctttgatcatattgaaacctagtagagaaccacttagttattttatgcattgagtatttataaaactattttgcttaagaattattttcgaataaacttgttagtttagttattacccattgttacattgttattattggccaaatccatggattgctatatcacgccctttgataacctaggtgtagatttatatacttcacaacaatattctagtggataagaccaccaaatatctatactcacatacatggtttacccgtcgtcacgtggtggcgtgtcgggtgatataaaatgtgttatttgatatgagtcactcgcctggagtgatatgaaagattaattctgggtgaagatggatgttgtggtgtgtgaggccgtgcatattgttataattattttgtggaatgtgtatattacacttgaagtatgcacgggcctgtgctagttttggtggctttccccggatataaggactaccctcttatgccatggaaaatgatgtaatttgcgcccatccacagaactgagtaatcagacatagcctagtacattgtcccactatatgaaagactgtagggcggctttatgagcaggtttggggtggacatgtggaaggggcttcggccaggttaacatgatccacgacggtggaacccgtgaaagcagcgaccgtctagccttgcttaggcctagcaagtgcccgactgctaggacggatcaatatcccactgggcagtaactagtagtaagtgggactctcgaatggctatgttgtcctcagcctagctagctgttgacatcaggtgggtaaagctgagcagtctctgcagagatgagtcttaaatcattcgaatgtgccatgcttccggttaagaagctatgtcattgggtgattcctatttatcatggtatgagtagattttaaattaaaatatggaatatgatgaagatgaggatgaatggtgattaatattgctaccattttaaaatgatgatttacagttgtttgtgaataaaatgtttgataaagtagggaaaaactatttataataggcttgttatgaaacctccttgatgaactatattctttgtacgccttgcatatattctatttgtattattatgggtgtggcttgctaggtacctcggtactcacctcttgcataaaatgtggttcaggcaatcaatccttccccgaggaggtgcatgaaggggaggaattctacggtgctaacgagttcatgttctaggtcgatctgctctcaagcattgcctgtggtgtttttatcctattttgtgtttgggtcttttgtttgtagggagtgtgtttggcctgttggcccctaaaacctgtcttagttatcttttatgtaataatttctgtaaaaacttgggtatatatatcgaaagctgttctgtttatcaatttgtgcgcgatcgaaatcctgaacggtcgcgggtggtttcgggataccgtactcaaaccgggtacccccacagccactccgtcttgttttccatcagaccaatagacgtgggacccacatgtcagttccatcttccaccatcctccctcttagggatggcaatcgggcgcgacgggtacgggtagtgcctacccatacccgtgcccatgagattatttttgcccgtgggtatacccattactacatgacgggtaaggatggttgcccatgcccatcgcccgcgggcgtcttgtgcccgcgggcgtgcccgtttacccgccacaacaaaagtagtggaacaaaaagtctacaaccttctaagttcgatatcgaacttaaaacatcaaatattctctgcctcggtgtggtgtctctcctttgacggcgacagagtaagagggagagataataagggaaataaaagggaaaccgtagaaaacaaagaacgtggcttatgtattctagtggattttgcttctagcctacatgtaagttagatttcgcgggtaaacgggcaaagcgggcatgggtagtgattacccatacccatgcccatttacccatcgggcatagcttttaacccaataaaatacccatgggtataaaatggagaacaaacccaatcctaatagggtttttacccacgggtaaacggacaaacgggcacaattgccatccctactccctcttctttcttcctcacgtgcaattgaggctaacggagatttttaacggaaaacgcaacgggacggtacggttctagtttccccaaattctagtggcacgtagctgatatcgtgaatagcagtggtatttatctaaactggcatatttgtagtagcatggatccaattaacggctcactgagaagccacttttctgcggggccatttgttagtgagaatccatatttgtacaaacaacccctctagatgctatattgcaggacacaagatatataacatatatcaatttgcataaatgatttaaattccacatatattaatttcatcagtagacttaatatataatttaatttgcacaatgttaattggatccactcgttatactctgaggtaatacttcttggtaatatattaaaaaatgtattttcccttaacaaaattctactcgggctcacttgtcgaacactagtctagaaaaactataaactacatctaattagttgcggtggggctaattctcttttggcttccaccaccgtcgtcaagcaggcgctcagggtcggccccgtgctagagcacacactaggggcctgtaccggggttctgttggctggccctgttccggggtcgaagatgggggctggtgtggtgccttctcctccagctccgatttggtcggagcctcctcccagctagacgacggcttggcctccagcgttgccacggtcacgtaggcactcacctcctgcaacaccggccgccacgtagggcctgcctcttgctcctcgggagcgttggggttgactctggcatttcacctccgcaacctgccgccgctgcgtccacagggatcgaggcattctccttgaccctggccttcacatggtcctcgggcgatctatggcccccgtcattgtcattagctttgttgctactcttgtcgtcattacgggagtactcctctgctagcgggtcatcgtcgaagtttttattttgaggggacctgctgtataccagtgctcaaaatcattgtccacttcatcattaggtgttttgcctagcaatgatgcaagcgatgacggggttatgtcgctgtgagagctgctcctactgttgttttcctactcctcgttggtgggataaatggccatggctagagagagtggataaatggccgtggctagagagagtggataaaggtaggatggaaaagtagggagagcatagcgagataaaacccattgtttattggaaaattgacatggcatgggagttgaggagtcaaaatgtggtagtggagaatgtgatgtcacgccctgaagttcccctccttgctttaaaattcataaaataaatcgtccaaagaaatgatttattttaacctagagtgaatccttaattaataaatgcaaataataatcggaaccggtatatggaatttttcttggattctacatgtcaaaatatgctaacaggatttttagtggaattttcagagccttggaaataattttaaccaattaaaataagcaaagtgcaatatttaatcccagggaaattccttttcttttttttctttttcttttcctcctttttctctcttgttgggccgtcggcccatctcctcccacgccaccctcctccttgcagggccggcccacgtctccctccctcctctctccgggtcaccaacaggtagggcccacctgtcggccccttcttcctcctccggccgttggagtcggagctccaactgcccacgccactggcgcctcacctcctccactccgcatcccgcgcccactccgccgtccgccttacccgtgcccacgtcgtcgcgacgccgccctcgccttcccgcccacgccgcgtgcccacaaggggcggatttgaattttgaatcccccccaactctctctccccactctcccacgtcgccagcgaaatcaggagcaccctagccacgtccgccactcccgagccccaataaagctcccccgcactcccctccacctttttcctctttccgccgctctctcccgcgccgctacacccatcgccgccgccctccggccgtgctccggctgccgctagccaccgcgccgagcctcaccatcgacgccgccgcgttcgccatccggcgagccgccgcgtccgctgtccgcctggccaaacccgtcgccggagcccgcatctcctcgcattccggtgagcttccaccattgccgccgccttcggctttgttttccgctcaccgtggaccacctttctccctctaatccctcccattgtgttccctaggtggttccagagctcgtccgcccctcgccgccatctctcggtcgctcatcgtcgccgttcgtcgtcgcctccctccggccggccgaacccctcggtgagaactccctctcctccctctttctctccctcccgtgtccgctgccatccaccgcacacgcgtccttgccttcggccgccgccaccgccttccgcgccattcactgccgttggttgctgttgccggcgaccgtgcaccgccgccgctcgccgtagccggccggccggcttggagccgagccgagcccggcagatgccaaccccccttttggagccgttgccggtggcgcccgcctgccagtaccccctccctctcccttgtgcctatgacccgtgggtcctgcctgtcggcaccgccccccccttgggtgacgttagccctgggacatattgcgcaataaatacattaaggctttttctttattagtaaaaacacagataatattctaaaaatcatatctaattcatccgagctccgattaagttcattcaagtctcagtaaattcataaaaatacatagaatccattaaaaatggttttgtttcctatttcagtagtcttatagcctgttttgcttgtgtgctttgtttgtcgcgtagatttcggctgtttcgtcgatctgcagtttctcgaaggcattgttatggtctcatcagtgcgagagtaaggcaagtcatgcattacgattgatcatattgtacccaatttacaaatgtcctgcatttctattaaatgttgcattgttttataatattatgtgggatggttcctactactcagccatatattgtttaccttatgccattgataacttgggtattaaaatgactagatattggtttaggaaatgcttagccatgcttagttcaactagtacacaaagggggatcacattaaagcatagacttcgattattggcatagctttggattagtgccaccgccagggtgttagttaattaaaatacactacatggtgggctgtgggtgcatggttttgctagtcgcacccatggcaattaaggaccggttcgcgggatgccctggaagaagttatcgtacttaccacaagccagcgtggacaatggctgggcttgtagtgtagcttcctctagccgacgtacccaggcgagggtgggcgtgatggagttgggtcggccggggtgtccggttgatcggcttccggattcaccgcgacacgaaaggggggctgcccgttgcctactggggacgggggcgaaccctaaggtgtggtgcgatcggttagagggggttatgcgaagggtcctgtcacggcctctttccggtatgtcgtggtgatatgtcggcgcacgaaaatgtgtcgtggggctgtgtcttgtgggtacagttgtacacctctgatcagagtaaaactattcgaatagccgtgcccgtggttatgggcggtcgaccagattcaccgtgattagtctcacccctagttaggtaatgaactggtgtagttcaggtggttggttgggcctgttgcaacgtagtgtagcgttggacagtgattggttaatactgattacttactacaactattttactgctttcaactactgcttttaaatgctagctttatgcaaaagaacctttagcctcccttggatatatcctgcatcataccttccctttcggtatgacttgctgagtacagtgggtagtactcagtcttgctatcttttccccacaccagagttgaagtccctctcagttgaagatgtctcgaagaagttggtttcgtcgctgccgtcaaggatgcctgtggaatggagtcgcctcgttgtaggagtcaagtcttcaggcttagctcgcttttatcttttctgctacatttgtaatcttttatatttttataagacgtgaatctgtatgtcaacaattgtcgtttgtgtaccctggctggtcctggacaggggtttaatacacattcagcttagaaattctggttcgtgaatttctggacgtgacatgtgaccagcgcgcttcgtcttttgaagaggaagtaaccgaagtctatctgaaaattgatggtagtgggtgtggttgatgatttgaagtaatgacacaagatgaaagggcaataccacaattgggcctgaaaaattaatgtagtctaccatgtcccaaaattagcgtcagatagctgtcggaaaagaattgatattagcttcagaccatctgtggcgagaaggttagtgtcagatggtccgttggtagttcattttaaaaagacagactgtctgtcggcaatgatactaatttatgggaacagatggtctgttggtagttctataactaccgtcaaatcgtctgtgggcatttctcggggcccgccaaaaaattgggtcaatgagtttgcttgcgcgcgagcgaaaatttgccgcgcgcgggttgggctaaaatttgccgcgcgggctgggctggccgagtcagagagccaaataaaccctaaaaatcacacaactatcgatctacccatccccagcctcccccacgcacgcctccaatcgcgccgccgctgctcccctcctcccgtcgcgccgctagtcccctcctcccgtcgcgccgccagccctccccatctcaccgctgctcccctcccatcgcgccgcgctccctgcctcccgtagcacctccgccattccccatcgcgccgccgcatcgctccacccatcgcatcaaccctgcagctctccaggtcaggaggaatagatgtccccttcggccctgtcaattccaccaccactccgtgactcctagggctcgtagctccaggaaccagcgcccacgcaccctcccacgctcgcgtgtccactccgctgtcactcttcttggtatcgattctttacccatgcctcattgatgcaatttgctttcttgcgttttctgttcttgcgtgtacgttcttggatttctgttacatttgtatggtggtttgatgtgtcacgattgggagtaattgctgaggttggtgataatatgggataaatctggtattgcttggttcaattcggggtggtgctaatgttctgttcctaaattacaaattacagtggtttgatggcatgtagatttagaaacaactgtatttttgaaattttaggctgtatccaccacagccactaatatgttgccgcagtctatgagctgctgccatcactgatttccactttgccaaggaaccagtagggtggataggtggacagctgctcacctcttggtcgacagctcctccattgcgtgtgtcttgcaaaaaggggatttttatagccgtattgtgaatctgtgtgtatgtttgtgggtttctgtccattgagatatattaggtgatatttttgtgtaaataacaattgatttcccttttgctactggtgatatatatatatatatatttttacgttttggagatgagaaatttcgctctttgttctggatgcagctatcccttgggcttgagtgctgttcgaatgaaccagttggtgtcgcggaagtacatgggctgaatttattaaccaaggtatttggatcattttgatattgatatttagaattttccagggtgtacaagtggcagtgaatatagcactctctgaatattaaattttgaggcagtttacaatgaaatattgtaggtcatcaacaaggcaagcatcagaggaccaaggggatctccatggtagaagtttgaactttacttgaggaaaacagccatatagctggcaacaagcaaacaccaggttagtaatgagatgctttctatatatattatgttctactattgaatattatctgcatgcttggtactgaatgcttgggaaaaaaattatagttgtttgaataggcttcatattttgtgtgatgaaaataattgattgcagcagtagtggttattttggcaagattgccataattttaattgggaactatgtttactgaattgcctgaatgtgaatgttgtatatttgcaattgtttaaacacttaaaacatgcattatgggtctgtatagctgatctgtgaaaattaacagaggtgcaccatggataaacagtggatggataagcctaggtacaacaaatactttcaactattttaggtctctatggtccataccctttttttatctaacctggccactcatggatgtattgcacgtaggcactctagagaatattcagaagggctggacatattcctacaacatgaatttagttcagcagtaggcaacaaaatacaatgcccctgtaaaaaatgtgctggttcattctggagagatgaaagcgaagttcatgagcatttgatatgtgagggctttctacgagggtacaaaccattgatgtttcatggagaaggtagctcctttgtgaattctgctgagtatgatgaggttggggatgtggagtcaagtgaacatgatgacatctctgatttgcttcgagacttggcatgtggcttagatgataggggggaatttgaggatgagggtaattcagatgtaacaaatgaagatctgaatgctcttaaaatgctgtcagatgattatgggcaagaactgtacncagggtgtgataaattctcaaagctgcatttcatagttaaactactacacatcaaattgcttgggggatggtctgataagagttttgatctattactaaatctacttattgaagctttccctaaagggtcagcactaccaaagaactacaatgaagctaagaaaacagtgaaatgcttacggcttggatatgttagtattcatgcatgtaaaaatgattgcatcctttattggaaggatgatgctaatgccaactcttgtccaaaatgtgaaacctcaagatggaagtcagaaaacaagagtctaaatggcaaacgcatacacaaggttcctaataaagttcttcgctattttccaataaagagaaggtttcagaggttgtttgcatgctctagaacagcagctctaacaagatggcatgatgaagagcgcacacaagatggtttggttagacatccagcagattctcctctttggaaggattttgaccataagcacccagaatttgcctctgatcctcgcaatattagatgtgcattagctaccgatgggtttaatccattcagatccatgaatatttcttatagcatttggcctgttattataattccatacaactttccaccatggatctgtatgaagcaaccaaacttcataatttctttgttaattcctggtcgatatgctcctggtagtgacatggatgtctttatggagccactagtcgatgatatgtacgatatgtttgtccatggtgttagaacttttgatgcctccaagggtgagtatttccagttgcgtgctgctatattatgcaccatttcagattatcctggtcttgggtatgtggctggttgtactacctcaggtgagggagcatgcattgagtgccatcaatttacacgctctcttcgattgaaaaatggcagcaagacttcttacatgggacaccgtaggtttctacatgcaaaccacccatttagatttgatgctgattcttttgatggtgttgttgagcttgagtcagcacctgttccactttctggaaaggaaattttgaagcagacagaagggatgcaaacatcttttgggaaggatccatctggaaagaaggtaacgaaaaagagaaagcgtaaggagggggagccaattaatatttggaaaagaaggtctatttggttcaaacttccatattggaaggacttgcttttgcgtcataatcttgatgtaatgcacattgagaaaaatgtatgtgataacataatcaatacactcttgggtactgacaagaagtcaaaagacaacttaaattcttggttagaccttcaagctctaggcataagaagtgatcttcatcctattgaagtagaagataaattttatttacctccagccccatactcaatgaattctgaagagaagaaattgttttgcaaagtgttaaatggagttaagttccctgatggttatgcctctgatatacggcgcaatgtccaggttaatgagaaaaagataatcggacttagagccatgataatcatgttatccttcaacaattgcttccacttgctgttagaaggatattaccagaaaatgttagtgcagcactgattcgtgtgagcaatttttttaagcaaatatattcgcctgttatccgtgtaagtgatatgcaaaaactagaggcagaaatagctgagaccatatgtcttcttgagaaaatattcctaccctcattttttactattatgatacacttgatggtccatctacctgctcaagcaagaatagctggtccggtacattttcgcaacatgtaccctggagagaggtaattttctaaaaaaaccagtaaaataactgcagccatgccttagcacaaataaactcactttcactccctatttatatatgtataggtttttgatgagatgtaaggggtatgttcgcactagaagtcatcccgaaggatcaattgcggagagctatttatttgatgagagtcttacattctgttctcgttatttacatggtgttactcgttttactcggcgagttaggaatgacgaaggcctgcccatggaagttcagagtaccactcctttctttcgcaacattgggcgagggttagctggcaaatgttgcgtggctttagaccacaaaaattggttgcaggcacacagatatgtcttattcaactatgacaatatcgatccttatttgaagtgagctattttctttattttaacattgagaaattttcgtttttttattattgaattggcttttgaacacttgcagcaaacacattgactatctttcctcaactggccttcaaaacaaacgtgaaattgaccgtgtgcaccatgaaacctttcatgagtggtttagattgcatgtaagtaggcaaatggcccaagtaatgtgtgatttttactaaattgtagctttatcttgacaaatattatctcaataacaggtcactgagatgggtgatgatgaaccagaagagataaaaattttagctaaagagcccatcatggctgccaataaatataacagctacaccataaatggttttaactttcatacacagtcttatgatgagggaaggcctgttcaaagtagtggagtgtctctaatggctgagaccacatgttttgaaagaggcaataatgattgccgcgtagtaggaaacaagatctattatggtattataaaagaaattattgagttgaattatagcaacagaggtaatatagtgctcttcaagtgtgattgggttgataatcgcatacaggacaagtgggtaaagactgatcagtttgggataactactgtgaatttcaagcatttattcaataccggtgacaatatatcagatgagcctttcattttagcatctcaagctattcaggtttactatgttcaagatcctgttgatactgaatggtttgctgttaggcaatcaaaaccacgtgacttatataatatgagtgaaactgaaaaagatgatttggggaatgacactgaagtatccatcattttgcctgatgtgcatcccaattcaactatgaatatctctgttgaagaaactgtttttgttaggacagacatagatggaataattgttgaagcaaacaaacctaagacgtaagcatttttgtatatatattattgttgctgctcatttctgcttgtacaccaagtaatcttagtacttttcctgttccttctactgtactgatgttcgttgaagcactctttactggttggtaatttttttttatcatggcgcaggaaaaacaatggaaaaggcaagaggaaggtctaaagaaaaggttatcaatggaatggcagttggaaagaataaggaaaacactcttactgattatgaaatacgtcgcaaaggtgtcatagcagcaaacaatgaaatgttacaatctctaaacctcccgcccatgggcagcaatacgcatgttcaacaacgacccaagaaaatacctaaggttatgtgtcttgaacttctggttctaattttttagtatccaatatgtaccttttatttgacatcaaacttctgttaggtaactgatggtagaaacatggtgccatgtggagatcataacttgcggtctaggtcaagaaataacctagaggaaaatgtagatgaaaatgttggcgatgatcctgaataccaaccagaagaagatgccatggatgacaatgaaggtattaaagaaactgagctgtgctatttatggcaattcagatcgtgctagtgttatacatgcttatgcttgtttctgttttgttcagtagatgtagaagaaattcttgaacttgaaaaagttcagcagaaaaagaaggaaggaaggggtatcactcaaaagctcaacataatttcaagggtgggtgaagctaaaatcaaaattactctcaacgaatttggtcagccggtggggcttgattctgaggaatttgccactactgttgggacatttgtgagaaagaaaatacctgttgcatgtggtgattggagagatgttgacgtcaaagacaagctgaaagtatgggaagatgtacaggtagattgactgttatttgtcttgttccattaattttgtatatcctactaattcaatattttttatattaaaacagaaacattatgagatcaatgaatatggtttacattttgtgttggagacatcacatatgatatggaaggattataaggctgatttgaagaagaaacattttgatgcaaatctgactgatgaggaacttatggacagacgtgacttaagagtcaacgaggcacaatggaagtggcttattaaccattggagatctccagaagctgtggtaaggcatccagtgttatttgctgtactttacattaaaatagcctacatattgtgttcataactgttgtgtaggcccgctccataagaggcaaggcaaatcgcggaatgttgcgcatgttacatacagctggtagcaagagccacgctcgtgttggccatgacatggtaacataagtatatcatgttagttcattagatgtatgacttacaaagctttgtgtactctaacttcttgttttagggtgtgaaaactgggcgtcctcctagaagggatgaagtctttgttgaaacgcacaaacgaaaaaatggagaaattattccagaggctgcagaaacagttgtatgctttcattttctaaaacagatttcatgtgaagaatactacttgctaatatgtttttccaacattataggaaatgctaaaagaggctgcagaagttaacccagagttgaagaacaaaacaatccaggagggcgatttgtattcacgtgtttgtggaactaaggaaccaagaggccgtgttcgtgttttaggaaagggaccaactcctcaggatgtgggcacaccaggaacacgtagcagaatgccaacaagacttcagctagaaatagaatctcatcgacagaccaaacaagaagttgtatgtctgaataaacgcatggacgacatgcaacaacgttttaacataatggagcatatggttatgtctcaaggtgtgcagaatatagaaacaagttcccatcatgcttctaattctcgacatgctgaggtaaagtgccttgcctatctagatttatctatttgatttcatgttatttggaaatatgtgttgtatttattgcctacaaaagcttatgtcattatgttgatttggttgtagagcccaaggagtccagtacttgaagagctgcatcctaatgagcctaccaataggcacttgctggaggagcctcatgctgagcctaccagtaggcacttggataatatcctatcgggtgatgactttattatccgcaaaaaagctataacgccaagggtgccctcaagaaacacagccacaggaagccatgaagccaccattgctgaaggagaaaatcttgtaatttttctcatccttctaaacctagcttttatttaagtcatttaaatgctattggtattaattggtcaacatactgaactgaattgtgtcctttaggttggtaaagatgttatcttatatgctgtcttgagatctgacacccctgtggctaaagcaacaattgtatcaattgatccaagttccttggtgggaggtcaacctctaggtgttgaattctatgaagttgttgtcaatgtcgtgcttaaaagagatgcattgcttcctcgtccatatgatgatatgcaaactatggctgatgctcagtacacatccattgcatggccaaacaatagggtaaaaatctgctgtcaaatccttactacgtgcttattgtttctatttttgttgtaatggcttgccatcaaatactaactgtatgctattttcacctttcattttggcagttgaatgttagcaagaggtctgctatgtccaaaagtgctaactccaaaagtgcaggtatttacttccagtgtttacttcccaatagatgaactgagttgttagtaataacctatgcatttcagaatacttggactgcttgttagtaataaccctcacttgttaaacatttctgcatggttcaaatcctctagtgcaaggttcaaatcctcgagtaaagcaatgtgtttgtgtacaactaactagtacagactattgcaagaatagttaaacttcttttttagttttgaatataatgttagagtacctgagaaatatggattatgattgacctaaaatagatttggaagattgtcctgatttgcacctattatgactcctttcagtcatgggagctttttccaccttattaacttcgtaaggattattttgcaggggttgtttagtctggataacaaaatgctggctgcaaagggagtattttggtcaaatggtggctgatgaaaattaccaacttagggtagtgcacttttagaaaccatgtaacttgtatgccttttgtagtaaacactgcttgtcccttgatcgtttcaacaactgatgttagaagcatgtaagcttttggagtaatgacttgtagttgacatgaacctgtgacaacaaactgatgttagaagcatgtgaacttttggagtaatgactcgtagttgacatgaacctatgacagggcagcaatatacatgttgatgtaatcttcggggctaatgtctggaatttggtgtctacttccactcttttgctagttgcaattatcagtaatttgctattgaattggaatgtgaaaagttggttgtattcttgcatgtcggcagaagcatattaaccacagattatatgtgggcatgtgatgtgtgcggcgtctgtggacaaaactttgtctgtcggtagaactaaaataataacgtcaaactgtctgtcggtagaagttctatttgtcggtaatgccttatcccgacaggctttccaccgacacaccctctctgtcgccaaaggcctttgccgacagactatttgatgataaaggtggtcttcgccgacagattaattgttgccaattttgggacatggtgtagtgtacatgggtaatagtgtacataacatcgtcatgtaaatatatatatttttaaggggatatcccaaggcaaccgcctatgcgcatcgtgttattatgagcggccacttaagccagccacctgggtagattgaaatgattttcatgggtggctgctgttagctgtcccccacagtatttgtttacatgggcagctacttaaagcaacatttttttttattcttgtctgcccatgaaattaagggggaggggcctttgaaaatcgtttttctactattggttgcaagggtttcaaaaaaatacccatgtaaatgggttacatactgcttgtacacatgttttctgtaccggtgcaaacaaaaattaaacttgagaaaaaagtctaattcaatattgggcctttataggtacaaataaagatcctcaattgtgagattgtgggtttaaaactagttcctttaaaaattaaacatgaacaaaagtcaattctatgctatgctgattatcgatccatgcaaacaaataggaaatacaatgtcctaaaacctttataaaatatataaagtcatgggcttgatcttgagacatgtaaattctatatatttttttccagctcgtctgtttgccaatttccatatatttgggagttcagtggtcatctgtacaattatgtgttctcaatcattggccgttgtttctcctaactcactgatccttttttccgccaatattgcctgcaataatcttccttcattaatccatatgaagctaatttccatgtaaacaaataaactttcatttattaagtatggtacctgtgcctcccactttgttctcatgataatgaaaaatagtatggccatctggagtaatgttcctgtcaacatgcccatccatatcccctggaaagttgaagaaacatatagtcgtacttaatagaagtgctgatcaatggggctaagacaggagtacagcgagaaacatcgtaccaatgcaccaagctttagcttgaagccaaagagaaccccaaatgggatccctaccaagtagtagcaaccgatgttcacaaatgccaccagaatttgccaacctgctcctactgccacacctgcaaatttagttgcatagttgctcaaatttgttggtgttcatgcatgttcaggagcagcaacacaagagttcagttcttgagcttttttttttcttcttcttaataagttaaatacctgaaagcacaggcccgatattgccaaaaaagacggtgacagcaagtagataccccaatcttgcagctccgtctaccacctccttgtcgtcgctgaagaggcttggcaagcttgttctccaaatgaagaagattgacatgaaaatggcaccaatcatggccgatgttaatgatgccactgccactgagaactttgcctcctttggtcttctcgcaccgagctcatttgatactctgacgctgatgatgtagaaaaaaattggttcaaatatttttcatcgtgctctttgaaattcaaaactattgcataaaaagaaataaaattgacacaccaagccaagtaaaagtatttattaattactagcaaaaatgcatatgcgttacaacatgtgaagataattttcacgatcgataaaaactctaccaatttaaacgacaaaccgaaataagacaaacaaaacaatagcaaaaaaaagtcagaaatcacgtatagcattgaacccggttgcactcgattcatgtattctcacacaaagaatctcttatatagactattccatagcctcataaatcgattaggtgtctatactataaggttatgcatgggtatttttctatacctcgtcaaccaaatattgaaattttgattatttaattagtgaacgttgttttactgcagaaagaaagcatttgcaaaataacaaacttgccgcatacacaacttaaacaataattcaaaaggaaaatatttatgaggatcctcaaagactgggccggcaaattctgtagagattgacgaagtcttagtgaacgttgttttactgtagaaggaaagcatttgcgaaataacaaacttgccgcatacacaacttaaacaataattcaaaaggaaaatatttatgaggatcctcgaagactgggccgacaaattctatagagattgacgaagtcaccacagacgcctcggtgtcgacgggtacgtcgcttaccactgaaagcacaatgccgtaaaatcctagaaaattcgctcccatggggagtcaaacccaagacctcaagtgctactgaggctcttgtaaccactaagctataggccctttcgctatgaggagagaaattggaagagaaaaggaggagaaaaaagaggtgattagaaggagagggagaggatgaggatgattgggagaaaaggaaatgagaaagaaaacgggaaaaaagggagaggaaaaaaaagacgttgatcaagggagcgtccagcgtcgagtgaaggagcgtgggacagggtggcagaatgttgtaggctagttggattgggccaggagcaggaaggattgggctagaacagtagtgtataatagttattttagactcacgttaaattggattcaggtgacgtacaagcaactcaaatacggatgacataccaaaattccgacgaaactatattcaatttttataatagttaagatataatttattccgtcaagaacaaactatacttattattcacacaatatgcaacttttaattagcgttctaaaactattaaattaaggggaaaataaaataatgaaaaaactttcagaatgattttataggtaattttgaagccataaactaattgtctttttttgcggggaagccataaagtaattcgaaagtatgcaactgttaatagacttaaaatgacttattgtgaaaataaaaaatattatttaagcaattaagagtatcaccattcatctgtgcatgaatagttcgattaagtaatatcttaaaaaaggagaactatgatatccttatatatataataatctgctaaacttttgtatgtaatatcgatagcatgtgcaaatatataatacgagttaatggccattattgtgtatgtacctgattgcttcgctgaagcccatcgcaaccatcatggtccagaactggtaattgatgctgtaaattaaaatatcactcttgtttttatagaaataaaaaaaatcagttatagccaaagcttgcatttgtgtttgcaggagggctttgtaaattaacaacacttaccaaattgacatgatatcaagctggagtctggcattcttaaggagacccacaagaatgagtagtgcagcgtagtaccaaaactccaagcttaataaattaaaaaaacagtatcattaaattatttgtatcataatttccttataataataattaataacaataaaaatagtaaaaaaattacaataataataatgacatatggcaaattattaattactagtagagtaataaaattttgagcgaaaaactttcagaaataactataggataattgaactataattacaatacaactaaactgtactttcactgaactacatgtaactataatataatttatatataaattatatttaattatatagtttggttggttagcactgggatattacgcgtgatatgtgtgaaaatttctttgtagcaatttttctcttcatgcacaaatctttagatgattcgctaccaattagaaagttttaggggaaagaaacttgccaaggttttttttagcaattccgtaaacaaatccgaggcgaagggttgaattaattgttaccgaccagatcatgatggccgacacaagtgacagcttgacgaacgcggcgaggttgctgaacgccgtcatggtgaaccccttccacgcgtccgggaagcggccggagacaaggtagacgaactgcgcggcgtcgatgagccagtaggacaggttgccggcgacggccgcaccgcgcaggccgtaccggagcctgaccacggcggcgtaggtgagcgcggcgtgcacggcgagcaccgcggcggagatggcggcgagcgcccagaccctgctctgcgtctggaagaacttctggagcgggaagttggcggcgtgcgcgaacagccgcggcagcgaccacagcgcgtacggccccgccacggcggcgacgtcggccggctgccggaggagcgaccgcaggatcggctcggcgaaggcgtacgtcggcgtgagcgccaccgcggtggcgccgcacacgatccacgactgctgcacgtagaggccgagcacgtccagccgcccggcgcccaccgcctgcccgcacagcgtgtccagcgcgcaccccatgccaaactgccatggacgcgcatctcacgtcatcggtaccgtccgcgacggctagcggcggcggccggccggaatgaacaatgccgaaagaaagctcgaggctacgtaccaggacgccgtaggcgaagccctccaggatgctctcgacggcggtgaccgcggcgagctcgaccacgccgaggtggccgacgaagctggccgtgacgaagccgatggagaactggagcaactcgacgagcacggccgggaaggcgacgcgccacagcagcttcgactcctgccagctccggctcacaagaccttgcccctccatgctcaccgtaccacgtataccaccactattatttacagctttaccaccatctgcatcttgcaacaaacaaggagagcatgtgatgagtttgttgggaaatggccgtggtcctagctagcttccgcagacaaattattgtcagataatggataaaatatcataggaagattatcagaaacagtaagaggtttgcagctcatcttccagcagagcatattgaatgaccattttatagcatgggccaccgaaaactggacagcaccggatgataatgctaaatgcaacgccctttcattttataactaatttactagattaccccgcgttgctccggaattgtactatgatcgatggatcgatggtttaagtaccaactgaaaaggagttacataatcacgacgaaattaaagcaaattggtatcaatcaaattggtgcaaaccatgaatctccaagaacagaaagatgaaaggcagatttagtcgacaaataattatagcatacagtaactatgattgtgatactcgatgacgaaagaataaacataaaactacaaatgtaagtgcaaagagtaggaaaagtgatagacaaattatttaattaccttaatattgaatgccatattcttcgcgtggtcccttcatcaccttttgatagataagtctacgctcaaaaggatgaagtaaataagcctccttttacacataacatttagaaccatgctatatgtccgacttgtttgttcgaccggtgtacgactaaacgggaaatcagctgggcacgtaacgccgtgaggcaaagtcctgtagagatcgacgccatgcattcgctagtgttacggtcgtacaagagtcggacataatggtcagacgtatagcatttttgtaacatttagtggagccttaacaaacgattagcagtagcgctaaataagatactccctatgtaattataaaggaagtcgttttagacaacgatacggtctccaaaacacaattttgatttcttgtttctataaaaatatttattgaaaagtgatatatgtatacctttatgaaagtatttttcaagacaagtctattcatataatttttatattttcaaactcaatatttattgaaaagtgatatatgtatacttttatgaaagtatttttcaagagaaatctattcatataatttttacattttcaaactgaacaacttgagagttattcatgatttatattcccaaggtttgacttaaacatgatcctaaacgacttcctttacgagtacggaaggagtatggtcattgagttcttagttaaatctatataaataaatatagctttgtttgcctttgagctgccatataagattataagtgtgcacgggcagatatagcgtgagtgctgggtgttcaagcccccatcacgctggatcactattgatatagaaggagaagggaggaggaagaagtgtgtgtataatatttatcacagtagtacatgacctcaacaagtcatgaatggccaaatatcccaaaggttcaggataagttagtagttatatgaggaaatcccatgtatacctctaaaactttgcctaatctcttgtatgtccctgattttactaattcctttgcatacctcaatatttagtttggatcacttccatacctttttattagttggccatatttttttcctgtgtacggagaatcatatacatttataaagtatattatgggaatattgatattcattgtatgcgactcttatatttatgggatatattatttacgaaaaaatttatctttacatatggcataaaaggaataatatttacttttaattattaaaaatgtatatgtagcattttttctatgatagcagtgtataggtcaaatctatttatatgctacataaacatttttttaataactaataaataaatattatttatgtcatatctagagataatcttttcataaaaaatatctcccataacaaactcataatataatagtcttatacaataaatttctaccctctaacaatatactttacaaatttatatgtttctttatactaaagggcaaggtacacttttttataggaatttaacgattaaatcacggtcaactaatgaaaaggatatgaaagggatccaaactaaaattcggggttacatatggggaatgagcaaaatttaagagcatataattgattaggattaggtaaaatttcaagggtatatagggatgcatagacaaaattgcaacaatctgtatatatcaatcattctttttagaaaagagaccaacaaaatttatctagcttgtgtatgagagagagtgtgagaaatcacctgccaagagacatatgggaatgttttatcccgtagcaataaaatatgacagaccaagactctttccttcaatcatatatatgaggggcaatttctctcccaaatatgattgctgagcatacaataaaattgtaaattgaacaggtgatgtcgatcaagcggtaggtgtctcacaatctttgaggtgatgttgatcaatattaggtggcctaacagaagctcccctgatctctcgcaaaaaaggaaaaaaggaagctcctgtgatcgttgtgtggatgaccaaaaagcattaaaacatatatagtggagtcggcagtttcattgcacattatttggccagaattacttgatattaattgaaagcaaaacggcaatgctattgtgcgtttgggtgtcatttacttgatattaataggaagtagcaatgccaatgtgcaattaaaggaagtgtttcattttccaagtgaccaaaggtaggcagcggccaggaatcctaattcgcgagctatacaacctagtcatctcgcatgcggcttcccgaccatgtgacgacaagcatcggggtagggttagggtttcgggagtagggtgggggagggtgtcgctgggaaggggaagtgcgggatcgggttagagcgatgatggtttgagaagcggtggaccgatggtagatggcaaacaagagcgggctgcgcagcggcgatggtgccactagagctgtggggatggcaacgtgcagtgggccagccaagggcaaagcgaggtgaaggggagggagaggaggctgaccagacaaggccacatcggcacgttgatgcctttcggtgctggcgaggctcagtgcctgcgtggttggtgtcggcgacgaagaaaaggagctgacctaattgctggagggaggatgagggggctcgccggagaggtcttcgttgtcgtcgtcggcggaggaaggccactcgtctacatctcctcttctccatcggaagaagctcgccggaggaaggaggaggtgcgacttgcacccctggtgcgaatgcccgaattaggaagctccgatagtggcaaagcttagttgtcattccatagattccatagattggccaatgcaatagtgggctattgttggataggatctggtggcctcctcgtatgcacatgcgtatgaagaaacatgtgagccaattttgtggcccgatcttcacgatggaccaaaacacttgatataattgttatcaccacgtgacatgacaaaaaggcaatgcaccacgagattttgcacacgggacgaactacaaaggcagtcgcccttccaagtaccgatgaaactagcccacacaatcatgtcgtatagacgtgagatgaacagatgaaccgcagttcaacattctacaactccctcaagaatcaaaagaacaaagcttgtaaatccctctagactcactataattcaatttttataagtgttcagttctgaaatcagaatgcaaacttctctgtacttagctatttaagtgatggtccataggcgttatccaagaaactgacatgcatgttctggacatgtccacgcatgcaagtggtgatgagaaagataattaagacataacgtttattctgatttattaactccatgtaacagccacagtgctaaatggacttcattagatgttggcttctctccttcacatgttgaatgcctttgaataatccatcatttatgagaattataaaacacacgaatgaaagcacaatattttctaaaacatcggtattaagtaaactagaggatgccccgcgcgttgctgcgggacttggttaacatcaatttgttagataggaggtataatcttaagaagaaacagaagaaacaaatagctttcttggagaaattatttttagcagccctatccaaaatttgtagataatttaggtagcacatgtcaactgaaggggcgttcagtcataaagctcttttatacggattaacgggcttgatacatgtagatgtgtacggagatgggccaatgtgttcatgtgggctacatgtcactgaggaggcgaagagactcacccggtgactaatgggttgggctctatgctgcatagcatccaacgtctgagaagcgatctaatgcattcatccaacggttcacaatttgatgatgacgtggaagcacgagttttaaacttttggccttaactttatagaaagaaggaataaatattaggtcactgtgtttgcattttcttctctagtttctatacatgcttctaataattggaccaacaatgtcaacaacacttgtattagatttagatattgtatatgcattagacatttcctcattacctcccatataggtgttcagatatggaccacgctcaagaagcggtttgagaagtcaaagtacaccatcctaccccaagaaaatcagcagagagctcgcttgaggctcgccgactacaactctaccttgcacctgatctgtacctacctctccctttgtggaaaagtagtcacaaaattggacaagattgagaagatgctctccaccttccaccctaacgtaacgcagagctctcgtaactataggcatgtagcatacaagaagtttgatgggatgatcgacatcatataggtgtccaagtctcatcacaaggttctccacgagaactttgtctcctaggcacttggcaagagcattggccttgatgtcaatgctagcagttacaaggtctgcaagcccatccaaaagaagaggggcaagcaaggtgggagaaaggcagccgagaaggcataggaaagagctccagatgcctagagacgcaacgacaagcaggaaaccaagccgcccgcaatgacaagtcatacgacccgcaggaccagacatgctacaagtgtggcacagggctactggaaccgtatctgtgaggagccctattgatagtcgttatcgatcagtttcgcccgtcaatatcaccaaaataaaagagaactagttatgcttgcaatgcatatttgtgttagaataagttgttttccactagcactaggattctaacctcttgcagagaatacaatacaaaatggaggagaatcgacagcaaagcagacgataaatcaatcggacattgtcgagaataagacttatcgaaagatgggccaagaactcagaaatgacacaaccaaactggaccaaaattcaaaagtctgcggagagaagaagtcaaataggctgccagcagataatggataggattgggccagcccatggttcggccgaacccccaccagcgtcgttggatgcagggcttagcgtggacgtctaggattacatcccaatgacggttggagagcatttccgaccattccaatcgtcataaccgtcattgggaggctatttaaggagctctcatccttcactcttccacacactcaggcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38081 - DNA, 2753 bp, Oryza sativa
tcattcatttgaaaatcgtaatgatcaaaaggtctttatatttaattttcttcgctctcatagtgatttcttgcatcattgatgtcaaatgtttttacgctttctgagcaaggtaggagtactcaacttcgatgcttgatgatgaggatcagtagatttttttaaaaaaatctactatgtaaatcaagttatgcccgcaacaacgcgcggggtgtcatttagttctacataaatcataggaggcaagtcatcaagctgcaatgggtggatgtgctgctaaaccaagtcacaaatgaaatcttgtaaacaagttatggttggcacccaggaaggatattagagtgaacacaatgcgagtgacacaccatgcaagcaatgaagatctggaagtgacttggagcttgtgtgtagttcgagttctgcttttcctgctggaattaaaccctaccactatgttggatgttttatatttttagatttatgcatgtattgacggtttaaatttggtatttaataactgtcaacaaagagcaacggggactgactttgtagcctttttgagttttctattgtcgatagacatcctccagcccgtgacggtacgttgtgggatcaactcgtttttttgagtttttaacgattgtcattccacctttcttagacactacctgaattgggctaacccactctcacatcctgattttcgtttcagaatttataaattatttttagaatttatattaaatgtttattaatttacaaatgaagttaaatgtgggaaaataaaatttcctaaatataaagcatggctggatttaatttgtattaaattatccattattaattacactcaacgatgcatatcatagaggatattcaaggaatggttaaaggttctttttgtgtaaagctcattttgtaattcttttcataagcctaagacctagcatagactgatcaggttttaataccattattcattaaacagtaacgcttctgtccaccatccgttgtgatcccaaggatagcttccggccactggaccatcatggttttctagggtctaccctttctcgcttttcgagaagttcatccaccagtacaaaatcatcatgcatatcccacccatcattttaagaatttagattctaggcaagtgtaacacatgtcccggtgctcaatatccacgcgcacagctattcgaatatgttggtttactcacactgtagtggatatacactccacctgtacgccgtgacttgcccaacacatgagccaaagtccgaacgaatgagatgcgtcatggcaaagcctttcaataacctcactttggcagtacccgctccatgaacttgagccctcatgcactctaggcatacatggtttctagtagtgagaggagttctggcgttcccgaggagggaaaaactcacacatgcgttaagttatagttaagttaggttttaatttggttgcccacagatggttacccaccgtaggctccccgcctattcacacacctagatgaaaaccagtgcacttgggtaccacctctgctcggctatttactccgctaggtctatacccatacgagaagtatggttgtactagggtcatttcatgcttagcttcaaggcacggtccttaacagaccaaggacggcactagcctttaccggacaccacccaagtcatccagccactagtctaaaaacatttgtttagtttagatttcctttcacaaaccattttgttcatgttatatcaaagtggcgctcatgtctccacatgccgtatatcaactagcttccccaaagtagatgcccaagcatttaggggctgtttggatgggactaaaaatttagttcctatcatatcggatgcttggatactaattagaagtattaaatgtagattattgacaaaacctattccataaccctagactaattcgtgaaacgaatctattgagcctaattaatccatgacagtaaacttgtgctaattatggattaattagacttaaaaaatttgtcatgtgaattagatctcatttttgtaattagttttgtaagtagtctatgtttaatactccaaattaatgtctaaacatccgataagtccctggatccaaacaccaccatagcatttgataaacatggatgtgcatgaatctaagtggcattgactaagcagttattagatttacgagacacaatattgcggatacaaataattgcagggaatcaacatcaaagtatggtgtgtgtgtatatatatatatatatatatatatatatatatatatatatatatatatatatatatagcatgcaaattttacttaaatcaacataacttcacaataggtttaacatgctcaaagattagagatgacttgccttgctcacagccttgctgaccctggtcttcactcaactcatcaacttcctagggatctagatttagacacgaaagattttatttgaattcgaatagaattcaaataaaatcaccataaattcatataatacaaaataaatgataaaagtgataccatcagatagatcttgatcttagataaatttaggtttaagtttcattcaaatccaagctatgctagtttaaagattcaactttgaattaattcgaataattgtgaaatggcatttgacggagctcggggctcctcaccgggagaccgcgcaggcccccctttgccagttcggccgggggcttagggtgagatctcaa

SEQ ID NO: 38082 - DNA, 1271 bp, Oryza sativa
atgtagcccgacagacttcttctcggccgagtgcttgctcgcaagatgggccatctcgcagctttccttgtcgcaggtgatagcctgcttgacatcgctgcgcagggatatgactcctcgtggtcttggcatcttcatcatcatgtaggtgtaatgtgggatggccatgaacttggctaacgccggtcgtccaagcattgcatgataagctgtctcaaagtcggcgacttcaaagcagacattatctgtatgaaagttttccccagtgccaaaggtaaccggcatagtgatttggccgagtggtgtagatgaaaacacaaggaagactccgtgaaagggtgcattcctcagccgtaactcgatcctcgagatctgcatttcgtcgagagtcttggcgaagaggatattgagcgctcttccgccatcaataagggttctcttgagcttcacgttgcgaactactgggtctagtactgggggtaccgccccgggtggaccactcggttgggatgatccgagcgatcgaatcgattgcaacctcagaccattgtaggaattgtggtactcctggctggactgcgttgatctcccggtcggtcagcttctgcttcctctggactcgtaggcaagtggccctccgaagatgtggttgagctccttccttgaatcctgcaaagtgccttgagctggctcggtgtcgtccttcttctatgttgacgtgtcagtttccccttaagtcggcttcttgaattgagcgacgtactgcttggcaaactgcttgtagacgaaacaatctttggcagcgtgcttggagttcgggtgaagtgaacatggcgcattcatgatcttgtcttaggtgttgacacgaattcgttgatgctgaaaagtggacgtggcggcaaccagatcctcgggcttacacttgcgatccttgtggtgagtgttgctgctacttgcaccgttgttgccactgtccttcttgggcttccagccactgccggactgcttcgaagctaagactgcgtcgtccgccttggcgtactcgttagccttctcaaacatttccttgaccgtcctgggtggtttgcgtccgaatttgccaatgagtagctcgttgcgaactcccttggtgaaggcggtgatgatattgccgtcggtcatgttagagattttgttgcgcttctctgaaaagcgccggatgtaatcccttatgggctcattaggcttctgtatcacattgtagagctcgaagtgagtgcttggccgttcga

SEQ ID NO: 38083 - DNA, 1045 bp, Oryza sativa
gtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcagttttttttactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggatacc

SEQ ID NO: 38084 - DNA, 305 bp, Oryza sativa
agaattcgaggtgataatggtggagattttaaaaatgcttcttttgaacaattttgcaatgaaagaggtcttgaacatgaattttcttctcctcgtgttcctcaacaaaacggtgttgttgaaaggaaaattcgtgttttggttgagatggctagaacgatgttggatgaatacaaaactctataaaattttgggctaaggctattaacactgcttgttatatttcgaatcgagttttcttgcgatctaaacttggaaaaacttcttatgaacttcgatttggtcatcaacccaaagtttcacat

SEQ ID NO: 38085 - DNA, 794 bp, Oryza sativa
  unsure (1)..(794): unsure at all n locations
accggcctaatccttaccgttggatttagatccaacgtagcagctacaactgcttaagttgcagtccatactactactgcatttaatccggatccgatgtggataggagtagtaggcttctcctgaagcgagaaaacagcaggagaaatttcgtcagtgtaggacagacaaattagctatcaaaccattgttataatattttcacatggtcaatgcgtgatgcgtttcgtcagtgaatgacaaattagctaccaaatgaaatgcactcttctctgtttctctctattttcacgtgatccatgcgagtgaaagcgtctatgttgcctacctagcatccgtgcttgcaacagctgagcgaagaggaggaagaagcagaggagaaggagaagactatgagacggtgatctatccatgatcgatagatgcaggagcaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38086 - DNA, 774 bp, Oryza sativa
gatatgattcagagcaaacctttaagctttttaattgctccctgcaatggacacacaaacaaacatgcattagaaatgcagaagtggtgtgaagtcggttgtaaagataatgccaaactcacttattagcactgttgagaaaagtcaagcactcttgagctagagatttctgtgggacataaaaaacaagagagaattcatcaggcaagatgattataagaaggtacaattaaacacattaagcgaataaaatgagtcagtgaattaaaaaaaaacaggttaaccttaatcccagtgctgtgggccataagtttatccttgggatcttccgcttgctcaaattacaaatgcacttcaggagtttttggctctggtgcaatcgtgttgattctccggacacattctatgttccacttttctgccctcacgctcactggccgagtgctaagaagcttcaatgagtttgaaatctctctcagtcggtcactcaactttggggaggatagggtactgctggcaggagtcttctcaacaaggttatctgggaatgccagtcaggtaataatgtgatcatactttgcattcacgtaatgaacttggcaacaaataataagagtgatgctataacagtgatcccatgtcaatacatgaattcctatcggccagtcaggaaaaaaaattggggaactaaaccaggccatagtcctgaacaaagtaacaggggcactacgtatttaatacagaactgtaaacagataatgagtattccttgca

SEQ ID NO: 38087 - DNA, 673 bp, Oryza sativa
ccctctgttccatatatagatggtgtctttttcctatgaaagttaagttttttacgcaaaacaacgtggtattagcgtacaattgattgagttttaattactaaaaatttgaaaaatagattaatatcatattttagagtaattttcatatagaaagtttttacgcaccgtttaacagtttgaaatacgtgccacaaaaatcttaatcttcatataactcttattggagaaaataacatgaccatataaaggatttaaaagagatatgatatattctagtactacgaatttgaatactcagtctgtctagattattgactctctcacgtcatctatacagtctgatgttcgtagtccatctccagtgtgcctggaaacaaatcgagagaggcaaagaatgatatttggttggatttgtacactggagcaaccgaacaccaataaaacgcaaatttcttcggttggaacaagggggacaacaaaaacaaaaaaccaaagtagttcaagcagcattagctagcaaccacacctcagtcctgttcgtggtggggagccgaggaggaggagcagtgcccggcggccagggatcgaggcagggagccagccagccaccccaaccgaggtagccatggccgtgaagcctgctgcttcccatgactgtcgccgtcggatc

SEQ ID NO: 38088 - DNA, 714 bp, Oryza sativa
ggccgagcacaagccagttatgctggctcactccgtgcgttcgtccaatgcggaatggacgacgtagacgtccatctgacgtcacgagtgatctggatccaaattatactggatgtatatttgagggactcaaaatggacttattctgccaacatgtactgtcaacacaaaaggtccattttgcctcttgtaggtagggatgaaaacggtacggaaacggacggaaaccatctttatcgttttcgttttcatatttttttcggaatcgaaaagcccggatacgaaaatggaatcgaatattatcgaaaccgaaaacggagcgaaaacgaagtggcacaaatacggtaacgaaaatttatcggaatacagaaacccctcaaactgataaatccaattctcaagtctcaacggtcaacaattcatcgtaaaacacaatcatataaatccaattgttaagtctaaacaatatatcacaaaacacaatctatgaaataaattatctatgtttaagagagtaatgttgttgataaatcccaacgcagaaaaaaaatattcttatgtaacttcatatttacataacaaatatttttttaaaaaaaataaaagccaaacaccatcgtattcagtacttaaaaaaagaattcaaagtatttcagtcacaaaatttccggaaattccgagaaaatttctagaaagttctaactgattccggaa

SEQ ID NO: 38089 - DNA, 11519 bp, Oryza sativa
  unsure (1)..(11519): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttaatcttattattattatacattttagttaaggtaaaattcactatgagaattcgattggatttatgtttctctacaaaatcatgagatgtaattaggagttcgatcatctcaagttagcatgcgagttttttaaagagattttttatacgactcattctgtatttccaaaagcgaacttaaaaccgactcaaatatggatctgcattttcaaaagcgaacgaacttaagaactgactcatacacggatatgaatatgaatgtttctaccattgacaaattaacgataatagcatagtgatcattattgtaatgtttttctcatcattgttgtaatgcttcattgacaaacttaatttacgttgtttttctcatcattgttgtaatgtttcagagcagtctctacatatacataaaaaatacactgaagaacctcctcaaagtcactattactatcatgatccgattgatttggttggactaattctgtagcaacattcgtgaaactgtctacgaccaaatagttggaatgcacaacattatcttcgtctgtatcacactcactctgagaatacctatatttaaaaacaaatttgaaagctattgcacataaaaacacaagtaagatcgtcaagcgtttcatacatcataccagtgaattgtaaaaatattagagacgagaatttttgcattgcctttgtagcggcggagaagggggaagcgggtgaagagcagcgtaagtagcatcggcagaatcgaggtgatttcttatgtctccactgttgtcgccgtcgttgtccatcactaaacaaacctacagatcgcgtggcgttggcttacatgcaggattcggtttggttccgccgactgtgcatctggaacgatctaacaagaaagaaataaagaaaaagagtttggccttgtttgtttatatgggacgcaatcttgacctataagcatatacggagttctgatttatgttcgaatttccgagcatgtacacacattaattggctaaaataattaattaggcccaacccatccagagaaggaaggaatgccagcgaggttggataagcgcccactaatcaggccaagcaaataagggggagtgtctttccaaatccttttcagtacctgaatctgaatttttccatatgattttttttgacagggaatcctatcttataataaaattaatgtccactaacttctaaaactcaacatgcaagtgtatcacatcatcatccactagcaattattatctagagtattttaaatcatatgcaagtataccagatcatcacccactagcaattattatctagagtattttaaatatcatgcaaacatgacatatcatttaaaattttattgtatttttagaactcaatatgtaagcaatgtcaactcattatctccacatcattttcacattatttaaacatacacatctaacatttctataatgtataacatgcattcatccacatattcctcagtaaagcacggggtgtcaactagttttccagatgattgatgtcaggtgttcatctacctggagaagtttactatcatatgtttgagtgttcacccatgagtagatcgacaccgcactactgttccccctcatgtgaagtttcttatcatgcatgtgatgacgcatatgctgaacccagtgattgtagttgacaccatcaaaaatatccgggcaatgagaaactgaaattgtgcttgacaaagaagacatcatcaaagatcaatgggtgacggagaaagcgcaaaaataaagtggcagcaagcagaggcaggaaatgtctttctttctatcttttcctttctttttttttaagtaacaagcctcggtcaagaagaagaccacgagtcagcagtggagaagaccgcaccgcattaccgcaactacgagagtcgctcgtttttttagtgaattgcacttcgggccatgttttattgccaaaatattacttggaccatcctatacctaatcttttcacattagaccagataactttacctttgttgcataatagaccaccctaactctattttctaatcatgtctagtgtctccctcgataaaggtatgacatgcatataggtatgaaaattcgtcgacatgtcattaacaatttgctcgaagtcattgaagtgctaaagatgtggcttggggtggtcacttgtgcaacaaagataaagttatctagtccaaaataaaatgattggacaaattatggtccaaactgaaacttttgcaataaaacatgacccaaagtaaatttttaacttttttttcactcggatctgatcggtcaaaaagaatccgaccaaaaaagaagtgacacgcgaacaagcaagcacgcgaagacgagagacgaccagcgaagggcggcgcagccaagaatgagcggcggtcagcaggcagtggccggggatgggcggcatcggcgaacaggtggcaaccgacaatgatggtggtagccggcaaagaggcagcaataaccaactgccacggtagttataggcccgtgaccacaacgtaaaacaaaaactgaggtacgagatagaagaattgatgcacgtaagtgaagacgtacgtagagagaaaaaaatgatcatctaggggaagaagaagagtctaaccctagttttgctctcgataccatgttatagatagcacttgtattcgtctaagggcaataagcccaaatatatacaggtacatgtgcatacaaatatgcagaaaaaaaaacctttacaaataaaggaatataaagccaaaataaacatctaacaccatggtggctctgctggtcatcgatggatgatccagatgtgactgacctgtggatcccaccaacatgtagacatcaccatggcatatcatgtcagcgcacaaagtggattagagaacgtttggacttatatgacacttaggacaagttcagggatccgaaaatatatttaagagttgaaggacctagacgatacgcatgcacaagtttagagattgcttgtacacttcactcaaaatttaatgaacattaaggttgacaaatatcaaatgatgatcttccttcatgaaatactagttacaactcacactgtttgtttacaaagattcctctcttacaataactaatgtacttagtgtgtatatgtactaatacaaataaaaaactgtgaacgaacaaaagaatggacaatcatcaatactcttcaagatgtatatcagcaattcagtaggcaccatccgtgtggttgtggaggcattagtatctgactctatccaccaaagttcatccacaaatatggttgtgtgcattgctaattggtctagaggccagaagttatacttccattatcttaaaaaagaaaagaaatttactaagcataagagaaaaacaagattcttacccagtagctcattctaaaaatgacaagtaatttcacatgggttgttgctttcactgctatttctttggaacctagttagttggatggttgtatttcttgaacactctctcttggttttccctccaccattcctcagcctgctgctcagcaaacctcctcttgctaaacaaaaaaaaaagattgtagaagaatgaaccataaataaatgatcacctggagttgttgcttcaaacaaaaacatagaaagaactatgctttcagtgcacatcttgaactgaacacacttcaattgtaaacaaaagcttcgaagtttttccttcaaaagtgtggatggtgcaagtgttgttttttgaaagatggactattgatagattaatcaagttggaagatatattttacatccaagaaggatttgaggatggaatacctgaacctgacacgcttgaatactttggtgccatccctcagctggataagcgtcacatacactcctggctcaaactgctcaatcaactgcacttctccatgagtaccatactttggtgcgaagtcacctggagccttcaagttgttttccatgatacggtgacatggagagtcactagccatggcaatggaagagccactagcatttccagaactgccatcttgagacactggcaggctacccgtgctacttgacctatggtgtccgatatcatgtccagtaaggccagtaatctccactagattactactttgtcctgcaagaaatctctccgactggctttgcaaagtttttaagttgtcagcaacatcaccgggcaccctgtctgcaataaccttgagctgaagaatggagggttgtgatatcatgagtatatcctctaataatgataaataaacatgaactttgaagcaattatgatcatacaagacactaggataacatgataaacatgattttatatcgtgcgccctttattgtattttgattgagctatagaaacgtgtcagtaatataaatggaacacaatagagctactatactccaaactatacagtagaacaaatacgtacactatcatggaaagtataataatagatgaagagttgcacagtaatagtagtttaatgtacctcactgtcaagatgcttaacaaaatccaagacagtattgcgcctagcagattcttctgaagccatagaggcagcctgtttagcttttctttctgctttctgtagttgctcatcttgagtttcacatttctgtttcaacttattaacctgtcaacataaaaaatggttttaacaaattcagctaatcacattgaagaaatagaacaatctagagtgttctttcatacctgagattgcaacttggaaatgtcttgattcagcaactcgttagtcttcttcaagccatcattgtccactttaccgatcagaggacttgcggtcgctggaggtggacttggcttctttgacggtggcgatggtgaaaacattggcatgcccatttgcatttgacctcccattgtcatagattttacggtagttggaactgtaccaaatgttcctgcaaaagccatatctttgaactgcaacatggcaggaacttgtgatgctttcatcatggacataggatcggctggttttgtctcatttctaacattttttgtttcttgatacttgactggctctgctggtgatgtcgttgcaagtctggaaggccttatttctggtctctctaacttatctttgatatcaatggatcgcctggtgatgacattccttttgttatatgaactgataacgccggtatccgcggctttcagtttcatgaaacatgaatcacatacacggtgtggcttgccaggagttggtgccaaagcagccttgagcactttcctagaactgcatgcatgacaatggacaagtccacagttgtagcaattgtgcctctttcttgtgaaaccaaatggctgcctgcatccagagcaaacagactgatctgcacctgaaacccacttatgtatgcaaatgcatgtagtgaaatttgaaccacatgaaatgctcttaacatgacgatctttcaatgcgtcaacaagagttggcttctttttgtcttcaacactaccatgtcccaaccttccattggctcccatgccccatgtatatacttcacttcttgaagtcaaggctgctacatggttagagccacatgagatctcttcaaccaactcattacccaacttatcttgcaccatacatggttgtttaccatcagcttttggattcccaagctggccattgttagagctacccattgtgaaaacatggccagatgtggcaagagcaacagtcatgctatgtccacaggccacctgatggaaattatggtcaacgagtgcttgaacacatgttggaactagcttcgcttctttatcgccatggcccaagcgattcttatctccatctccccatgtaaacagctttcttgacattgcatttgtgcttgcctgaccactgatttccacaattgctgcagaatgccatactccacatgcaactttcattgctctgaatccactcaaagcttctacctcctttggatatgcaacgctttcacggtctccatgaccaagagaaccaaatgtgccatcaccaaatgtgaaaagttttccacttgacatggtcagtgctgaatgccatgagccacatgcaacagagagtacctgaagcccttctagaggccctgaaactcttttcggaagccaatggctaactccagttccgtgcccaagtaatccagcattgtatgatccatcaccccaatcatacagatcaccagatgcagttacaacacaagtatgaaactccccacacgcaatgtattccacattggacactgccaaggattcgacaagtttgggacgacagatatcagtatcagtaccatggcctagccgtccaccaagttcttcaccccaagtgaatacttctccttgccgagtagtaaggccaatgtgcctagagccacatgctatttgctgaacatccaaaacaacatctgattctagaggttttggaattaaaaaatctgttttgctgcacaaatagttggaggatccttcagagggtagcacctcagtccacacctcaccccatacataaacatcgccgagggattcgatgtcatctagtccagaactttgactggaagaactaggggcactggaaatactaactcggctattgtctcctgtacttgctcttagcatatttacgcggtctgatccaacatctgctctaatagaattcaatgaattcggtgtgctataaccagctgagttaaaactacgtgtaatacttgaggcgatatctagcgttgtatcataggaagtgctatcttgatagattgttacgtcctgaaaaaagaaacatttgttaaacaagaacagtaaggtgatgatattctagctaagtcaaacaactattacagaattagtcggtgtcataatgacagaagtgatttactaggtatattaattctctataattgtttaacaataatgattttgtatgctcaaatatggtttttgtgcatcctatatttttattagctcatcggaatctcaaggaagctgaaacctccaacagtccaatcaaatccttaaaagggatggccacatttgtacaaggattggattataaattgttgtagaaaatgaaggtgaatttttgtttgtactcgactttaatataaattaaaataatgtaaatggggaaaggagaataactcacttcagaaaatgatactctatcagtttgaccatcattcagaaaatttagacggcatgaagtaatcagtgactcaagtgtcgaaaaccacacttctacttcagcttgatccttgcaaacctgtaagaaaattattgtgttccataaactatagcacctaggggtaaaatcatttaaccccagttaatgaaaacgagtacaaagaatttatattttaccagatcaagggaacgttggccgttcttgtatataagggaaaatgataggtaatccttctcagggcgtaaaaacctcctaaaaacagcctgttaaaaattgaaaatccataagatcacaacttaaaacgtaaaagttctttggctcgaaaaaaaatgtaaaaattcattaaaatgaaacaatttactctcggagtatcaccaacaagatatatttttcttgctgcatgtttaaaatgaaacagtttactcttggagtatcaccaacaacatatatttttcttgcttcatgtttaccagcaaattaaccaccaacagttaactgtccggtggcaattcaacttacagttctctgtccaggtataactttagacacagaagacagtctgaggcacttttccttgttgtgggagtaccaaactaatgtattttcgtcctgcgataaaaaaaaatatcgttactttcatcctgtagcaaagagctgacattgattgcaacgaacatacatatgaacttacactagaaagtctgaactcacgaatcttgggttttcccttccggctatacttgataagcttgctgcctttctttaaagtaataagggccttcagatttcagagaatgtgaaaaatagccaggatcaacactaaaaaaatctttagcggacaaatttgtgttgaggcaaaatagagggaaatgaaacaggaaagcattgtgtagaagctcacattatcatctggtgtcatctaaacagcaacaggtcaacattctatttgcaactcttgatcacctgaaactatgcagataaactaacactgagttatcagagagacaataatggattttgttttcaatgacatatatgagagagttgatgtggtttttgtgcccagggagacagagatccttcatcccgtttgctagaagagcatttcagacagcaacaaaacgaaaaacactgcaagcgatgtatatgtacacaaccttcacaatctcgatatcaaatgacaagtagcggccggtttgcttcatattattagtgctggataaaatgctcgtcctgttttgggattttttttgtttttttaatgtgaaaaatttcaaacttatgatatgtatttcgttgggttgcttgaaatttgaacgatacatatttttcaccaagaacacgtcgccacagatacacaaaacgaaatgtaaatgctgaatctactgcagatgggatggacatgaggggcagcgtactgttccttaccaacaaagaagagaacgatccgagccggcggcgcctaggagaggaggatactccggcggaggaaggccgcgtgggttcccgtgtccggtcgccggcggtgaggtcgccgatcgatgattgcgcatcaccggattcccgttgagaggaggacgacgaaaaaagaggagcagaaggaagtcgtagccaacaaatgaaagaaaccaaagcaatccagcaggagggaagagagagaggagaggagggttcagcggcgccggacgcgggagacgcatcatgcattcacgcatggatggatggatggaggagaggagggcgtgtgagtgtgaccgttggttgggttcatctccaactccaacaccaacagggcgctagatttctttcgagcattaatacacgtactattttttttttggaagtgactgcggatcgggcgtccgattttagcttccacccacgcatcaattgagatttcctaccgtactgcagacgacctgcatcccccacgcatgcagacgcaccaggtgcagcccactacatgcatcggaagccatgcatccatactagaaaaacaataattaggttggtttaagtttattcgagcaaagtttaaactattttttctcttatattacttctccaattcacgattcgattgtagcatgacacatcagtaagaatttagtaagaaaatgctaggacgtatagccttctccatttctttttgcctttggattgatcatggatggctgacaacagtccgaaactctggatactttaggacatctccatcctaaaatattactcccttttattttatattataagttgtttgactttttaataatcaaacttaatattttctatacaaaataaatatattatcaaaatatattcaatgttaaatttaatgaaactaatttggtattataaatgttgctaattttttctataaacttagccataaaaaatgactaataaaaaagtaaaacaacttataatatgaaacggagggagtacaactacaatctagtatatcctgattcgttgtcctaagatgaatcaaatctcatcataggttcaatattttgggacaaaggaagtattgttttgctatacattcgccgacaactttttccttaaaatttgtcaaatataaatagtataattatgttgtaatttgcatgtactttcatataatttggtttgaactcttcaagatttgtgcaagcagagaaggaaaaaaatcacatagcacaggcacggatgaggggatttggtccccaacctacgccattgcagaaatagcgttttatgatgggatttttaaaagttacatccaagctatattgcagttgcaggttacaatgtaattgcaatgtgattgtcctatatttacatctcacaattttctgagagaaatattatcaacaaatatctaggtaatcccatgacagtttactccaactgaaaatcattaaattttaaaccagcatggttcatgcatgtatgatgtgccctataagcacatgtacctccaatagattgaaccggtatatattttgagattgactaagccatcacattgctttattgtgatgatcttccgagaaccaatcctccttttatgaatcaacaacaatgggttgctcttacacggtttttgttttgtttgcacgtgcacacagaacattcagtgtttctaagaagatgctgatggagcaccataatctatatagagctagcatagaccctgtttgaaaagtttaagattttaaaaatcaattgtttggcaatcaacttttaggaatccagaagaaaagcttggtttctcagcctttgttttctaattaattttctagattgttagctacagattatcaaaagttgggtgagaatctaaattgtttggagagccaaagttcagacgactggaagctgcagctgctataatctcatggactgtgtgtatatcaggtgactctgttgcacaaaagttagataaacttttggatactcgtggcacgcttttcaaactgctaaacagtgtgttttgtgtgaaaactttatatatgaaagttgttctaaaatattagattaatccatttttcaagtttgtaataattaaaacttaattaatcgcacgttattaccacctcattttgcgtgaaacacttaatctttatcttcatcttcatcttgagaagattcaaacaccaccaatgttggctattgctattggagcagtaccatttccgcagcagagcttacaattggattttcacaggcttaaactttcagccctccctgagaaactggaggtgagaagagaaccacgcacattgctccataatctgaaccactattgcccgcatgtttatatttcagaaccttggtttgcacattttccttcaataatttctctgtgatccagtgctggaggaaacgcgaactgaaacttaatgggccattttgacatcaggctgacgtaagttttaatccaagagaaatcttgtttgttttatggcacatctgttactctttttaaaaaaatgatctggaagctatgatcaggaatattctaagagttatcgtcaactcgtacaaaagcctcatctttacttatcagccaaaaattaaattttcaaccttaaatttagagtagattttggaattattttttttcatcatagttcattttcagcttttgcttttaattcgttaaga

SEQ ID NO: 38090 - DNA, 3686 bp, Oryza sativa
ccatttgtaaatatactgtttcactttttcatctttatcagcggtttcgctttctcatctttatcagccaaacgatgaggctgaatgtctccggtcaatgccaatgagaactaaatgtgagctcgcgcgagggcgcttcgccgagtcgacgagcccgtgttgcctccgtcgccggccaccaaaacggcacgcagccccgcacttggcatttgactcactcgggtcgccgttttttgagctttcccctgcgctcaccaactgctaactgaagctcgcctgcagcttccacttgctaatttgctatcgtgtaaaaagtttcgagcttccgtagacgagaacatggcacagatccatggtctattactattaagcacgagcttacaacattaatataatctttctagtagcttgactccgtttggttctttggatatgttcatatgtactttgctgaacagtagtgctgtacagtttaaatagactatagaaagatctcacttctgtgcaagttgtgctgacttggaattgcgtttgtcgaaatatgttctttgttttttgtttttttttcctttatccacttgcgagtatgagtcaattcagttcatcattttattaccgctggtgcaccactgcgtggatcggaggaggcggctttgtctgaatttctgaagcctccaccagagaataatactgctactgctattgttaccttccaagaatgacttggaaagttctgaaacgggaggggctgacttggaaaattctgaaaggaagaagaagaagatgatgatacacctgacctgcaggtggtagctgcagtgcgtcacagccgtcgtcaacgacgaagcctgccctgcgtgcaatcgaattaagcgctgacgcaccacgcagcttcgtgccaaaacatctagttgttcgagaagcctgaatcttctctcgagagacctggaattcgaattgttgtcttcagaactctctctgaaaactggagtctttggcatgcagacttccaccagtccagaacttattcagataaattaattgtggaaactcaactaacttctagaagtcaaatttagggtgatagttttcgtcaaatagaagatctcattatccattttctttttctgcagcaggatgctgactttaaaatggatcatggaggtaacccagcgaatacagtttagttaggtgttcctgcctctgggctctgtggcatactggcaacttgtacacctggatatctctctagaattatgcagctggcatggccactactataactcctatctcccttgctcttcaagaaacatggagaaagttcatgccaagtagtactacaactacaaggttgttcatagcatcaaggtataagtgacaatgacacatggcgatgcttttgacagtttttatcagatgttgagctggcaaccgaattactgaatctactactactctcagatgtagtagaagtgtagatgcagtgatgcccttatttttcttgagaggcactctgtaataattatgtaatggaacataaaaaaaaaagtttgaccagtacatgtatgaacacatgttctaccattacagctgaaaattattgcagctgaaaattttagctagtcaagtggtgttcttaagaactgtaccactagtactaaactactaattctgtagtaattcatgcacaagatcatagagaaatatatatgattaatttggtgccaagtaaaaaaaatgttgtggtagttcaagtactccacaaacaattgtagggatctagaaacaagagcaaacactccactccaagacggtaggcagctagggaaatctatctatccatccagtgtacacctgtccggggtgaggtaatccagagattttggccaagtgtcacccctgatctgcatcatcttcatctccccagctttcctgcagccaccaccaacctgccagcaaacgtgcacactaccaccacatcgtcgccggagcaacagcattgcagcagaagcacttctcctcggccgccgccgccgccacttgtaccgacggcagcagcaggaggagacagtgatgttgctgcagagacggtgaattggattcatgtctagattgagttcagttggttgccacatttggcggcaattggatgaaaaaggttgccattggaatgggattatgcagcttttgttgctgttgctttgagtttgagattgttgtgtatacgggtagtagatgaggagatgtggttgaacgaattggttttgtggtgagttgtcataaaggggggtcacggctacagaggctgtcattttcatgagttccaacgaacacgtctcagttccagcagtaactgaaatggttatcactggttctgaaaattcagaggtttaggtctacgttccatcgttctgaagaattaatgctgatgccgctgccctcgatttcacatttttggaggtttgaagtttcagatttgtagtttgagtttgtagtgttatcagatttgagtgaataaaatcgaaaaaagaaagagaaggggaggaacagaggcagtcaggaattggaggcaataattttacttttctttcatcagaaacatcaacatgaagtacaattgggtcactagtagtaaaatctaaataaatatcttggcggagctgttcatccacaaaggtatcaacagttcgtacattgtgcacgagctcatcatcgtcatcgtccacgtcagcatccattacagcttccgatctttcatcccaagcactcgcgtagctcgtcgtctccaaagccggcgaagccaccggcgattcagaaacttcgctgcgcgtctgctcggccggcgtttcagccgccgcgatgggaagttcggattggctgctcatgacgtcgatccagccatcgtctgattcccaatccggcacggcagagcaggggacggccagcgccatgatcctctcggcccagctctccggcatgtcgtcgtcctcgtcgtcggcgtccgactcccaaaatgcggcatccagcgtgctcttgggagagacccacttgggcttcgtctcctcggcggccacggcgcggcatccggcgagcgccaagaacggatgctccagcagctgcgcggctgtccaccgctcgccggcgcggcgcctgaggcacttgtccaggaagtcgttcgcctccggcgacagccactcggggggctccggcacggcgtcggtgaacccgatcaggcgcacggcggcgaccacgtcgtccacgccgctccagggggcgcggccggtggccatctcgatgacggtgcagcccagcgcccagacgtcggccgccggcccctgctcctccccgcgcgccacctccggcgccatgaacgccggcgtgccgccgatcggcccagccgagtcggcgcgcctcgcgcacccgaagtccgcgagcttggcgcgcccgttggcgccgatcaccacgttcctccccttcacatccccatgcaccatgcccaccccatggaggtacgcgagcccgctcgcgacatccgccgcgtaagcccggacatcgtcctcctcgaggcggcccccattcctcgcaacctcgtcggcgagcgacccaccgggggcgaactcgagaagcagcccgtactccccgccggcgacggcgccgaacccgaagcaggggagcacgtgcggcga

SEQ ID NO: 38091 - DNA, 9531 bp, Oryza sativa
tgagcgaagcctcgtgcggggtagagacactggcgtgtggggccatcctgatcgcgggggggccacgtggtggtggctttgggtggaacggaacgtgggatttgcgcgcgaggcaagtggaaaacgagggagaattgcagcacgaggagggattcggcgtgtcggtttggggttttttcgcccaaaaactctggtggattgggggaaacgtgttgcttgcattgacggatcggggctctttactatggacagatgttactactactacacaaatcttgggtatctgggtttggcaattggattagcatgacagcaactaacaaaaaaatcggatgttgggtgcaactatgcaacggtggctgtgtactggagaatatacgaagaatcagcaaggaaatgatagtcgaaactcgaaatatgaaattgatttcattagaaaaaataaacaaacatggaactgtgtaattttttaaaaaaatgttgggtgtgagggttgcggactggcggtgtactctagaaggagaagaatgagccgggaaatgccagttgaaagtggaaggatccatgcagttttggtgattgggtgaagaagtatatacccttgtgtacagagaaattgcatgcagttttgcttgaagatagatatactgcgtggagactatctaaaaggcaaatatagtatcgcaaaagttatctcctctttggaatgttataaacaatcaatttagttaaagaattctatataagatttttatttatttattttcaccttgataggtgtgttcggatgcacgttttgcagccgctaccacacagccacacaactgcttgtagtgacacaaagtagtgtgcaatattgctatgtcacagctgaagtagtgcagccaaacatacctaattttggtataaggatcatgaagttacgtggaggtgcgaaaaaatattgacacctagtcataaatttcttggcaagtatacgaaacatgaaagtatagagctaacatgtaggtcataatgtgtatatgtggtgtattagaaatttacaatttcattggccataatgtgtatacgtggagacgccccaaatcctcaataatcatatgagtttcgatgctctaagttaatccttttacataaaatgagaaatttaatccttcaattgaattgacgggattgtgtgattttattcgaggtgggactgtcaaatgatactactctattaatggttgaatttaaaatcttgaaataacagtgcttaatttatcctacccaatgcttttaacaacgaagtaaatgctttgttcattttattgttattttcaatgttactaatatttagcacgttttggtgttactaaattttggtatcaacgtttagtttaaagtcttaccaaatattgattgaggttttgagagtaagagcttctgggttttctaattttggcatggtagcaatggcaaaaatgtgtttgatttgttgccttactaaaatttagtaatgtcaaaattgatagagttaaaaatggtagcgaagtgaacaaacttaaaatgataaaatcatgttcattgcattacccactaaaattgagttgcttttcggatctgcttccatcaaatggtatacaactcttgtcaattttctcagattatgcaagtatgcaccagcgtagttgatccaacctcgctaccgccccagctatatctcttttgttttctggaccgatcacttggctgcatttctgccatctggctcacgttccttcggttcccatctaactctctctctctctgtctctctctctctctctcttcttgaacgtggcacctgtgcctgtacgcgggcaaagtgcaggttggtaggttcatcagttcacggatcttcttgctggggtcctgacaagtgtgaagaagctgcagcgattgtttgttgctgctcactgttttcctttctcatataccgtgtgttttggtggtgtgccaatttttttaaagtatatggacccatatttaaaatattaaacataaactaatagtaaaataaattatagattccgtctgtaaactgcgagacgaatctattaaggctaattaatccgtcattagcaaatgtttaccgtagaatcacattgtcaaatcatgacgtaattaggttcaaaagattcgtctcatgatttacatataaactgtgcaattgattttttttcgtctacatttaatactctatgtatgtgttaaaacatttgatgtgacggaaaaatttaaagtttaaagaaaatattttaaatctaaacaggccatagtagtagactagtataattcacatttgtccttcgcatcatcctcgtggaaaatattaggcattgcaagaaatgaatagcaacatcctgcaattatcatgccggaagcacgcgaggtaggaggtagtacgactggaagatcagaaacgcgaagctgtgggcttcaaagagaacgcataagatcattgaccaacacagtacacacagtaagaatagtttataggagtgcttctgagaagtagtagcacatgtcctaaacactttgtgtctttgtcggtgtatctcctctgacctacgatcgatggtctctcgttttaaaaacaataacgaatttgatttttgaccagcgagtaatcaaattcccccggctaattaaacaatgggagccagccagccagccagggtcgccagtgtgaagtcagcccagccgagtcaagtccttagcaaaatctcgctcgatcggttggtttctgcccgaacagctgcaacggagagcaataatgaccatctggctggctgagacgagacgaaacgagacggtgcgatacacgtagccaatgcctatccagttggcacgccggcaccgcgcgcgccggtggcctaacgatcgcgcacgcgagagcgagacggtggggacaaacggcaaatcctacggagaaacggcaaaaaaattccagatgaaaaacgcgcggttttggtgggttgcacaagcgatcgaccgcgcacacatggcgcggcccggttcgccgcctcatgattggccgtttggctttggctcgtcgcgtgagtatactactagtagtaccactattatattgctgatctatgttggctgccatattttgacgccaccgaacttaattaggctgagctggtgattattttggttaattagttcggtggtatcatggggtctaatgattggaaggcctgtattgggacatcaatttggggtttggatatttgtatctagctcgatcaattaccggtcaagttagaatattacaacgtaatttttgacttgggtttgttcagataactacacaccaagcaagcttaactaactagtgccaaccggctgccaaccaaacccatcccagtccgactgtgcgtgcccaacaattgtcaccaccgttttgccgcatacctaactcatcttgcacaagagatagtataaatcacaactgtcatttgccccaatcatgtttaagctaagggaatattctatcagatgcactaccactacaggtctagtactagtagtagtacttggttttgcttggctcccaagaagattttggctacagcctggaacaataaaatatctgtggtgatgatcctgtcatgtcatgtgagataacccctccgcgtaaaagagctctctctctctctctaatcagtcattattacgccaattccatgagctggttttaattgcgcagccaggacagcgatcgatatgcacatccgatggtccggaagatctctccggacctttaagattccttcactcgatcgatcgatcgatcgggcggccccgttgcttgaaagggaggagaatggcggcgaaagcaacagaaaagcacaaagcgtccagaaagcggcacccgcacaccctcccggaggaaaagaaaaacgaaaaaaataataaataaatcagcaaccgaaagcccgggccgcgcctcgcatcgcactgcgctgctcgggttggcggctcggcatctcgtccgtctcggcaaccggatgagaacgagatgatgagcacgcacggcgaggaggcgcggtggtggtggcggtgagatgcgcaacgccacgccgcgccgcgcgctcggctgcgcgtggactccacacgcacgtacgtactccgtcgtggcgccgcggtgccggtgcgggggaagtggcactgtggcccaggcgcccagctcgatggcgtgatggcgtccacagctttcagggttgtacggctcgcggtggcgaccgggattgtgttgacgcgcttgcggagacgccgaccaaatccaaaccgggcgatttcgatcgacgtatgcgttatgcgtggatgacgctggctcttacgtttgcattgcgggtggttaattaacgagaggggcaatctatcaaacgtctgatatgcaactacctctctgtagttaaatgtatcgcctgggagtactatataatcatcagctggtaagcaccatgacaccttatgttaatttgatttagaatctgcgatttaacaatcttatctgtaattacttgtaagtcgtaagaagtactctccttgatttttaatgcacggtaacatttactttagaaatatgtttaaccattcatcatatcaaaaattacataattatcatatatttgttttgttgtgatttattttatcactaaaaaaattttaagcattatttttttattttacatataatttttttaataaaatgtttggttaaatataaatgcaaaagtcaacatcactacaaattaaaaaaccagagggagagtgttgcatcgttgatttcaattgctgacggcggtccaggcacgatgagcatgtgtaatgttcatccatgctctcatgctaatccaatcgatcactgttctacttctacccgccaaaaatgacgggcataggacttccgctcaaatcgctcgcttttgtgataaaacgggcggcggcgtcccgtacgcgtcgtgtcatcgcgtcgactaataataaaatctacacggagccttttcgcagtcttgcaaacatcggaaaagctaaaagcatatgggcgtcaaccgttaaacccaccggaacaccgactccgcctcatcccgcacccgacacgtacgccatccagaagcgcacgacgggatcgaggaggagtccgcgccgcggtgaattgcacgtagagagagagaggaaaaaaacaacggggggacgaatcacgaatcggaccgtgacaccgtcacaccgaagttggcagtagtagcatatcccgttcccatgccggatccccaccggtggaagcaaccgcaacgacgcacgcacgcacgctcgctcgcagtagtaggacgcgacgcttacttgtaaaatgggcaccttttgttaactccttttcttcggttcttccccttgtgcgcctttcaccgtcggctcgctctctctcgcctttgctgaatggacacgggcccatatgctgctgtctgtgctgccgcggcgccacgagaggccgaaggctattgaccgcgcgcgcgcgcggccccctttctgcgtccgccctgacgctgcgctgctgcgatgcgctttccgtgtcgactcgactcgatccctttcgcgtcggaagcgaagcttcgggcgtgtgtatgtgccgtggtggggaagctgaactgctgaagctgatcgatttctcattcctactacgcgggcgcagtgttgcacttgcagagcaagcaagctgccgcgcagtttcactcccgcacgtattggtcaccgcagttaattttggccggtaaattcgcggacacgtggcgcgataggaggagggcagagactaagggtgaggagcgtatgaacagagcagcgaaagggggagaaaaacatttgtgaggagaaaacatggtatgaattcaattgcaatgtgtttgttacaaaatggtgttttacatagtacttgatcgaaaactaaattcgaaggggaaataatgtgctgagcattggcttctcccacattgtgggtggtgttgccattgccgctgtccacgtcaatgtggggaagctcgaattctgcggttctgatgtcgccgttgaggtcagtcgtcgtctcctcgtcggccggcgaggtggtggtctcgcaggattcttcggtaggggtggagatcacatcgatccagccgtcgtcggagtcccaatccggcagcgacgaggcggcgcaggccagtgaaccgatcctctcggccgtgctctgcgacagctcgtcgtcttcctcctcgtcggtgtcggactcccacaatgcggcgtccagggtgctcttgggggacacccatttggacttcgcggcctccggcttgccgtcgccggcggcggaggcgacgaacgggtgttctagcagctgcgccgccgtgctccggtcaatggggcgccgttgcaagcacctggccaagaagtccttcgcgtcggcggacagccaaccggggacctcggggacggcctccgtgtagccaatccggtgcaccgccgcgagcacgtcgtccatgtcgctccacggcgcgcggccggtggccatctcgatgaccgtgcagccgagcgcccagacgtcggcggctgggctctgctcctccccgcgcgcgacctcgggcgccatgaacgccggcgtgccgccgatcggccggcccgaatccgcccacctcgcgcacccgaagtccgcgagcttcgcccggccgtcgccgccgatcacgacattcctcgccttgacgtccccgtgcaccagccccatcccgtggaggtacgcgagccccctggccacgtccaccgcgtactccccgacggcgcactcctccatccgcccgccgcacctcgccgccacgtcggcgagcgacccgccgggggcgaactcgaggaacatctggtacgacccgtcgcgccccacgcgtccgccgatgcaggggacgacgtgcggcgagctcagcccggccatcaccccctgctcccgcctcagcgccgccgcgcccgccgcgcccacggacttgacggcgaacagctcccccgacgcgtcgtccgccgccaggaacacctccgccccggacgccccgcgccccagcgtccgcaccctcgtccattgcctgctcaccgccgccgccgccgccaccgccaccgccatctctccggtgatgtgtcgcgccgccgccgccgtggtggtttctgttggttccctctttgtctcgagcttgagctaacttgtggcgagttgtttacctgttttgtggcgggtgagagttatatatagggagagggggagaaatatagggcaggggagacttgtgcttgtggatttatttgggaagctttggaagtttggaacatgggggaaattcgttttggcgtgtgtaaaaagtgagggggattatgggaaaatacggaagaaggaaaagaaagcgtgggaagcaagggggattttttcgcgcacgcggttgctcgcggtgtggatggatggatggacgagcgtcgactccgttgtgccgtgggaacgcgcggcttcttccgtccgtctccctccgcgtcaatctcacctcctcctccgtctcgctactggttcaagtgttctgaaattttctttggcgtttttttaggtcactgggaatttacttgtcaaagtcctgggtcgttcgttcgaatacaggttttttttttggtgaaatgcaattggtgatttgggatgggaagcggagacctacgggtataaacgaattttgatggtcgaagtcagcgggtgcacctgaaaggcgcggcgctgtgggtgttggatgcaggatgctcttcgggggggccacggtgggtggcttgacactgtggcctgttgcgagtccaccacaggattgttttttttatggtctagcgccaccaacaccaggtttcttccaacctccatccaaattccaacagcttgttcgtatctagaaaccgtttttttgcaaagacttggaagatgaaattcgtttccacaaaaaaaggtaaacgcaccgagatacatcagctagatatacgtactccgtgtcttgttccagaatcaaggacacggttgtgaaggagtactgtgacagttaccagtattcaatactacagtacgttcattaaattcacccgtaaaaagcttctcacgtcggcggctcctcgaccggagtagtagtataatattcatatttttaactcctgatcatcggatgagtaataaattcccctgcttctcctcggcggcatgtgcgccgcgcgcacacatgcatattcccgcacccgttcgctgcatatgcagtttatgcacgatgcacaagctatccatccaccagccgcggcatgcatgttcactgcaccaacgtaacgcagagcatgtttggattagggcaagtacaaaaatagagatcgatatggactacgttaattagaggctatcacgttacaatagttaggacaatacggtctctaaccattaatataccaaaatactttcttactagtcatctttcctttattagactcaacgcaacaaaaaaatttcctaataaatattaagactcgactctacgccgttgtcatgcgtagcaaccatctttctctttccttcttcctctctttttcacgtcaccaaatattcttgcatgacaataaagagagaccgctaacaaaaaccattgtacataaccttagtgccaatttgtgccatgtcaaaatatggtagtttcaaatagtcactttgatattatttggattgtgatcaatttttggctgtgtttagttcgtgtgccaaattttttttaaagtatacggacacacatttgatgtattaaacgtaaactaataacaaaataaattacagattctgcatgtaaactgcgagacgaatttattaagcataattaattcgtcattagcaaatgtttattgtagcatcacattgtcaaattatgacgtaattaggcttaaaagattcgtctccgatttacatgcaaacagtgtaattggtttttttccacatttaatgctctatgcattgtgcaaacatttgatgtgacggaaaagttagaagtttgaagaaaaaattttgaatctaaatacagtctttgcctactccctccgtcccataatataataatctaggattggatgagacatttactagtactacgaatctagacatgcgctaactttttccatcatattaacctgtcctacacacgtaaactttcaatcatatcgttccaactttcaaccaaacttccaacttcggcgtgaattaaacacagccttggtagtgcactaacacgccacggcgcgcgcacgcaggcaggaattccgctgcgacgagccgacgacgccgaggcggggccggacagggacagacgacgacgtcgtcgacgtgtactcgcgctggctcggtgtcgctggccacgtcgagcgcagggccgggacaagtggcgcttcgagcgagcgagcgagcgtgtgtgtgtgtgtgtgggggggggggggggg

SEQ ID NO: 38092 - DNA, 2120 bp, Oryza sativa
  unsure (1)..(2120): unsure at all n locations
ggggggggcgccgtggcgtggcccatgccctgcgcctgcgcgccgaccgaaagtggtgcgagcgagagcgcggcgctttgcggcgcggggcggccaagcggatggatggggtggacggctcgtcgtcgcgtgtgaggagtcagatgcgtttgcttgcttgtccagcgtgagatcaccagcgcgcgtgcttgtcctcccttgccgccgcctgccttgcgtcgatcggtggcccggtccctccccttttcgccgcggtcggttgattccctctcactccactccacttcaccgccnngagnncccacaagccaccananangncacangagattccccaacccccctattaattttgcnncgtcggttnncacganntacacgattcgncccgaaaaantttctaccgttttcggtggattctacaaaccaccatgccatggcacaccgtttgttcccaagagaggaaaaaaaaatacagccgcggctatgtagctactgttcacggatcatgtcgtgccgggaactgaaaatctatatatgtttttttttctcttttacaagacaaagacgctgatcgggatatcctgattctgattcaggcttgcatgatcagtgagtatatagcacacagattatacgatgagtaggatgcagctagcgccggtgctggcagcggcagctgctcgaagcctttgcagagctgcaagcgcgtcagatctcacggtgtgaaaaaagctagcggcgttgttcagacggctcgtgcccatgaaaactgaacattttgggatccaaaaaaacctgcctttgcttcgccgaagtcaaacagcaaggatggcaatactctcctggatttttcacattttggtccttttaaaaaaattatttcgtaaatagaccccaagaaaaacttcttctaaaaatggtcctttttgggcgccagagtggctggcgccgtcgttcaacaggatggtgccagcctctttgacgccgtccccctgccgacgtggcggggcgatgctgaggtggctagggggagtgcgtcagagtggctggcgccaccccccgaaattttttattcttgttttatttgtttgatatttttttcacgcttagggacacacaaaaaccaaccatagaaaaattgaactcaaatgaacgtaatatgtgacatgtagaatttttcctctcctctcctctcctctctctccgaactagtgcagaggagagagatgtgcaacttttttatttttattttattttttgatatttttttcacacttaggaactcacaggaaccaaccatataaaaaataaactcaaacggacgaaatatataacatgtggaattttccaaagctctaccgaaaaacttctctcctcgaaaatacaatcttgcaagcggaatttggaggttttaatatcgccgaacccggcgaagcagggagaatcggatgtaactttttctgtagatgtccgtgcatatattacttgcctgattccgagtccgtatgagaaagttacgcctattttaatagatgacatattttgtccgtttcggtagagttttggaaaattctacatgtcacatattttgtccgtttgagtttattttttatacggttggttcctatgttctcctaagtataaaaaaaatatcaaaaaaataaaataaaaataaaaaattgcatctctatgtactgtttaacttatatatgtcatttcatgtggttatattttgaattagattaagtaatttcatatagtggtagagtgcattatgtttaacatgctgatcaaagggttttattaaaagagttatggtctaattttagtgaaggtgcaaagtagattaagtggtatgctagatattttcagactaagtggtagttcgagtttaaattttttttgtggtttgttgtatcgtgatcctgagtgtgaaaaaacatccgaaaaaataaaataaaaatgacaccgttgcaactccatacagagaaacaggaatggaggcggcggcgccagccatgctggcgccctcctcctgccacgtcggttcgcgtgcgccacggtggcaggaggacgacgccagagaggctggcgccgtcccgctctggcgccccaaa

SEQ ID NO: 38093 - DNA, 1721 bp, Oryza sativa
aatatgtttatagctggctaatagccttgctattgtacctgctcttacggtacaggacatcaaggctcatcaaccaatgattgcatcgaagtattttcttgtagaaaaattccttccagtcccagtgcaattccattgggcattccacttgtttaatccactattgcgcctgttacaatcatgccaaaagttgaagggccccttttcgttacaccggctccagctctgtagcaggtcaaccgctctgaaagaagaactcgtttcaactggtcttatccaagtgcacaagaactcagtttgccatttgaccaaaagcagatgtgcaggcatgaacgcgaaaactttgcagttgacgagtgatggatcggacagggatacgagagatcggccattgtgcgtccggtttgatctgcgagatcggtagggatgagcagataagaaagtgatggacacgagctctgaaagtagtatgaaccgtgtgtacggacaagtgacaccaatgccagcagagtgccactttggacgatctgttccatcctttttgccgtttagcactgcatttcaccgatcattggtgatcactctctgaattgtgctgtggtttcagcttcgttttcagctcggattttcgaccgtgaattcttggtttatttcttgtggctcgcaagagcagaaggtacatatgctgtgtacttgtgttatgcctcactctgatctctgacgaaggtgagctgaaagattatgcttttgagggatttgtcaacatctgttgcttgacaacgatgcgcagtcgacgaaaaatgtctgcgtgctttacttggtgtttcagatactggcagagtcaacgtccgagttattcttattctgaaataaagggggtcaacagccgtcccaaaaagaggaggtacagggaaaagggcacctcgaacttcagtctttaggcaatggatgttgacttttgatgaggctgcagatatagtttattcgatgaagaagttgaccaaagtgaaaagatgccatttgatattgtatatctacgttctttaggggaataattgtatcagcatcaatgtgattgtgggtgatcatttgattgacgaaacaggaatgcagtagagaagcgtatacatgggcttttggccaactccaccaaaatctttcatccaatcgtaattctgaattgattccggccagtcgcactggcattaaaccgttgtcacattgggatgttggataaggcagttggctaaccactcacactcagcgtctctacctctgaagatcaagtgtttttctcttcttgagatgagtaatcaagtaactgattttgtcagattggtggtgctaagcactgtatcttgttcggtggaagcagttattgccttacactgaaggtcaatagtcgatagaaagttcgcataacaagtgggcgtataggattaggggtgaaatcgagccgagccgagccaaaccgagccgagccagacttggctcggctcgtgaaagcttgacaaagaataggctcggcttgattaatgaaacgagctaaaatagcggctcggctcggctcgtttcaaagctcgagctagcttggttcagatacaggcagcgaggcgatggatggcatcgacaccgtaggggagggaggcggtggaccggtggcgctggggatggaggcggtagaccggcggtgttggccgctggggatggaggcgacgccg

SEQ ID NO: 38094 - DNA, 826 bp, Oryza sativa
ttgaccgcagaagagatggaggcagagctcgctggcaagaaagtttgtccccaagctcatcgcttcgccaatttagcaattaaccattacaacaatattgagaagaacattgtaatagcccttttcctttttttgctttccatgacatgataagtcttaatgttgtaaactactaacctttctattttttgtttgttcaggttaagattgagctttgtactgttcttttatcaaactgttttcatgaggtctgtgggtccacatacgcccatgtcaactttactgccagggctcagaatgatgatcaggctaagaagagcctgtactttgcagagctcaaattgaatccggatcttctggcaaagaggatggaacgctttgcagagttgagccttgatcctaatattgttggatgtgctgatgatatcgagcccatgtgtgtcgtctctatccacaacctccagggttcttgttttggtatgtttattattgtcgaccaattgactgtattctgattaatatgcttgcttatttgtaattactgtaaggttattgatgtttgtacgtgtgattgtaggaccttctcagcgatttatttgatatgttgatgttgctttaattgtaggtggatgccatgagatcaacaggagaattgattatgtaatgacgaggaatcaggactatgagcgttgtcactcatgtagtgaccgtatcaagcatccatatgggacagaatttgttgcagggcatgatagttccaagattccgtattacactgcaggctgatgtaataagagcatattcattgttggtttttagaggggat

SEQ ID NO: 38095 - DNA, 1205 bp, Oryza sativa
tttgtcaccacaacgatttacaacggtcactggtcggtgcccctccgtccaaaaaaaaaagaccaatcctatagaagacttgtggctaggaattcttttttttttttacagaatagaacggctttgtatagaaggctcgagcttcttttcaaatttggtcaaactttattatatttcttccttagtgtcaaatttagctgtcaacagatagattggaagtacagtgcagcggaaattttgaagtctcgcaatgcaatttctagttcatagagttttcatccttgagtaccctgataattttattcttaggtactcctaaatggcattatatgtcattaatcctatgttcccttttgcgcccagttacccaacaaattaatgattatagggtagaaataatgatgtgatggatgtctctgcttctatatttgtcctttaaaacaacttactaactccgttcaactaaatggtggcaaatgttctattgtttttgctgctggcgggagtatgtttcgcttcatatgagaactggaaattaagaatgaggattgaaattgctggtactgtggtacattgttacctcagattttgacatccctcagcatgctgcctgttgtctgtactatggttgcagtcgcctgaatatatttctccttggagcaccacaagaatgtctgaactctgaacattgcaaagagcttttttttttttttggaatatgcagggagcgtattttttaattaaaagaaataaaattttacaaacaaacccaaaaaaaataaaaggagaagggaagcgggaaacattaaagactaagaaaccgaagcctattcctgactcaacatttggcgaccagccgctctagtggctaaggacttaacaccggcaccaacgcattgggcagacgccaaagcgtcgcatcggctgaccatcgccttggccaccttgggctatgttcgctgttgtttgttgcacactctattgtttctttctttctagattgtacacgtcacaagagttgcaacggtgtcagagcctcgcctatgagccttgtcgaccttcttgcggctatcgcagagccatagtgtagtgcccgttccgtcgtggcgcctagcaggaaaattaattcttaaaaaccctaattgcgaaatttgtttccttgcttgttgtctagtgtccgtgccatctcaagatctcaatccccg

SEQ ID NO: 38096 - DNA, 3732 bp, Oryza sativa
tttggtcgctggccggagcgccagctcgcgccttgaccgcgcaagtcggttctcaaaccgacattgccgtcccctttaaacccccggcctccccttaccccccctcctcttccattcgtctccgcgccatagccgccgccccgtgctctgtctcacctccgccgtccttcgccgagcgccgggagagccggtgcattcgaggacgcggaaggggacttcggccgcgccctctccttccccttccccggcccgaggccggagagattactcccgcgccgtcggcctctcgtcacagcgcccctcctcttctcggtgatgtctctctccgttcttcctcctcgctccaactcctccccctagctttcggtagtagctcgagtagaccccccgtagctagccggcgccgccccaaccgtcgccttcgctcgccgtgtgctcgccgccgtcgccgcccgagctccgtagcacccgctcgtcgccggcctcgctcggcgtagttccgcccaatccgacgctagcgtcgagttcccgaagccgcgtaggtgctctcaccgacgggaatcgacccctcgtggcctcgtcgccgtttccctcttcttccgccgccggttgccgccgccgcaatccgccgccatcgagcgacctccggcgaatccgagccgttggctcgcctccccctgtcacgaacaaccgcccggtgtgctcgcttttgcccgtatcaccgtggttcgctccgccgctcgccgccgccgcccgccgtccattcgcggccgggtcgtcgtctacctcccgccgtcctgcgtggcagccacgtaggcgccacgtcggcgccagctcagcttagaccgggtcgagccgaccccggtcggtccctccccgtgcgcgcgttccaccgcaagccgtgaggctgcgcgtgggcccgtcgcatctgcgtccgccgcggaccgcgtgcgtgcaccgcgttcctccccgcccgcgcgcgtgcgccctccgcacggtgagccgagccgctgacaagcgggtcccacccgggaccgcgtgtggtgagcccggtccaccggactctctctcccctcccccgcgcacgcgcgcgcttgggacggccggcccatttagttcggccggtccgttccaattcccttgggccgcgccttagccgcccgaggaaaagtctataatccctccctcttttcttttctttttcttttccaaaaaggatttaatttaatcctttttccgttagaccagaaatccaataatcttagaaattcaatatcttcccaaccgtaaatccgattgactccgttcaacttccaaaattcctcaaatctcgagatctatctaatggcatgcttagaggtcattaatagggctttattttcgccgtttgttgagttgttccgtttcgcgtgtagttccggagcccgaagacccgcagtgcgaggatttcgaggatcaagctccagatctcgagcaaggcaagccacctttgaacaccttgagcctatatttgaaatttaattatgttgcttgcaaagtattatgcattgataggatcacacttaatctgttgtcccgtctgcgaagcagattggcggacttacctaacttgtcgcatttgatccttccattgttaattgctatgccatgtccccttgtaaccatccagttgcgcctcgatactcgtgcactctgtgcgagtatcgacggtcgccttcaaagttaaaatctgagtaacaacttgggtaaaactggagctttacaaaagacttggaaaaacccgacacttgggtcgatgtctgcgaactaaatgaattttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctaggacccctctcgtcggcatatggtaaacctgcatcggctttcgaaatgccttgtcatgaaagcttggaggtctcccgacgtggctgatccccacgggctgggtgacccgggttagtaatgtcgtgtgggtaaagtgtaccccctctgcagaggtcattaaactgttcgaacagccgtgcccacggtcatgggcggatgtgaggtgattcctagcgtagttttgtttgactactgcttgtgaaattgctgttgtgaaactgggttcgatgtttggaaaacctgcagctgacgggatcagctaggcccgggtggcagtttaaaagttgtgggcccgggtggccgtttgaaaagagttggcccgggtggtcgttcaaaaagcttttggccgggtgccaaccttgtttcaggatctaaagactgatacattgcacatactccgaccggacgagacgcactgtctcaaccgtgtcgtttgagaagcactcacttagttgcttttagaaaagagttcaaataaaatcaattgcaaaaacaacagcctttccttgaagcctgcattaaacacttatttcccctggcttgctgagtactcccgtactcacccttgctctatataaatatctcccccccagttgctgaagaagatgaagcggatcctgctgatgagaagttcttccaggagcagtcggctatgatgagttttagggtttcggcctagttcccagtggcgcctgtgattgtttggtccaagtcctggcttccgctttccttttgtaatgcagttgtgagctcgggatctgtccgcagcccaacatgactgtacttctactctataataaagaggcttctgttgctgtgatattctgtctcccggtgataccagcactgtttcctgggacgggtatggattaacgggttaatttggagcgtcacgggttagttccggtcgggactaattcggggcgtgacaagagatggtatcagagcacaggcttggccctagggcgaaacccgacgcttaggatgaccctaaggatactaagttcaaaactacttgcgaaaagctaaggtttcttttgttttctttattttcaatagtttgtttctaaaatggttactgatctttctccctctttcaaaattgtagatggcagtgaacgccagcttcagttcccacggttttggtgagggtcaccacgtcgctcagcttcgtgacctctcccgtttccttggcttctcgtgtcccgagtacacggggtactccgtggaccgtgttccccctcactgtaagctctctgtgtacctttaccctcgtggaggtatacacggagctggccttcgcccccaccacttcactgtggccaggcccactctccagatcgcgtaccaggacctctcctggactgcgcttcgtcgcctggcccacgactacagccaccgtctcggaggctccgccttccggcagcttccacgtcttccctctggccactcagacgccaggtacccttgtccgtacagcgagtctcagccagtgctgactcgcatggtcgagctttcggaggctcaggccactcagcacgacctactccttgaggcttaccgctcccttgcccgccgctacgccgctttggaggcccgtctggccgaggagggtgtc

SEQ ID NO: 38097 - DNA, 22187 bp, Oryza sativa
  unsure (1)..(22187): unsure at all n locations
gcccacgctttatccgcactgcgcggaagcgtgttgttggttcttccaccgtgttccgtttccgccacccagctcccccaccgccagcggcccgtgctgctgccggccctcgacaggtcccgccggtcccttcgcgccagccgatcgacgtttcttcaactgaggagccgactacaggaggcagccaggccgacgaggagtagaggaggcagtcttcagcagccgtccgtgtgataggccccttttgttccgccgccaactcttttggagtcgtggcgaggtagtgcgtgcgtgtgtttgttgtgggtgttgtttggtagtctggttctcctaggtggtgtgtgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgccccttttctgggagtttagatggctagccgcccccgtcgtacagctcgtgcaccagcccgctttggttttgaagatggtagagttgaagcagaagcaaatcacgaaccagctaatgagcattctcaccacagcaaccgttcgcaccgtactgttccccgcaacgcagaggttgagcaacctcgccgcagtagccgctcgcatcgcacagtttcccgtgatgcagagctggagcagtctcaccgctctcaccgcactgccagtcacaattctggagaagaacgcctcccttccccacctcatgtggaaaacaacatgcaacacataatggcagttcagacacaaatcttgcaaggactaaccacagccatagccagctttcagcataatgcgcatggaaatggccaccctcacgtgggcaacaatagatccaagctgacagactttctgaggtcacgtccgccagagttctctcagaccgtcgagcccgtcgaggctgacgattggttgaaagatgttgatagaaaactcaacttagtgcagtgtactccggttgagaagacgctctacgcctctcaccagctaagaggacctgccgcagattggtgggagaattaccgcaatgcacaccctgaacccactaacattgcttgggatgagttcgctacggctttccgtgcagctcatgtgcccgaaagcactattgacatgaagaaagaagaattcaacagacttaaacaaggcaacaacagtgtcaatgagtacctaagtcagttcaacaagttggctcggtacgcccctgaggaagttgacttcctagccaaaccgatagtcctagactcgcaaagcttggacatcatcctagggatggattggttggctaagcataaaggacagatagattgtgccgaaaagtccatcaccttgcaaggacctggaggaaagcaagtccgctttacccctaacacccctaccgcaagtcggtctatcctaacctgtttgcaagtcacctccttggagtcggtgcccatagtctgtgaatatcccgacgtatttccggaagaattaacaagaatgccaccagaccgagagatcgagttcaccatagaactggctccaagcacagctccaattgcaaaaagaccctaccgaatggcagctaatgagttagcagaagtcaaaagacaaatcgaagagttagggagtaaaggttatgtgcgacctagctcatccctttggggagccccagtgctcctggttaagaaaaaggatggctctgagagaatggtaatcgactatagagccctgaatgaagtaactataaagaacaagtacccgttgccacggattgacgacttattcgatcaacttaaaggagcaagagtcttctcaaaaattgacttgaggtcaggttaccaccaactgaaaatcagatctgaagatattccgaagaccgctttctcgacgcgttatggtctatatgagttcacagtaatgtccttcggactcaccaatgctccagcattcttcatgaacttaatgaacaaaatctttatggaatacctggaccagtttgtcgtggtattcatcgatgacatcctgatatactctaagaacgaggaagaacatgctgaacacctgaggctgataatggaaaagctcagagatcatcaactattcgctaaattctcgaagtgtgaattctggttggaccgagtagcatttcttggacacgtgatctcctccaacggtgtcgaagtagatcccagcaaggttgaagctgtacttgcttggaacccgcccaagaatgtgtcagagattcgcagcttccttggcttagcgggatattatcgaagattcattgaaggattctctaagctagccagacctatgaccgagctgttaaagaaggaaaagaaatttcaatggtctgtagcctgtgaagacagctttcaagaaatgaagaaaaggctgaccactgccccagttcttaccttgccagatatccgaaaagatttcgagatcttctgtgacgcatcaagacaaggcttaggatgtgtcctaatgcaagaacgtaaggttgtggcctacgcatccaggcagctcaggcctcatgaagtcaattatcccacccatgatctcgagttggcagccgtggttcatgctcttaagatctggaggcactatttaatcgggaacagatgtgaagtatacaccgatcacaaaagtcttaaatatatcttcacacagaccgagttaaatatgaggcagagaagatggttggaactaatcaaggattacgatcttggaatccactatcatcctggtaaagccaacgtggtcgctgatgcgctaagtcgcaaggcctattgcaatgtagctcaaatacggcctgaccaagatcatctgtgcagagaattggagaagttaaggctgaccgtggtacagtcaggagtcccagccagcttgacagtacagcctaccctagagtcgcaaatccgggaggcccagaaagacgacgaaggggtaaaagaattaataaaaagaatacagttgcttttagaaaagagttcaaataaaatcaattgcaaaaacaacagcctttccttgaagcctgcattaaacacttatttcccctggcttgctgagtactcccgtactcacccttgctctatataaatatctccccccccagttgctgaagaagatgaagcggatcctgctgatgaggagttcttccaggagcaagtcggctacgatgagttttagggtttcggcctagttcccaagtcgcgcctgtgattgtttggtccaagtcctggcttccgctttccttttgtaatgcagttgtgagctcgggatctgtccacagcccaacatgactgtacttctactctataataaagaggcttctgttgctgtgatattctgtctccctgtgataccagcactgtttcctgggactggtatcgattaacaggttaatttggagcgtcacgggttagttccggtcgggactaattcggggcgtgacacatagatagaaagagttttcattcatcataggcatctgccttgcccaatggccgagagttcaagccaccaaagttgacgggactatgggcaagcgaccaaaatatgacaaagagcaatcttccattacatccgtaggatgataggcttgcggccccattttttcgcttatacttatacttattagccaaaatttaaattttcaactttaaatttggagttgattttggggtttaatcattgtagtttacttttctgcttttgcttttatatcgttaaaaacacgtgtataaaagttttttcataaattattttttatttgtaaatatgttgttttgcttattcctctcaacagccaaacgatggggctgttttcttcggtggttgatctactatcactattgaattcatggtttgtccaaaataccaggttgtattgggtttttcgccggccccatgtcttgttattatcataacatgcatgattataaatggacaatttgtgactaatgatatatatgtcaacattttaaattgttgaagtcccgagaatcttgttatgagataagaaataatctagtgccaagcagttagctcgaattttatcatacagaggtagagataaggttctaagctgtaggttcagtactatactacaattatgcattttgggtgcaaacaaataagttagagacaaagcaggtaacccaatttgggtgcaggaaaatgagtagagaggtgacagaagagctaatcacatggaagtatgagcatctttaggtattgtctactgggctgtacacatgccaatgctggaagcctggaatccttgaactacaccatagaccagaggtcgtcctctggtcttaaagaaaaaccatttcgacaacagaagtgcagtttcagccactataaatgctaatgttcccaaacctttaatttcttcatccatgtaccaatcgatctacaacaagctaagagcacattcagctattagctttcattttgctctccttgcatagtattctcgatcggccatggacagatcactgtctacttcactgcttcttgtcctcgcccatttcatcatcatctttgctcatcttttggatgcacgaacactaggtaggcaacacaacagcacgcagaattgcattggttcctttcagtcgcattgatcatgtgaaaaagaatggttttgattgctaatctggcctagaatagtgggttactgggtttgatagctagtaatttgtcattcaccgagaaaatttcttgtgctgtttctgtccatccaggagacgcataccaaccacacgtacatgcgtcgtcgtcgtcggcggcggcgttgcggctgtggagcagcgcggatgccgacggtggcgcgctggcgaagtcgtcgccgcgcgctccgccgccgccgaggtcatcacattcgccaacgccgcgctggcatgacggagatggcgcgccggcgaggtggccggcggcggctgctcctcctcctccgtttgcaggagatgtcgttggccaacctgtgctctccccaagccgcccggcagtgtacacggcttagttacgaggtcgtaatctttgatcaattcgaggtgttgtactgctcgctgacatatgagcacgagatcatatgttattaatgtcaatgattagtactccactgcactgagtccaaccttgatgtttacgagtcacagagtcactgtttcatttcctgatcacaagcccgttttcttatgttgtgtactcatgtgtgaactatcgaccgttcttttgtgtgtgtgctcgtgttaactatcaaaactgttaccataaactcaatttttaactatcaatccattgtccatcaggcttgtttagttcacgaacagattttagatgtcacatcgaacgtttgaccagatgtcggaaaagattttcggacacgaataaaaaaactaatttcataactcgcctggaaaccgcgaaacgaatttattaagcttaattaatctatcattagcacttgtggttagtgtagcacttatgactaatcatggactaattagtctcaaaagattcgtctcgcgatttccatgtaaactgtgcgattagtttttcattttatttatatttaatgcttcatgcatgtgtccagagattctatggctctatttttttcttcaaacttccaacttttccgtcacatcaaacttttctacacacaaattttcaacatttccgtcatatcgtttcaattttttcaaacttctaattttaacatggaactaaacacaaacacagtttatgtgatgttttggggaaaaaaattggaaactaaacaaggccagtacttcaaaacgaacgtgtgtgtaacgtcacgacaaacatatacttacagttttgcactccttaatttcctaaaagaaaaaataaaacaccctttcacaccagcgtgaaagcgttggtttgacagtccggccatgtacgcgttaataattgacgatgatatgaccgaaacacgcggcggacatacatagacaaaattccgaattcaatctaaaacaatatacttcctccatctcaaaatatttgatgccgctgatttttttttaaatgtttgaccgttcatcttattaaaaaaaataagtaattattaattcttttcctatcatttgatttattgttaaatataccttaatgtatacatatagttttacatatttcacaaaagttttgaataaaacaaacggtcaaatatgtttaaaaaagttaatgacgtcaaatatttagaaaaggagcaagtatgttctcagaaaatctaaaacgatatatgaattatgaaacttccagttcatctcaatgtctcgatgcatgtgtggtcgtcgatatatcccatggttgccgtcgattcctcgtcgtccgtaactccgtatgtcttggtgtttgtgtcctacgtgcactggcagcggagcgatggtggtgcgggtagaatacgatgtaattaattttgaaaatatattatttctttcttcaattttttttggttagaaatatacctcgctatcacataaccaccgcacgagaatgacgtggagtaacgacgcgccaaggttttgcaagggaattccacgaaagcgtacggtctcgcacaaccaatacgcgagaccgcacggcatggctgaatgattaatgttttaatcacattgattagcaactaattaatcttagttatcattaaataataactaattatggtaattaatcactaattttggaccagagattcggtatgctgtttcttatgcgatactgttcggtattgctgtttcgttatgtctcgcgcaacgattatgtgaggtcgatgtatatttctaccaataagcttgcatcctgaatatttttaagaaaaaacaaattaacagtatattttgaaatttatttcgaatacaatgcacgtcgtcctacatataccacaggaatacgacgtggaaaaaaatcaaaaatactttacagatctatcatgctttaagattggtgaggatacatgtacgtgtacgcgtacgtggcacccatttagccagctaggtaggatggtgctccacttggtgcggtttagggcggaggcttcacaccccggactactttcgccgttctaaaaaaacataacctataaacgaaatatgatataatataatacaataaatttaaaaaacatttagatagaaattcatcccattttaggtgtttttttatacagttcctgttccttccgtgtcaaaccattaacttgtttttccttccgtgtcaaaccattaacaaatcaatccgagcattttctttcttttgatggattaattaggcaaaaaaccgttgactcagtcatcacacatgcacaccacgcgagtccacgacgaccacacgagcgccgtaccaaatcctgcctatataacagagctcatgtgggtgtggctagctgcagcctagtagcttgcatcagagtttcatctcatctatcgatcggctaatttctagcttaattagcttgtgatccctttccttcccgccatggaggcctcgtcgtctccttgcaagcttcttcttcttcttcttcttcacgtcgtcctgctcgcgttcgcgccgctgctccaagcacggccactcggtcatcaggtggtggtggcgccgctaatgttgccgagcgacggcggcgaggtcgtcggaggtgtcgggcggccggaggatcacatcccaccgtcaccttttgcgcctggcgggccgatcacgctcgccggcggatggctggtggggaggccggtcggccccactccgccgcctccttcgcaccccgttgtgccgactccgacgcagctcgccgccgacgatgacggcggattgctgaggaggccgggcggccccactccgccgtctccttggcaccccggtgtgccgacgcagacgcagctcgccggcggcgacgacggcggcgtcggcggattgcttgggaggccgtggcctaaggctcccccgccgcctgacccgaacacgccgccggtgcagccgctctccaactacggcgtgtcgcggtgttgcggccggccaggacccgctccgccgacgccggccggaaacccgccgggtgaaaccaacgtcgccgtcgcgctcgcgccgccgatcccctgcgccgcttttctccgggtgatccgcgacgccgtgcagtacatggtcggcggcggactcggagcctgaaacgatcgagagctcgacaccgagaagaagagatatatacgagagagttgtacttgtacgtgtatatttgtacgcatacagaagcaaagctataggcaagtatgtatacggtataacgactgtataatcgtatatattgtatagtcgttttttatttaattataagtgtcgtagcagagtctaggtaagtagacaccagctgagcaaaaagactagctggctagtagctgcacgttgttgcgtcgctcaactacgaaaaatggagatgcagtaattataatctctctgtggccaattggcgcagtatatgcatatatatatacacggtggtgaatccggctgaaatcagaggatagatttaaagtctaaatcttttttgttaaaaaaaaagataaaaatacatcctctgtatcaacccaccatatttggtttgcaattgaaatttcaaacattagttacaggggacaacaccggatactttttgcaccacggatccataaagcatcaagaaaaaaatagatgaaatcccacgtgttgctgctagaattttatatgatattagtagaaataacatgtgacagtggattttaaagtcttcggcaaacattcctttgttgtttttatgccattcaaatagttatgaaaaaaattaaaaaaattgagaagatgtactaatatgtgatatatcacccccacaaacatgcaatttaaaaatccaactaatacaagttaaaaatccaactaatacaagttaaaaaaaaattaaactacaactagttaacatatattcacagccaatttttttttaaagttacagaccttacatgcttgtgaagtaatctatcacgtactacactaaatagggagtagtaatccatcttatcatttttttctagaatatatagtttcccttaactacactagataaactttatagatatatatatgatgttccacggtaccagagacactgacaaatgagcgttggatggtttgacatcatcgatacatcgaaaataaaaatattaaatagatacagaatatatatatttgatttagaataaaactaaaacgatttacatatttacagtataaaacgaagaaaggtgtgccgcacatcaggatcatatcccctggcaggtgcaaggtgtgcacttgatcaggccactaaaataagagacatccaaatctattagtcctacaatttatctaagctaattaacaaggaaaagaaaaaaaagaaaagaaaaacagcacaagtatgaaaggcccaggcagccaaacacactagcttggccgggctccatgttgccatcacggtttctctccgtgaacaaaagttgttttgactcacgcggtggctgttgtctgtcgcggttgtttcttgtctgttgaatggtcaactttgaccgcaaccttagctcgtagcgaaaatcttcgcccggtagcggttccaacagctagctatttgcagcaactaactgacgatttacgcacatttatacactgctattcgtgttcttttcaagttaaatattggctctgtttggggaacttgttccagctgcagcttttcctaaaagctgcttctgctagaagctgccccaaacagtatacagcttctgagaatctgtaggtacaggttctgaaaaatgaactaagaagccagaagctgggtttcagagcttttccagattctcagaagctggctaccaaacaactgcttctcagaatataaaactccaccaaacagacccattaactagtatatcgaagattctttttgaaaatgctactatcctattcgaacgggataatatctcaggggtatcacctgatatataaaaatcaatagatatgtatcacttagagatattatccagtttaaatagttataaaccgatatctaacacgtatcatatcagataatagcttagaaatatcatatcgttcgaatgggatattgtcatgtagcattttatggattaagaagaaacagttgacttgtcaactttctagccgtcataagcaattctaatctttgcctatatatataagagctcacgcggccatgtcgttcttcgcgcgcgctgccgcttgcaacatctcgaattctcgatcgatcgattcattgcttttccttcccgccatggcgggttcgtcttcgtcttctccaaagctgctgctgctgcttcttcttcccgtcgtcctcctcgctccgctgctcgaagcacggcgtctgcacgtgctgccgccgctgatgttgccgagcgacggcgtggtcgtcggaggcgccgtcgaggtcgagggcggcaggtcgggtaacgccccgccatcgcctcgtccgcatggccgggtgacgccgctcgccgacggcggcggcggcggcgtgctgaggaggccgccaggacgcggtccgccgccacctggtccaggtggccatgtggggccgctctccggcggcgtgtcgtcgtcggccgggagatcgtcgacgaggccgctgatgatctccgacgacgacggcggcgtgtcggggaggcagtggcctgctcccccgccgccgcctgacccgaacaccccggtgcagccgctctccggcggcgacgggcggccgcggcagctcgcgccgccgccgccgatgggaaacccgccgcccaacacccaccgtcgacgcaccgatcgtcctccccgccggctgccggcggacgacgacatggccggtttgctactccgcgtgatccgcgacgccgtcgaatacatggtcggcgaactcggagcctgatatccatcgagaccgagaagaagatacgagagatccgagaattatacgtatatttgatttgtacgcatgctgaagaaaggcaagtacttacgtattaattaacgtataccaactgtatagtcgtatactcgtatgtatgtattattgtatttgtattagtatacagtgtacagttgtaagcctagctaagaggctagctgagtaaacgagatcagacagttgcatgcatgttggtagctactcaagctgttgaattcgtcggtctggttgtggttcacactgaagtttgaaagtttggttaaaattgatacgatgtgatagaaaagttacgtgtgtatgaaaggtttgatgtgatgaaaagtttgaagtttagaaaaaaaaactttgaaactaaactgggcctctgacgtgtatatttggaccctaattaattaacagtgagtttttttttcaattacatggtagaaacatgcgcacacgcaactactcacactccgtgaatgtgtcagctaacatatgctctaataaacggaaattaatgatatatcaccgatctcattgattttctattgaaactccaccagtatatacgtaatattcatgaacaacaggacacttgtaatggagtagtatttaaattataattacacagcatcataatctttgcaaaaaactgtttctgatctatctgcccaggccattcaagataacaagaccggacagtttctagccggaaaaagctctaaccgatacaaaacaggatccaggggggaaaaataaaatcataaacagcaatcatgcgctgtagtgtacttatataatgaacaaagcacataaattaaccaaaccctgtaacaacgaaaggctaacaaccataagaattcagaagggagtggttcacaaaaatctgccggtatggtatagctctagcactactaattatttttaactaattatccgtgcttgccattagcatattaccggttatatataaattataagtatatactagtaataattaatcaacaaattcaactcaagacgagttttgaaaaactgtcctagtactccatgtcatacgacgatccttgacttttaattgacgacgtgtctttgtttagagtccactaattaattatagcttgcagccaaaagttaggcctaccaatcgaacatccgagttcataatatatgataatgagtacagacaaacgcatcttagataagctgagagcgcccattaactgtaatctatcaatatttgtccatcatttgatatagttaacgtctgtccatgttaaatattggtcagaaaaagaagaccttcgagaagatagatttgattactactgacacgcttggtgctgatatatgagttagaaccgccccataaaagtttcggcctaattaagataagtttacttggtgaaaaatcaaggttttcaatggacctttaattttatcccaggccccagacctggcctagctttgctcggggcctggatttgcccccgctaccggaattcatctaccgacaaaacatcagacaggagcaactaacatactcatgatatgatggatacacacttcggagaagtcgaaagtttgaatgtcatcagtggaacaagccaaaccaaactcgaattaattcatatacggccaaatatccatcaaatagtcgctcaagttttgatggttgttgatatagcgtttgataatcatcatttttagcaagcagttttgcgctacggcagactcctccaccagctcatcgtacacacaacacacatgcagctagtcatcgtcgtcaaggacgctccggcgcctctgaatctgcgaaataaaacatagtaaaaagaatcagttgtgtattggatgctttcccttcacagactagcctatattagcatcattttctcttcctttttttgatgatgtacaatcagtgacttggaaagaatcacaacaaacgagaatctttacaaaccaaactaaattagttgtagtgaagctacccaaaaccactattggaagcatggtaggtttgtttagttaagtgcacatggtatgtcaaaaactgatagaagtttccacgtttatcataccgtaactttcgtctgtttgctagtgtgggtattgatttgctccagaagtgagataagcctttcttcagacacctgaaagccagaaaattccccccaaagaaagtcagctttcagataaacctttcttctgagtctcttgacacagtaaagattatgctacccgcctctattaccttttcagatattccaccggactgagcagctctcagaagaacatcctctacccctcttgctttatcaggtttgaccaaagctatgcgagagactgaaaactccagagagtaaaaaattacatcattatagaaccttttcatcaccttaacctcaagtgagattaacggtatgactttttcatagaatcatccttattcagagcatttgattctgataagcaaactatgcattatgtatccatgcaattgtttgccagtttggtccagcctactgcataacatatgttcggagctgtggagattttgaagtgtgcacacagtgccccttcctagttcatacggttttcatccttcagaagcctcatctttttgttccattggtttgtaataatgaagcctgcctagtgctttgctattgttcagttccttacgatacagtatacactggcttgtgaatatatccaatgatactgtttgagcattggtatcgtatggatagctcattagttttagttttgaacggaagtgaaataactgaagtgatgaagtttattgtgatgaacagcaagttaaaggttgggcattatagtggtataaattaaatgtgtagggtggtaaaaaaattcacatgcttacgttagtgattaaatacttcagttttgctcttcttgtttgactgtgtcttatgatgctatcttgatcgatcagaaccattatatgttcaccggatgagcagctacctttttggaagggaacggaaagttgcagacatccccatagatcatccctcctgcagtaaacaacatgcagttcttcaatataggtaagcatagcaatcttattgttatttgcctttattagcatattgcctgtgcgtggcaacaagattttaaataaagaaaattatcattaactcattattattatcattttctgtgtatatcgccccttaatttatgtatatatttgttactgacatgtgcactgtccttttcttctcacaaaaagtaggaagttggtggtaggggtggttgacatgtaggccccccttttctattaaaaaaactagggagctggtggtggggtggtggnanatncaccactcaccatcaccactactcccttttacaagaagtatatattgagaaataatattgtgattcacccatctctttgccttttcagacttgtagagaaggagcagccagatggcatgatgtcaaagcaagtgaggtactccttgctagtaatgcatataattttttttaataacaagtactaataattcatgattatcttagttctgtatgctactctagattatgatgttttttgctgctttgtttgataggccttatctgatggatcttggtagtaccaatggaactttcattaatgtaagtcctccaatgatacttttactactaatcagatacactagtcgcgtttctaataatattttctacccagtcaatatttatgttttgatttttttttcaggagaatcgtattgagcccagccgttactatgaactctttgaaaaggataccattaagtttggcaatagtaggtatgatcattgaaattgaagagtaactttccccctctactgtttaagataactttgcttgcttcatgccctcatcatatcaattaaagaaagcatcacttttttgtttatttattgctcaatgtatatgcatctttggtatgtgatgacttaaattaacaacttattatgaaagtgacagtctggcttttggcattctctttagttagagattttattttgatttgtggtactcttgggataaacattttttctccaataatctaagtaatatctttgtaaactacgcctaattgtttttctcaatacaatttccaaatgaatctttaggtggtatattaatgtttataaatatcaaggaatctcaaaatatctacattatggaaacataattttcctttatggagccttgacttgcaagctcaatcatgtataaatgtataacatatattcagagctgtggagattttgaagtttgcccatagtgccccttcctagttcatacggttttcatccttcagaagcctcatctttttgttcttagatggatggtactatttctaatccagatttagggtccttttgagtccagttgcccaaaagtaaataatataatgatgtgatgcctccgcttctatatgcctccttactaaccccgttcatctaaaatatgacaaatgttttattgtatttttgcagccgggagtatgttttgcttcatgaaaattcgaaagaatgaggattgaaattgctggaaactttgctacattgttacttgagattttgacgtccctctgctgcttgttgtttgtactatggtttcagtcgcctgaatatttttcaagaatgcctgaaggaacatagcagaggccggtaatcttccgttacatttataggattctagagcctagacatgttttatccagtggttgatctagtaccgctacatacttcatggttttgtcaaataccatgtcatattgtcactgccatatcataattataatctgcaatttgtgactattgaaatgttggcactctaatctatttgaaatctgcgaatcttgacacgagatgagcaataatctagatatagcgaagcactgaagcagttctgttggttccaattttatcatttagaggtagccagctggtagggatattctagcttcattactattctacagttaaacaggcatcgagaaacaaagcaggtagccactttgggccccccaaaaaaaatgagagcatctttagttgtgtccactcggctgtgcacatggtagattgctaatgtatctctgtaagtgaaggcagtgtttggctaacgagaaaaggaaatgattttccacccaccaaaagatatttttaaatcctaaccgtttattttccctcttccatttaatcctaactcttcattcattttccaatctcaatcccaatcccacctcccatttcccattatccaaacacacccgaaaagttttcctcacaatgcttctagggtgagccacgtcatcaagtgaaatatgaccgttggattcataggtgaaaccaatatcaaccgttggatgaaatgtgatggtgaagaaaggatatagaaatggaaaggaggaatccggaaccttcatgtggcttaggttggaaggattcatcggatattgagagaaatgagaaaaacaaaagcggctaaaaagataaagatgtaatgaccctttgcaatatttattttacaaagtaaaaatttatttacaaatagatccatagattcacacatatttttaaatgagtgtttaacaaataaacatattttaatttacctaaattcacataagtataatacatataaaatgtatctagacttacataagtataagtatagtaaaaataagtatgttctaataaatatgctactccctccgtatttgaatgtacgacgtcgttgactttttgactaacgtttaaccatttattttattcaaaatatttatgtaattatcatttattttattataacttgatttgtcatcaaatattatttaagcatgatataaatatttttatatttgcacaaaaaatttaaataagacgaatagttaaacgttgataaaaagtcaacgacgtcacacgttaaaatatggagggagtataagacatgatggaaaactgacaaatttcaatggaatacgatctacatgttaaattaaaggtcattttgaatgtataatccttgcaataatttaatggagaataaatatattaatccagtaatcctacaaaaatcatgcattttctttagaggctctttatcactaatgcatgggctacaaagaggggctaaagagtttgtgtcaacaagaggtatagggtgtactcttttaccataatggaatagaacatatatatgcattttttttaagaaaaatgctacatctgactttcttttctttaaataccatttatgtatttttcatccatgggttcctcgaatcattaaactttcaaccttccatattccatctgattcagccttataaaataacacgcctaaacctaaacagaacatgtttacacctatgaggaaattcgaccaagggtggctactcatggccatgtaagtaacttagcataatttatcgcaaactttatattaccatgtcagtctattacatagttttaagtgagtagttgttacaaatttaaactaattactactctctccatctacttttgatagtcatatttcatcttgacacacagaccaagaataagtaattgtacctatcatccatttaaatatactactagttatttctcgtaaagaagcgatttatgaatatttacatttctcgatgtccatgtagctaatcttatgtggaagaatagagagtcatgcattaaattctagaaaatcattaagaggataggttgttggattgaaatatgcttatcaaaaataaatttttcagatttagaaaatatgcctatcaaaaatagatggagggagtacaatataacgtgtaaaagtatttaataaagatggtggttacagtcgcctgaaaacgcgacttaatagactagtaatgcttgaaagttgaaacctcgacagctcgtcaactacacaaggtcggtggtctctagccgctatatatactgccagtgttcccaaaacctttcttcatccgtgtaccgattgatctacagcaagcttcagcttgctcctgcatctatcgatcatggatagatcaccgtctcatagtcttctccttctcctctgcttcttcctcctcttcgctcagctgttgcaagcacggatgctaggtaggcaacatagacgctttcactcgcatggatcacgtgaaaatagagagaaacagagaagagtgcatttcatttggtagctaatttgtcattcactgacgaaacgcatcacgcattgaccatgtgaaaatattataacaatggtttgatagctaatttgtctgtcctacactgacgaaatttctcctgctgttttctcgcttcaggagaagcctactactcctatccacatcggatccggattaaatgcagtagtagtatggactgcaacttaagcagttgtagctgctacgttggatctaaatccaacggtaaggattaggccggttactgtagcaaaagtaccacggcgtaaaatattgttcagggtactgtagcacgagtactgtagcagttgatctggactgttgatcacaaaaatgaatggctgaaaatgcatgcagtccctaagactgcacccgatctcaatccatccacatcttcgtgcgtcggcgtggcggagcagcgtcagcacggatgacggtggtgcgctggtgaggccgtcctcgtacaccccgccgtcgccgaagcacccggggccgcctcaccagcacggcggaggtggtgcgccgcccgccgatgtggtggccggttgctgttgctccgccgttggcaggacacaatggccggccaaccaagcccggcagtgtacacggcttagttattcgtaaccttgatgttacaaggtagccaactctgccattcgtgtgattggaagcccgtttgtttggggaatttgagagccatccggtgagaatatggaaaaactaaatcctacgtttcttaaaatctaagtaaaaggttagactatttgaagacccgaagattctaggaaaaaactgtagttacaataagctcccttaaacatgatttgattatgttgtcaattatcaggctggtttggtttgtgtcataaattgattttaccaattttcgtccatgtctaattttagcaagttttagcatggctgatcttagtaaggtaaagttgtgtttgaattaaagctaaaatagcctaaattaactattgaagtgacctatttttcttaggtttgctaaaatttggcttcaaaccaaatagacactaagtactactccctccgttccagaatataagtatttttagagttggacacggttattaagaaagtagatagaatttaatagaggaaggttgtgattggacaagaagtggatgtaggtgaaaaatttaaatggtggaggattgtgattgattgagaagagaatgttggtgtagaaattgttatattttgggataaattctagaggctaaaagttgttatattttgggacgaatgcagtattaaaattatcaaatattggtaatatcaatatagaccacagaccaaaccagcccatcaaaactccagctcctcaccatcaggcttccaagacctgctagtgactggttgtagcaagttccaaggactccaaagccttccagtccctccggagctgttcaagggctccggaggaagccagggcttcaagagcccaagccctgggcgtaagatgggtgatcggatgtgtagtgggacgccataaatacgcactacgcatctgccaaccacctctgacgccgctgacgagggcagacaacgcacgctattacccagagcacgcctttactcgggtaatagcaggcgcctttgggaatcgacgtcgctcccttaatgggcgcaaccctcctgtcaccgaggagctgaccaaagagccctaaagatggcccagcagccagccgcctagataattcagcgattaaggtagcgatgtaaattccccttgtacatccttgtataaatatgtaaacattgctcacagctaggcatattgaatacagaagtgatacacatacgcttgttggattttgtcccaacatttggcgcaatccatggggacgaaagaagcaagcaggcaaagaattttcataagaaaaaaatcaaacgacttatgatatgaaacaaaggtagtaaaaagaaggtttttcggacaggacacggggtcgggagatttgtttgatgttgttcttctcgatgtcgatcatcctatgatagaacgtagccatatgcgcattggactcgcggaaagcgggcttatcctcctctctgaagcagtgagcctcatcgctcatgtccaagctgtccgcgagaagctcctcccatgtcatgggcctctttatcaggcaaggatgaggtagtgtgcgagggccgagggatcctcctccaactcctaggcgtcctcttcctccttgtcggggcctcgcctgaccccgccgccggcacggaggtggaggaattagcccccgattgcgacagcagcggcgacagagagtccagccactcctacgctgtgatcgggacggtggatccctgatgaaactggaacatcgagtaggtcgcaaatttctcttctatggtgggccttctcatctccgtctgccgaatcgcaatctagggttaggattcttcctcctcgtgaacacgatgggagaaagaaagtggttagggctgaggagaggtgacacgacgcgtccctgatatatatatgatgcagcacctaccggagccatccaccctaggagaatgaccggaggcatctactgatttaggctccggagctagctcgggagccaacacgggtcctcggagccacctaggggctccggggtcatccaaggccttcggagccatctaatggctccggggccgatcaaggccaccagagctgttcgtgggctccggagccatccaaggactccaaagccttccaggccctccgaagctgttcaagggctccagaggaagctagggcttgaagagccctgggcataagatgggtgatcggatgcgtagtggcacgccataaatacgcactacgcatctgccaaccacctctgacgccgctgacgagggcagacagcgcacgctattacccagagcacgcctttacccgagtaatagcaggcgccttcgggaatcggcgccgctcccttaatgggcgcagccctcctgtcaccgaggagctgaccaaagagccctaaagctggcccgctagccagccgcctagataaatcagcgattagggtagcgatgtaatttccccttgtacatccttgtataaatatgtaaacattgctcacagctgggcatattgaatacagaagtgatacacatacgcttgttgaattttgtcccaacatttggcgtcatccgtggggacgaaagaagcaagcaggcaaggaattttcattaagaaaaaaaaaatcaaacggcttatgatatgaaacaaaggtagcaaaaagaaggtgtatcagacaggacgcggggtcaggagatttgtttgatgttgttcttctcgatgtcgatcatcctctgatagaacctggccatatgcgccttggactcacggaaagcgggcttatcctcctctctgaagcagtgagcctcatcgctcatgtccaagctgtccgcgagaagctcctcccatgtcatgggcctctttctcaggcaaggatgaggtagtgtgcgagggatcctcctccatctcccagatgttcgcttcctcctcgctgggccttgcctgaccccgccgccggcaggtaggtggaggaattagcccccgattgcaacggcggcggcggaagagagtccagccactcccgcgcggttatcaggacggtggatccctgacgaacctagaacatagagtaggtcaccaatttctcttctgtggtgggccttctcatctccgtcttctgaatcgcaatctagggttaggattcttcctcctcgtgaacacgatatatatatatatatatatatatatatatatgtatgtatgtatgtatgtatgtatgtatgtatgtatgtatgtatgtatgtatgtatgtatgtatgtat

SEQ ID NO: 38098 - DNA, 9682 bp, Oryza sativa
attccccgtcttgtgatgcagcacctaccggagccatccaccccaggagaatgaccggaggcatctactgatttaggctccggagctaactagaggcgctggagccaacccgagccttcggagccacctaggtgctccggggtcatccaaggccttcggagccatctaagggctctggggccgatcaaggcctccggagctgtccgtgggctccagagccatccaaggactccaaagccttctagaccctctggagctgttcaagggctccgaaggaagccagggcttcaagagccttggacgtaagatgggtgatcggatcgtagtgggacgccataaatacgcactacacatctgccaaccacctctgacgctgttgatgagggcataccgcgcacgctattacccagatacccgggtaatagccggcgccctcgggaatcggcgccactcccttaatgggcgcagccctcctatcaccgaggagctgaccgaagagccctaaagctggcccaccagccaaccggctagataaattagctattagggtagcgatgtaatttccccttgtacatccttgtataaatatgtaaacattgctcacatttgggcataatgaatacagaagtgatacacatacgcttgttggattttgtcccaacatttggcgccgtctgtggggacgaaagaagcaagcaggcaaagaattttcattaagaaaaaaaaatcaaactacttatgatatgaaacaatggtagtaaaaagaaggggtttaattaacacacggtgtatcggacaggacgcggggtcgggagatttgtttgatgttgttcttctcgatgtcgatcatcctccgatagaacctggccatatgcaccttgcactcgcggaaagcgggcttatcctcctcactaaagcagtgagcctcatcgcttatgtccaagctgtccgcgagaagctcctcccatgtcatgagcctctttctcaggcaaggatgaggtagcgtgcgagggatccttctccatctcccaggcgtcctcttcctcctcactggggcctcgcctgaccccgccgtgggcagggaggtggcagaattagcccccgattgcgacggcggcggtggcagagagtccagccactcccgcgcggtgatcaggacggtggatccctaacgaacctggaacatcgagtaggtcgccaatttctcttctatggtgggccttctcatctccgcttgccgaatcacaatctagggttaggattcttcctcctcgcgactcgatgggtgaaagaaagtggtcaggactgaggagaggcgacgtggcgcgtccctaatatatatatgttgggggaatggctccgggtagcggagccagcctccgtcatgtgatgcaacacctaccggagccattcaccccaggagaatgaccggaggcatctactgatttaggctccggagccaacccaggccttcggagccacctaggggctccggggtcatccaaggccttcgaggtcatctaagtgctctggggccgatcaaggcctccgaagctgtccgtgggctccgaagccatccatagcaacccgtttgcggtgcgtgcaggagaatcgtcgaatgctcgtatggtttgatggattcgtactctcatttcacgcctaactgttagccaaaatatcagctattcacggccagatcgatcgagtgagcgcagaaggctgtgtttagttgctgaaaaaagttggaagtttggggaaagttaaaagtttgaaaaaaaagttaaaagtttatgtgtgtaggaaagttttggatatgatataatgtgatgaaaagttggaagtttagggtagctgaggtgaactaaacacggccgaagtttgacactccggccatgcacgcagcctgatgcacgcgctggtttaattacctggttttcgctgttgcttcctggagtagctgttgaacaggtgctagcgaaaaattgcgtcgggtagctttcgctgtttaattacctggttttcgctgtttgcgtcgtgttcctttccagtttaaacattaattaggctgcgttcgatatcaggagttcctaactccccctgtttttcgcgtgtacgcttttgaaactaataaacggtgtgtttttaaaaggtttatatatgaaagttgcttaaaaaaattatattatctttttttaaaaaaatagctaataattaattaatcacgcgttaatagaccattgtgttttccgtgcgtgaatgatgggttcccaacccccaccacccaacacagccaagtcattagccgtcctatttttaatactccatgatttaggaagaaataaaccgttgactgccactcgatcgccatacacacgtacaagagcagatgcaataatcctagtcagcaggctccaaaagctattatattgtttttttttattagatggagggaagagaatcgatgagagagaacggagcgggagctaatctggcgcccggcgatagcacgcgttttcacgcgcactcacgattaaaaacatattttgtgggtcccacggtcacttatccgatcccgtgcgcatcctccttcgttccaccctccggtgcttcgtcgaccgacggacggcgtcttccactagcgtaatctgagtatttctcgtcggcgagcgagaaaactccatcgcccccacagatcacgtaggcccatcctccatcctgaaccacgcacgctcatcctcgattcctcatcctcgtccaggaagtcttggcggcggaattgcagccgaccagaagcatctcatacgggcgtcggatcctgtacgcggcgaggtacgtagcgatgactgtgctcgtcttgtgcttttgcataggctgatcaatcatcattgatgaagacccgggaggatcgatgtacagatggagctaatccatcgcgagcttgctccgctatgatcaaccaccggctagctgcaaaaccgttttcctttgctgttttttcccttccttgcattttcatgcttccatgtgaatggagatggataacaggataaacaatctatcattatcttttagttgctatttctgttgtcgattttaggcagggtgactgttgcgatttcgcctaggaagaagaagagaggggaaactcgaagaagaaagatgagccagcatgcacaaaaccaaacgttttctttttctttgatgtgttcaccttcatagttcatatcacagcaatggccacaaaaataggatccacttatgatcatacatgtcaacacgtgcatacataattaattgtttgatataaaattatactgtagtcagctccctccgtctcacaatataagtattttgagtttttccttgtaacatttgaccactcgtcttattcaatttttttttgcaaatataaaaaatgaaaagttgtgcttaaaatactgtagataataaagtaagtcacaaataaaataaataataattttaaaatttttttaataagacgagtggtcaaacgttgcaaacagaaactcaaaatcccttatattatgggagggagtacaaaatatggttagagccggcagtcggcggcactattgaccttgctcacgtaatcctgcccatataaagagctcacgtggccacacatagttcgtcgatcgatcggctcccttcccgccatggagggttcgtctcgatctccttgcgtttgcatgctgctgctgctgcttcacgtcgtcctgctcgctccggtgctccaagcacggctgctcggactcggacatggacgtcgtctgctggtggcgccgccgctaataatgctgccggtctcgattctattgccgaagcggagacggcaggcgtaacaaaaaaaaaaaaaaacgcaatgcacttgtcgtgtccgaccttttttttttcggaaaaagtatacttcgactccttcaactatgacccgagtatgattcatgacctccaatcacaaaaccttgactcctccaactatcaaaaccaatacaaactatatccctcggtggttttggaagcggttttcgctgacgtggcacttacgtggcagtgttgacccggtcttcgtcccacgtgtcgcttatgtggcattagagtaaaaaaatattgtgggaccaacatgtcattcaaaaaaaaaagtaggacccaccgacatatgggccccacataattatcctcagctctccccctctttctttcatcttttctactcccctcaccttcctccatcactagagacggggcggcggcgacggtgacagtgacggcgcacgggggaggagctcgccggccgtccacgcgagggggaggagcccgctagccatcccgcgagctcgccgcccatccgcgcacagagggaggaggtcgccggccgtccgcgcgctggggaggaggtcgccggcgtccgcgcgggaggaggtctccggccgtccgcgcacagagggaggaggtcgccggccgtccgtgcgcgggcgaggaggtcgccggcgtccgcgcgccggggaggaggtcgccggcgtccgcgcgccggggaggaggtcgccagccgtccacgcgcgggggaggaggtcgccggccgtccgcgcgcgggggacgaggtcgccggcgtccgcgcacgggggaggagctcgccgccggccgtccgcgcgctggggacgaggtcgccggaatccgcgcacgggggaggagctcgcggaccatccgtgtgccaccgcgacgccatcgtcacctctccccggccggccattgtcacctctcctcttcgtgcttcgttgcttcggccagccgcctctagtgatggaaggtgagaggcgtggaaaagatgaaagagagagggggagagatgacgatgacatgtggggcccacgtgtcggtgggtcccacatttttttttgaatgacatgtcggtcccacaatttttttaactctaatgccacgtaagcgacacgtcgacgacacgtgggacgaagagcgggtcaacactgccacgtaggcgccacatcagccaaaaccgcttccaaaaccaccaaaggatatagtttgcatcggttttgatagttggaggagtctatatacctggttttgtggttcgaggatatgaatcatactagttgagggagtcaaagtataatttttcctttttttttcccaccgggccacggcgcccatgggccaggcccaggcgaggcatcctattccgtgacgtggataaatttctttttcgtctcccctgatcgcttctttccccatcgagagttcgccagaaggaagaaacctaaccctaagattgcgattcggcggcagcgacgaggcgcgggcggagatgaggaggcccaccatagaagagaaactggcgacctactccatgttccaggttcgtcagggatccaccgtcccgatcaccgcgcgggagtggctggactctgtgatggctggagttggctcgatctctctggcggtgcggggtgctggctcgatctcggcggcggcaggagcgggagatggggcttgctcgagctcagtggcggtggcggggactggctcgatctcggcggcgcgagcgggagatgggcctttctcgagctcagtggcgggggcgggggctggctccatctcggcgacggcgggagcgggacatggagctgggtcgagctcagttgcggcggcggggtcaggcgaagccccggcgaggaggaagaggacgcctgggagatggaggaggatccctcgcacgctacctcatccttgcctgagaaagaggcccatgacatgggaggagcttctcgcggacagcttggacatgagcgatgaggttcactgcttcagagaggaggataagcccgctttccgcaagtccaaggcgcagatggccaggttctatcagaggatgatcgacatcgagaataacaagatcaaacaaatcttccgaccccgcgtcccatccgatacacagtatgttaaaccccttcttctttctttcttttttttttctcatgggtatgtcaactacaccactaagaaaacatcatacaaatagaactttcctttcgtagatcctaacacacgtgaaatagcacacccattatattcctcattacaaagttcatgtgaaaaactatcattgtttttatcacttataaaacagtagtgaccgcaaacaagacatcgataattcagcttagaatagatctcctaaggacacaaggaagaggtggagacagaaaagccaaagttacttaatttggagacgaattctgtacaatcctttaaatgggtaaactgacattacaacttgcaaccattttaattaataagaaatgtggattttttaagctgcatttccattcttggtcactgaaacagttaaattataaaacttcagttgattcatttagctagtggtaagagatagaacatattaacaattgaactcttgtatatgcaacggatgtaatagttgaagtacgctatcgtcatagtattttaactcatcagatgcatcatgttcctgtgcaaacataggtggccatcttttatacagtctagcaactctttggtacttggccaaccttcacaaaaggtgcttgcatttataaattgaacaatcaaaggtcagatatgcgacagcaacagtgaatctgaaagaatgtcaggtactaacttctagagttagtttgaccatctcagcatcccaggatcaaataaaaattttcaggatggtttaagaatgtgcagtccaacttaggagttgccattagtcaattctctgagtttgaaaacaacactaaaatctgagctaattttaaaggaatgatccatcctgtgtgctgcactaatattcaataattatgttccaatctggatggcagacacaatctggatgggcttgaccaaggtttcatgcatgttgggtaatgaatattcccggggacaaaattaagcttgggtatgggtattcactattgatgcccgccatgcccaattgtcatccctatctatattcctgacaaaattaagtgaatacctaaaattggttttgtccaacacactgttgaatctattactcttttgaatatattgcagcgagcaacatttgaccgcagaagagatggaggcagagttcgctggcaagaaagtttcttcccaagcttgtcactttgccaatttagcaattaaccactacaacaatattgaggagaacattgtaatagcccttttccttgtttgctttccatgacatcatgagtctcaatgttgtaaactaataaacctttctatttttgtctgttcaggttaagattgagctttgtactgttcttttatcaaattgttttcatgagatctgtgggtccacatacgcccatgtcaactttactgccagggctgaggatgatgatcaggctaagaagagactatactttgcagagctcaagttgaatccggatcttctggcaaagaggagggaacgctttgtagagttgagccttgatccaaatattgttggatgtgctgatgatatcgagcccatgtgtgtcgtctctatacacaatcttcagggttcttgttttggtatgtttattactatcgacttatttactgtattctcaatttactgtgttctgattaatatgcttgcttatttgtaattactgtaaggtctctatttatgtttgtaagtgtgatagtaggacctcagcgatttattcgatatgttgatgttgcttttgtaggtggatgccatgagatcaacaggagaattgattatgtaatgatcaggaatcaggactacgagcgttgtcacgcatgtagcgatcgtatcaagcatccatacgggacagaatttattgcagggcatgatagttccaagattccgtattacactgcaggctgatgtaataataatatgattagagctatgacttggagtattgttagaatttagactctttatttatgctttgacatctatgtgcgcgagtgatctcttctaatgcgcaaatattacctgatgaagtagccaggatctttaatgaagcctctatggtatgtctactgtaaccaggatcattaatgctctattcagttgctccctctgggctagtattattagtggatgaagaaaattgtcgtttgaacgttctttttagttatgggacgagatataaatcataactacatgctttaaatcatctataaatcatctatagtgaattcaatactctctccatcccaaaaatataagggcatgtacaaaggtaaagtctaatatggtctcttagttagtacataatattatttagagactatactactgccatagttgagacaccaatcactctttaataattaatgcaccaaaatattattttactactacctttcattccttttctccactctcataacaaaatttcttttaataaatgtttagagtcaactctgagctgttatatgcatagcaatcatacttttcttttctctcctctctcttccacatttttcttctctcctctctctttcacatcatcaaatttacttgtatggcaataaagagagactgctattatacacggttgtacatgctctaaggcacaaccactcctgacacaaagagcaagaaagaatttaatcacctccttaattgaatcacatccgtacatgcaagtaatgtgattgggagacttaatggtacatgaattaaaataaaccaaatttaaagaaccaagagatgataattaatgtatgcatgcacgccttatattatgagacataataaaaaagtggttgtgtcttatattttaggatggagggagtagctaatacatacaatagttacctataaacatatactacactattgatacatggtcccacttgccctacacatattgcatcttgcagtccgtgctacggctggctataaatctgtagcccgctgcttgtttctctccccgatatgtgtttatagctgacttatagtctggtatcactggtggagaagtagtttttactcccggttcgtaaccccctttagtctcggttttccaaccgggactacgaatccgggactaaagatcgctatctttagtcccgggtgaaataaccgggagtaaaaatctatctttagtcctggttggtgttaccaatcgggactaaagatggagcatgccaaccgggactaaagatagagccaggctgatccctggctgctcctttattatattcttttcttcattgtttttaatatattgatttcactccatccccatccccaaaatcccaaatcaattatcacctccaaatccttaaatcgatcatctccaaatacatcacaaaatctttaaaaaaaaattacatcacaacttctacaaaattcatcacaaatacatcacatattcatatcacacacaaatcaaatacatctcaaatccggatcataaattctcaaaaaaaaaaaacaaaacaagccgccatcttccacctgccgcccagccgccaccttccgccttctgccagccagtgccgcgcgccggccgctgcttgttaatggctgcaataatggctgcaatctaggaaactaaataatggctgcaatgcagcatgcaagacactcatctatagatagccaaaaggcctgaggcccgacgcttggcccacggca

SEQ ID NO: 38099 - DNA, 2580 bp, Oryza sativa
tattttaaaaaaggcacggtgggccacccgtgccttcgggctagcccggcatggcccgactactagtgggccgtgcctgggccagaggtgcagcccataggccggcacagcccgactactagcaagtgccgaccaggtcgtgcctgtgccgaaccgtgccgggcgggccttttggccatctatacagtcatgccgtgcagggcttgcgagcgtgacatcatgtatgacgaggagtctttgaccagcgactccctggatgaggccaacgagagagtgcatgtggtcctggactccatggacgctgccggcgatgaagtgctcgtggtcgtcgactccatggacgatagagccggcgaggaagtgtttgtgaacaacgagggtgatggttgaccaccgactccatggacaacacggccggcgaggaattgcacgtacgtgatcgccgactccatggacgatggctggctagtgactccatcaaaagtgcaatctccatttgcatcaaattttgaacaagtaagcacttaagaacattttagggatgctatcactggtggagaagtgctttttactcccggttcgtaaccccctgtagtcacggttttccaaccggaaaaccgggactacgaatccgggactaaagatcgctatctttagtcccggttcaaataaccgggattaaagatgaatccgggattaaagatccctatttttagtcctagttagtgttaccaaccgggagtaaagagagaatagtggtagtcccagttagtccccttttctttttttttattttctcccaaatcaagtgggaagcatatccccaaatcaaagtaacatcctaaatccacatcataaataaagtaacatcacaaatcttaaagttacatatacacacaaatcaaatacatcacaaatcctaaaaagttacacacaaatcaaatatatcacaggtcatctcagatccatccaataaatcacaaaattatacatgtgaatcacaaattaaaaaaaacagaaaacaacgccgttgccgctgtccgccacggccgccggcccgccgccgcctgccacggtcgccggcccgccaccgggcacggccccgccggccgccgcctgccggatgggaaggggaggatgggcaggaaaggggagaggagaaggtataggaaggggaggggatgaggaaggggaagaggtggaggggaagggaggatgggcaggaagggaggggagaggggaggggatcggatgaggaaggggaggaggtggaggggatgaggttgtaggaaacggaggaagaagggaaagaaggggagagattcgatctgtggaggagaggataagggatagggattatattgggaacaccaaccggatccggttggtgacaccaaccgggactaaagatcctcggccccctgacatcaatctgacaggggatgaaccgggactaaagatgatttttagttcggttggtaagaatgcctctgtggttttcaaccgggactaaagattatttttagtcccggttctttttggaaccaggattattgtggttttgggtcgatccagcaaagattatttctccaccagtgtattcttgcttctaacacgtacgtgtaggttctccttcatttgcacgcaaagaatatttctcagatttcctagtaaatagaaccaattttcatcaacaaaaacaacatcaaacatgcaggcccttaaaccctggatcaagcatggatacgcaccattgcaaccttgctttcttgtttgcatctatcaagtgtgactttatagcattcgaatgacatctactgagaccttctcgtattattctttgcaccttgtacttactcaaatgtaatgtaatggagcacaaagatctcaaagcgttgtttgttccttgaaaggaatgccatccagggttttatattttggaaagcaagaaaatttcggtgggcaccgaaatttcgaaaaaaaaatttgggatatttgcgaacgaatgttttgaaatttaaatatatttttactgaatttgaacaaattataaccaaattcataaatatttgaaaaaattcaaaaatttcactcgaaatatttgcttgccggtgggaaggcgaaattcccgaaatttccatccctgatgccatctagcacaaataaatctacttgaactcgcttgcggccaaagttgcatattctattattaacattaacatcaaccgtaatgcattgatcaaaataacttttaccttgcttctaaatacgttgaactgatcgaatgcgaacgttgaataactctgcaacttccctcgtcacatggcgctccagttttccatttgtgcttcttaatgcattagatatttgttttcgtgttgtacttggcacatctttcgtgcctgcgagaaaaaaaggctttttgacatttcgtttatgagtgcattattccttattccaggagtcaagatacaaggtggccaaacgggccgggccaaacaggcggcccggggcacggccgaacctgtagcaggcacggcccggcacggcctgctacagtaacgggccgtgcgtggggcc

SEQ ID NO: 38100 - DNA, 28001 bp, Oryza sativa
acagtaacggaccgtgccggcacggcacgagtagccgtgccgtgcttgggccgctggccgagcccgcgggccggcacggcacggcacggctactgtagcggcacggcacggcacggcccgtttcgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggcgacagcttcggaaggattttccggaaccgcgagcggaagtgtttcgacacacaccggctcgaagagatcgagaacctccgttgtgtggcaaaacttcaacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgtatggaagaggttttgcaatgcggccggtgtgaaagctcgtaagtttgccaccgatgcagagcatcgcgtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctaactttgtcacaagtttattatccaactgctaatataattttgcacaacccttcttgaaattgctactttatttaaagaatacgaaaatgatgacgttctaactgaacctgtctttcacatgaaacaaaaatatttgaaatattggaaaaatatacctatgttatatgcttttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagatacagtggggtaggatttggggtggatcgtcttcaatccaaggtggtggcagttcgtcggctacaagtggagacgcctcttcgcatgttgtggccgaagagttgtccggttatttggacaacgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggatgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaaatagttctgacctttgagctgtactcttttctttgtcatggttttctcattttccactatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaataccattttttcttttttttaacattagcaaatcattacttttttaaaaaacttttatttccattttttaaataccattttttcattttttaacattagtaaatcattactttttttaaacattttggatccatttttaattttttttttccttatacatttcctttgcttttttttttaaaaaaaaacactgtgcactggcggcctggcggcctggcggccagtgcagctcagctgccggcctgccttcacgggccgccgtgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctatacagatacacttaacatagtggataattaaataacatagtttagtaatatgcccatgctaaacgctacggtgaaattctatgtctttaattaaactttaaaatggattcggatgccgtgaatagaaaagttatatagagtacaagaaaatatattttccgcatgtcacgaatacagatgttccattccattttttgttatgtgtgctttttgaacaaaattaatacaccctgttcaattcacaaatggtaatcatcatcgatcaataacacccctaaccgtacgaattttctcgttttttttggaattttttcggctcctcaaaaaggttaagcgtggttggctatttttgcaaaaagctcctcgtgtttgtagaaaatatcgcacagatgcttaaatcgactaacaacccaccatattttatccggaaaaccccttatcttctagtgaaatacaatgtgaagaagagaaaattccgctgtaaacatggtaaggggtatttatgcaaaacatccatcccctacggcctacccccaatccccaaaccatcccccgatccggaaccagatccctctacgttagagggacgtcctcgcacgatcgccgttcatcccgcatccaacgctggcatcggctctgcggccgtccgtcgtcctcccgctgccgccgccgcgcgcgtcggagccgacgccatcgccggcgctacccgccacccccccggccccgccggccgtgagcgacgcgggcgtcgtagccggtgcctgcgctggcgctccctccccccttgttctcctcccactccgcccgccggcaacggggcttgaggtgccggcgaatccgaccgcgcacgggcaccccgccaccgccgcccgtcagatccagcggggagaggctggccgtgccccccgcgcctccacgaggggatctgcgttgagggggaggacgaggaggctgcggagaaggaagacgaggacgaggaaggccccagcgctcgtcgtcgtgcctgccttcttcgctcgttgtcgctcttctgccccatctccggctaccgccgtcgccgtcgccccccgggtccccggcatcgtcgccgctgtcgtggcctccttgagcccttgacgaggaggggcccttcacctgaggccgcgacgagaacaaggacgaggacgatacgccgcttcggctgatgggtcgtggcggagccagatccaaacgccttcgactcctccacccttgccgtcggcttccaggcggcgggcagcagcaggcatcggaggtgacccgggcaccgagcaggagttgttcttagcgtgcctcctacaacgcgccgtcgcccgcgacgtgctggtcccgtcatcagcgcggcggcgacgccgaggtatgggagccgcgcgctggtggtggccagatccgtgcgtcacctgcgcgcacaggcgcacaggcggcgcaacagctgacgcagcacgggaacatcgggtatgtgcttcgcacactcatctccatggataagaagcctgcgaggaatctcaccgcctgccttgccgccattgctggcgctgtcgtgaataacagcaatggcggaaagttgcctggtctgtcacggaagctgttccagaaggcgccgtcggaacacaagaagaacgcactgacggaggtcaagagcggtggcaacacgcgggcgctcgccatggtgctgcgcggcgagtgggtggacgagatcgctgcactccgcctccagttcgagcagaaggacattgaggtacacacacagacatatccacctcttccccactcctctgtgccctctgtggatgccaacgtgaccttactgcgattgcggcgttcaggttgagcgcctcaaggacctgtgcctgtggcagcgggaggagatctggacgctcaagggcgccgtgttcttcccggctacacaaccggaccacaacctcacgggacagatccaataccttgctgaaaagatcgcggtggcacgttttcttttcttttcttttcttttctttaacgtttttcaatgcagacacttcactaactctattgattacccacctaatcacctaatcttccgtctgcaatcgtttcactatgtacaggttaaaaccaagaaacatatgccaagatcatgcatgttttgatgacgaatactgctgttccccaagtactgtacgctggtgcttaatgagaatgctttctcactggtaattttcacatgctccaccattcgtctgctacaagtacgattttcaaaatccagatggaccatttgactgctactgtcaactgcttatatgtgctccttcataaattgccttcaaatcaatctttttaaatccaaagttcgtgctaccaagtttgcagtatgcattttcttctcaaacttgatagtctgctatgcaaaggtagttcagtggttcatttcttaataccagttttgaaagtctctttctcctgttgttgtttgtccttacagttgttctcccatggcgatgaaccacttagctatgattctcaccgtaaatttcttgcaaactattgatcaattaattagatggtttgatatttagttaaatattgatcagtcgcttaattttcttaatagttacatgatctatattccaatcagttacttagttttactataaatttcttatttcttgatcgataacttagttttggtacatgatctgcaatatgtaatcgatcttgacaccttgtaatcaacgttgctagctcccaagtctctcgatctttcgattctccccaatatctctttatcgttttgccatgcacactttgatgtggtaaagataaattacctacttaattaaccttccattaaatctttagattagtacctggtccacttttgaagtgccttctaatatttgtgttttaaatcgttagatcgaatggaatcaactgatctcgtttttccaaccataacataaaaatctccttttgtgcaatcacaaagtggaggtataagtagccattttacgtcttctgtgcacatcaaatgttagatgtgccttgtaaattctttaagttatttttcaggtagatgcttttccattttttgctgggccatcagtatcttagtctttgttcctgacaggcactatcgatcggctagatgttcttgaactcttgaatgcctgatgcttgatcagtgtgtcctaccaggcatgatatctccagagttcagatttgcttcttgtgaatactggctaagtaaaactggtaactattggcaattcggcatacatactactgaaaggacggtccttccaggcgtgacatctccatgttccagaatttttttgtgtgttttcactaacaaaggcggttattctttagacatttggtgctttcccattcaccaccgcatggatcttttgatatactatgcaggtaactaacagcacaggcaattatattctgctctttcaagattttagaatgatcatgtcctttagtttgtattttttgcatgtaccatacgattgatcaggctaaaaaagcatacccctttgtaattgagaacatattctgtaatagttcttttaggattgcgaacttcatttgtgttatattctctgttaaggaatgtgctaatcagcagaagaatgacaatagagatttttgttcccttcaatgaaccaccaccacatttgcagtccagcagaaattgaaaatagttgttctccagttgatggtgtaacaaacaagaagcttgtaaggttccccaacctatacaatatattctcaaccgcatacggcagcagtcaaattgtcctccgatatcaatatctggcgttctaatacccgaattttttttatccaagcacaagcaacacagtattttcaaatgtgagcacgccaaacccacatttttatttataggcaagatgcaacagtgattctattcaatcgaatgtcaacaagctaattggattagggatggcaattgtgcccgtttacccgtgggtaaaaaccctattaggattgggtttgttctccattttatatctatgggtatcttattgggttaaaagctacccatgcccgctttgcccgtttacccgtgaaatctaacttatatgtaggctaggagcaaaatccattagaatacataagccatgttctttgttttctacggtttctcttttatttcccttattatttctctccctttactctatcgccgccagaggagagacacgataccgaggcggagaatatttgatgttttaagttcgattcgaacttagaaacttgtagattttttgttccactgctcttgttgtggcgggaaaacaggcacgcccgcgggtataaggcgcccgcgggcaatgggcatgggcaaccatccttacccgttatgtagtaatgggtatacccacgggcacaaataatctcacgggtataggtatgggtaggtactacccgtgcccgtcgcgcccaattgccatccctaaattggatgctgaattgagttgagtacgtgcgcttatagaccaacagcccacctcctattagccagttagtgtttgatttagatattggaacaacatagtaggtgtaacatttttctactgttcaaatctaattcatccacgaggatcatcatcaaaaacgtaatttgtgctaataatcttcatttgttttgcaaagcagttttacatatcagttgttacaaataattgtagcatgcatataaattttttagtgtaatctgaataaagctaagtaaggtaccaacacgatagtcacgaagaagagagttatcgaggctgctgatttctagatgtttttgctagtaacaaggcagaaaaggcctattcatctatcgtggacatttactcaaactattctgttcatcataagattactcagattgacttgattacatgggcatgttgtttagaaatagaaattcaaatatcgtgtgctcacatttgtaattaacaggttgcatgtgcttatataccaaaaaaatggaatacccgaattttttttattcccagccgattatgataggtctgatcgttgctacgatggttaatacatgggcatgctcaagaacttattgtttttcttgcttattgaatgtatttttgtgtgctgatttttcccacaaattagttgtttcctcaagtataattctcaacgtttacaggttctctgtaaaaactaaatccttacgttgtttaaataaatgttgaaataatatttttattataaaattagcaattaagtttcaaaaattaatcatggagaatttaataaaaaataaatataaccatgttgttttatttttacacttaccttacctgtaaattaatttaattataaaaaatatccaagtatttcaagaaatttatattttaattagttacatataatgtaaatatttgttcactttttcttaattttctcatattttcttcccgttgcaacgcacgggcactttttctagttaggttctaaggaagtatagaggctggtctttggtgatgtggcgctgacgtggcacctaaagttagaaaaaagaaataaaatatggcgggaccgacaaaaaaaaacaggtctcacccaccgagtttcctaattagcgcagacgcgctagatatcaatctgacgcgtgtttccggcccatttctgttttgtccatgtattccggcccacttctgttttttcggtgtaaagaaacgtcgggaaagacggcgtgtcgtgcgccggcgttagatttggagaaaaaacaggattagttccgtaattagtttccgataattatgttttcaattaatcttgcctttttttcacaaggttgttttctttttttaactaaagattttaaaattttatacgtgaaatttaaaactttctatagaagaaaattgaaagtcacaatcataatttaaaacaactcaaaatttcaactttcaattcaaattttgaaaactttcaactcaaaatttaaactttcaagtcaattttgaaaactttcatcccaaattttaaaaactttcaactcgaattggaaaactttcaacccagatttgaaaactttcaagtcgaatttaaaaactttcaactcaaattgaaaaactttcaacttaaattttaaaaactttcaactcaaatttgaaaacttttaaggtaagatttaaaaactttcaattctacgtttgtaaagaggtataggaaaaattgaaaaaaaatcgggaaaaaaagagcgaaaaaaggaagaaaaacccgcctgtagacaccgaaatcgggaaaaaaaataataacagaaaaaaaaggtggggcaggggggctaggcttgctggtgcgtacgcgcgcattagccgcccccctcacccacgcctacgatcgcgtacctccggtcggtcacccacgccgcgtccgcgctcacccgctttgagatcggcgagccgctcccaatgttcgaccacggcccgcccgccgggattgtccaccgcccggcctgtcgtcgcaccctccatcgagcaacagcaacggcgcgcgcaggaggaggaaggcgctgttgtggatgatcatcttgttggcgacgtggctggggcgccgtcgatcggtcacgcgagaggaacgcggcggcggcggcggtgaggagatgaggatggtggtgaggaacagtagcctcgcggaggtcgcggcggggttggaggaatacttcctcaaggccagcgtcggctgcgtcgccggcgacgccatgtcgagccacctcgagtcgagcatgggttgcagaatagaagctttcatgccactgatcaccaccacatgaattgattttgttcatggtggaccgaacaacatcttggacgcgctttgctgcgtgtcagcgccatcagtggcgcacgaccacgtcgacagcatcaatggcgagcagaggcatacccccaccatgtagcagcagctagcctgggagaagaagctgtattgggaagtgaaggtgataacaacttaccaaaacaaagcctcaaactagccgtcgtaccgtattaccgtgcgtgttctatggccagtcgagtgatgcgatgttgcaatgcaggcgagagagcggctgcaggtccagaacgataagaagctggcggagctgagtgaccaggagtacagcaggaagattgacgtggatgtgttgaaggcttgaagctgaagaagaccgcgtggacctcgccaggggcagcatcgcgatgcgcgttggcgaggatccccgagctgccatcgggcgctgtgcccatcctcttgtagccggcctcgtctcccgcctcgccgaggagaggatggaactcctctgcgcacaccgcggacgctgctcctctccctgtctatagccggcccacgtgccctggaggctgggaagagaaggaagggaagagaggaatatgaagctgacacgtggggcttaggcactaaaaaacggtcgtgtttggaatcagccgttcccagattacatagctcacggaaaacgaaacggtccattaacgcgtgattaattaagtattagctaatatatttttttaaaaaagatcaatataattttttaagcaactttcgtatagaatttttttttttttgcaaaagaacacaccgtttagcggtttgaaaagcgtgtgcacggaatacgataaaatttcttgcgcggaatactgctctaggaccttatatgtactctggttttgtaagttgagggatgtgttatgtctgttattatggttgaaggatgtgatctaaactcgacgacaagatgagggacttgaagtgaacttattctggaagggagagaagagcggggacatggtgggccgaccgagcccagggagaggagggatgcaaatttgacttctgcagaaaaattgaattagagagaatttggatttgaattcaaattacatattcaaactcaagggatcaaggaggagtcaaggaaggaattcaaggtggtaattcgatgtttttggaactggaacaagtattagacaaggattaatcaaagggagagatttaacttcgaaatttgatttttgggggacttgattcagaatatggaatttcggggtgttgatttttgatgtcgaggagggggaacaagggaggatttaaattgatatccacaacatgacttggctgagtttgtttctaaaggttcccaacccatctccttagttttccacgcccacacttttcaaactgctaaacggtgcgttttttacaaaaagtttttatgcaaagttgttttaaaaaaatcatatcgatccatttcttaaaaaaatagttaatacttaattaatcacgcgctaatggattgctccgtttttcgtgcgggagggtagcgtttctaaccatgatgaacgaacacaggcttagaccctcactctataaagacagcaatgttcgatttttaaaggtgttgcatgggacagcaaagagaaatgagcgacgataggcaagcgagcttattatagatttactttatacctaatgtgtatatagggttacctccaatacaataaatgatagatatagcagcaagcgagtcaattatttacttgttttgaaaaaaaaatataaccatgtaaagaaaatgtacatagatatatcgctgctaagcgcgtaatcacgtgggccaccctagtagtacgtagttatgggaaattcgctattgaaaaagatcgttattatcggtgtcttttcctccaactagtgaattagctgctgattattgaagctgctttatgctaagagagagacgagcatgttttacttaatctgacgtgtatattgctatagcgtgtacatgtgcatcagtgcatgcctgcttagctcatgtcatattatcatcatgtcacatgtatagctcgccgccactactccagtattactggtggcaggtttggcgacaagctaactgcagcatactagtagcctaaccaatcagctctagtctctcgtccaaagtgaacaagatatacgcgcgcaaggacatgaatcgataaatcgaccgttttttatgcgagaactcagagctgtgtagcagtagtccacagtggccactggccagtgtatgcatgtgtgcatgatatatggtgatctgtgccaatctctgatgtgcagttgggcatgatactcgcaaggaaaaagaaagaagaacgcatgcatgatacatatatatcgatcagagaaattgagaagcgggtgcatgcctatatatgttaacagctagtagtagctagtggtatgtatacagtcagtacatgtgatacatcgtgtacgtggttcttcgtgtagacggccggtccggtcaatcgaggaaagatacgtcgtcatcgatctgatcagtcaagcatacgaggctggctacgactacgatacgagtggtacgcttctcttgctagccgcttgctttaatttggagcaatcgctccgcctgtctgaactaaagcaaccacattcacatacgtccaaaacttctttttttcaaaaagctatagctctttctatgctatgcaactgggacacctgtccacaccgatcgcttgatatacatatacacactgtcctgtgggtcaaaagaatctcgagcaaataaagcacacacacactgcgtcttgcgctgctctctcttctctatctacattaattggtggcttccgatcctgcgagggagagagaaggcagctgtgccctgtgatgtatatcaaggcaaaaaccctagaccaagcacacgtccgtctcatttctccccctttctgcttccaccatcaaacacaccgcagccgccgccgcctcctcctcctgctgctgctgtgagcctttgtgacacgcacacatctacattaatttacacatgtattattactacttgatcgaattcaatttgacagtaagctaggtggtggttctgcagagccaaccggatccaagatggaggcgtttgaaccagatcgatcctagctacgaccttcctgccctggaggatctgcacttcttcccagttctcacgaccaccgtagaccacagccaaggtaaaatatatagcatatctctgttattaccccccaccccacccaaacctaaaccctcttttatcgacgcttgcgagtgatcgatgttcttcactcatcttcctacttgtgcatttattttttatctgctcgatcggttgctcaaggggcacttcttgtctaccttaactaagatctcttttttttgttgccattattactcgatcggctgcctgcattggtggggaaatttaaagttcaaaaacctttcttttgattcggaccgctagttcgatcgattctttcatcctctcctgcagaggttaattggatccatgtcattgcaaaagtacatatttaaataaataccgttataattcgtctatttctaaccgtgtcattaaaattttacaaaattagaatcgtgccattgccgtcaagtttctatccatctccatcttttttttttccgtttcttctttttttttccctcccatcttctttgctttgcttggcggctgtgtatgatgtccggccgcgcgatcgcgggggttcagggcaccaacgccgccgtggccagcgcgttgatttctcctcctgccatgcgtggttggtggccagcgcacggcggcgtggcggcgggcgcagcaggcggggcaaggccgcactgcggccggcagcccggcacaaggcggcgctgcgggcgacggcgggcgcagggtggtgcggtggccggcgcaagcacggcgggcggctccctggcgaaagcgcggcggcctcgacgcggcttcggcgcaggctcggtgggcggcggccggggcacggcgcgagcaacggcgacgcacgcagtagctcgaccacactgtgctgatcgtcctgccaatctgccatccgttgtggtgttccttcaatccttctccttgccttgctcggatggtatctatggtggagcaacaagatgagccagaatggcaagaaaaagaagagcaagagctccaccatgaaagtgtacttgggccgtcagaagtcgccgtccagggacaggcggacgctgacaacgacggcggagatgacgacgacatcatcataccagcaggcatgccgacgaggtttagcttccaggagattacaacgatgacctccaatttcgcgacaaaggtgagaacaggcgggttcggcacagtgtacaaaggggagcttccaatggcgcggcgaggggctcatcgccgtgaaaaagctcgaggctatcgagctgaagggaagaagacgggagaaaacggaaaaacagagggatggatagaaacttatgatagtggcatgatcctaattttgtaaaatattaatggcatggttacgaatagataaataataatgacatttatctaaatatacacatttgcaaaggcatggatccaattattaataattgattgattgatcactcaattggtgggtttgtctctctctctctctcaacttgggcatgttaattggtggcctccgatcctgctattctttttaaaacatgggaaaattttaaaatccaccccataagtcacgtgacatactagggtgcatttgcaacaaaattacttatggttgctgttcgcaataacggaattaatggaaggcaaaattttaagttaaatatttgatatttgaatgcatgttcgttgaatttaaaaaatcttcatatatatatatagatgttcacaactccacgagattctttgtcacggcgttacgctgaagctgttagaaggatgacatggaaaaaaaaaatgggggtgaatgggatttgcaaggttgccccagttgtcaaaacacaagagggtggtaagaatttctcttgcttgtttaatctgacattaacatcaatgtgctatggtcttttggactaacaagaagtacatgcttttaatcgtatatcagggacctgtatttacaatgctatctgcagtactatggagtcccacctgaggcttaatggctactgcgtcaggctctccgtggaagacttgatcgagaaggagcaagcgctggtttgtgcagaagaagacaggacgctgcgctgcatcgaagtggctaagactctcggagtttgctcacaccgagattatcaggaggtgcgtgcgtacacatacgttatagttagacatttaggccgagttgagtttctaatttttttttcaaactttcaacttttccaccacgttaaaattttcctacagagacaaacttctaacttttctgttacatcgtttcaattttaaccaaacatccaattttaacatgaactaaacacatacttaattatctgttaatgctaattgtctgtttcttaattagagcaagcgcaagggcaccggccggaatgggagcacattcaagatcctctcgatcagggcctttctcaagctgaatgccgatgcttttgcggatgccattgaaagctgggggactaatggaccacttctagctgagatcgatgtggacgaaacattcatgcagtatataattaagttcgagcaagcgggtatcctgtcatatgaagcttacaatgagatcaacatgagagtccatgcagcgtgtgttctcgcgctgggcgtggagaatgtggtaccgttctgggagttcatcaattcgtacggcaagcttgggaagactaagggctacggcagagtggtaccccataacgtgagacgcctatttgagatcgtcgttgaggttccgaagaagagggtgaggggcatattcgagaatacgccgagcgactccatcgacacccaagacttgcggccttccaaggggagacctcctgtgactgatacgggagatgtcgttgttcctgttctcatgggcgcagccgctgccgctgggaatccattccccacacataccatggactgggctttctctgaccctccagatggttatggttcatctgccaagccggagcgcctccatatgatggatatagattaattagcggctttttctgaccctctagttctagttcctctgtaatgcgcttcttatgtgatcaacaactttatgttctgttctgagtatcagatgctgtgcaccgtgagaaacttaaaatactagtactccacaacaagcaagcgagaatctacttatccaaatccaacttgtcacggtttccatgttaatagtaattaataaagggagccacgcaacccaaccgtaccacaaaactgctccaacgacacattgcaacacttcttttaataagttttgagagtagcgggactgaccgatcatatgtgactgaccgatcggcctactaataaacaatggaataacgactgcctcataggggagtaattgcagatgcaggtgtgacaacaacaacaaaagaacaaccgtaacagcattccagaatgaacaagtagtcaacaacataaagaagacgctagctagctaatcttccaatcgtcgtggagcattccaagccatgcattcagttgacacttgatacttgatagattcttcccccacatacagcagcgtcacctctcctccagtcgtcagcaattctcgtctttcaagtctctctcttctttccggacctataaaaagcacactgcccaagtcaacgtgaaattgcacgaataattccagttggatcaccaacaaccttgtcctaaaggcaaatgatcactcccagacacacaattatacccaatttccttgggaagtgcacagaaaacaaaagggaccacagaagaaataaattttaaacacattctatagtccttattatgtaatgtggtcaacattacttgtcaatgccttcggagagactgggaactgagctatattattgtcatctttgtgtcaggtaaggttgttactctgcacagcgcatcgctagacctacttgggaaaacactgagctttgaacagaaacctaagttttggacctatgaaacagtgactatgtggttcctacatatgcaaggatagccagtgtgtcttgtcgatgcattgtgaaattcactgctgcactattagatctaatttgatttacacgaactaatggaatgatcccgtgaaatttcaaaagttctaatccagcattaaggcctattaataaattgtcaatttttttatcctaagaatgaaaaagctacaactccgtaatgatcgacgtacctcaagcatcagcatgttagcgtgattaatggtcagcccctcaggcaatgctcctacgtagccaacaaatccaccgtcctttggatgcctgattccaccccagcaatgggcacagatatcaacggaacctggaggtgacaacccttaattcattgattgtttcagagaaaaaaccatgaacttcagcacaaggttcaatatattgtttgaggcatttgtatcaggggggactgaaacgacagaaatttccgaaaattcggtccgaaattatttgattttttgaacaaaatttggtcaaatttaaacaaatattgccaaattcacagaaatatgaaataatatggtattaggggggggggtccaatagaaacaaaatttcgttccagaattttgaaccctgcttcagcacatgcatgtcaaaatgaatattcagcggcataacatttatcgattactccaatgataatttacaatgagggaagggaggaaacatggagtccaagtgcttaccattgtatttatcgacaatcttgcacattgtgacctcatttggtttttcttccccccttaattcagcaaaaaagggtgttgaacagccagcaacagtggctctaaagtacacgtgccagaaacattgtttgtcagcaagcctcaagataaacatgtggctatccttggctactcccttggttgctttattggctggctgaaaatgagaggaagggaacaatacaaggaaaaaaagaacagaaaatataatgaattaaaaaggtaactgactcaatcttaacaaactgattacaaatatatgaagtaagcagaatacttcagaatactaatcagatgatctccaaaagctaccttatatctaatacacacattaccatctgaggtaaaatataataacaaagataaatcacataaggtaaggtccaagataacatcagtacacacattttccaagttgtagtagtgcattgctagacgggtgcaaacacgtgtctggtgacattgacttgtatttttatgttcttgccaattcaatggtcccggcagcttgctgcggtcccttgaaattgcatccggctgtagcatgcggtgatgaaaaaattcttcagcagcactttcatattgccaaagaacaaaatgaagattagaaatgtgatgcacatctagcaaagcaaagtaactttatgtatgtgttccagatgttatttacgtaagtgcagatgctttggattgcttgccatgatttgctataaaatataccatttctaatgtacagatagctgtatgtagcagtcactgttgctaccagttgaaaaataatcttacatgtataaatatttaatttatatgcacatcatgtatggcctaaaagaaattagtatacataatcaagccttgtgcattaatggaagttacttcctacccatttcacccaaattattattatgttttggagaaacatataaaacacatgagaaaaagaaacatactcagggggacctttcttttcgggcttttgggacgccattcttgatagctcaaaaggagatgcccttaaagttttcctgcatatgtgaaagttaacattgaacttgatgcaggtgcttaacaaacacagattaccgaatagctaaagtaatacaaggataagcatctattgaatgagagctgcaatattcaacataaatataatggtatgttacaataacaaattatttaattcatctagcaaaaactatcatagacatcctattactatctttaatacactaaaaatacaatagaatctaattgggtgcacaactaattgggtccactcatactgaggtagtttaaccatgatgcatttcacctggtccaccactagggtgtgcactacattttcttccccataaaaggttgctttccccccttcgttttctcaaatgagctgaaggagagctatgcaattgatttttttttaaagagagcactgtgcaattgaggcttgtcaagtatcaacattttccaatctggctgattgcagttagatctagtttgcaaaatcttaagtcctaagtactaactaaatctagttaaatccaaatcaatttccacaaaatttgttaactgtaaatcaaatttacccaaaatttgttaactgaaaaacctgaagagacttcagtgactggaaaaaaaaaacctaaagagactttaggcatagataatccgaagtatgagggacaagaagatgagcatcaagcaaaactgctccttaactagtaaagacaaagaccgaacgaaaacacatgccatttaacagaaaaatatggcacgaatactttttaggtaagaaccgaaccacgaaaatatttgggaagcccgggattcagactatgagataaagaaagcggagaaacattaccagatgtatagggtggcgggcgagaatgattgagccgacggcgcgtgggaatggggtacgggacgacacgggaaagggtttagccggcggcgaagaaacgcaaaggcgtggccgcgtgagtgaggaagagagccgaggcttgagctgagagcctgagagtggtggtgccgtggtggagactggaaaaccctagtgggcgaatgctcgcgaacgcaggctttcttccgtttctggcccaggcggccgcgccttttccttttccttttcctgtgtggaataagttcactttagatccctccatttgtcattgagtcttaaattccccaacttacaaaactgtgcaaacgagatccctcggtagtattatctccggttttgactgacatagcgcctatgtggctcctttgactaggtcttcatcccacgtggcattgacatggacttacaaggcaattcgattcggaaaaataataaaacccatggacccacatgtcagtttcacacacaaaataataaaaaatagtggggctatatggtcccacatgtcatcctcactgctcccctcttctctctatcctctctctagtagtaagttgtttcatctcatagatgctctaatggcttcacttagtgacggtggagcgggatgggcgttggtcggagcggcggcgaccggagcatgccagtggtgcagagcggaccgtcattgtcaaccgctgtcacaccgccacagctgtcgtgctcaccagcaactgcttgagctcctcctccggccacctccgccgttgttgccccctccaccgcccgaccactccatcccacccgtcgcccgcttcggcagccgcctaccccgctccgctggttggagagagagggggatagagagaagaggggagagagaggggggatagagagtaggggatagtgaggatgacatgtggggccccatgggcccaccatttttttttgtgtgtaattgatatgtgggcctcacgtgttttattattttttccggatcgaattgccatgtaagtacaacgttaatgccacgtgagacgaagacctagttaaagcctcaaaggagccaagtatgcaccatgtcatccaaatccaggacagtactgctgagggatctcgtttgcactgattttgtaagttgagagatgtgttgtgcctcgacggatgaatttcgaactcagtgacaaaggagggacctaaagtgaacttattcctttctgtgtgaggccttgcggcttttcttgacgtggtgtgttatgcgcgtacactaacgtgatttggagtaatacgaagtagtgaagtagggttagaggggtgggacagtttggtctttggtgtgttattctcacgctgcacgcagtaggggacacagaggaagacgacagcgtcttttaaagtataaataagtagactttgttaaattcattttaaatttatatgtataaagtttctttactcaaagtttctattagagatagtttccatgcataaatttgtgctttaactcgtataaagtttgtacatttttaattttctttcaaattcatatgcataaaatttctgcggaatgtttctaaaaaaaaatctacgtatatagtttgcatgtagcaagtttggactttaattgtatacgttttgtatatatactgtattcgtttaaaaaatgagctttgtatattgcctcggaatactagatatcttaaacgtcctagattcgccgcgagctcagccgatccacgccattgaattttgcagaaaacccctcgttgtttcggtatttcggattaggttcagctgatcagagccgttctttctcacgcgtgtacgaaatctagccgttcattccctacgtacggccttgcctggtcgtggaatcggtggccggtcctctccccacgccgcctcctctctccccccctctctggctctctcccccgtctccccgatcccctttctctctcccttctccggcgccgctttcctcgccgccgtccctcttccccttcgggtgcgccgctccccctcccctacatcccgacctccgcctccaccgccctgccgtctctgccaccgccaccgccgtggcgactcgctcccgcccgcctaagcccactgccgccgctcccgagagtggaggcgggcggatccgcgtgctgccggcgctcccgttcctgccaggccgctcccaaggacgacggccgctggattcgtgcgtcaccgtcgctaccgaggacgggggacgacgaatccgcatcggtttcttcctgccccgcctcctcacggcgtgggtctgtcggtgggatggaggttcttgcgcggcggcgcgggccggggagcgaaaggtgaggactttgtgtgtgttctcttggtgcgtttcttgctgtgatttcttgggggagctgttcgtggtttctccacctgcggccgtggacgagattctccatctctgcttcgggggatttcttgtgggtttcttcccttcctcttcctctctctcctgtggcaaggtgtgggaggacggccatggtctggaactctggatcttctctcttactgattttcctccagcacagacgagcaccacgcggaacctgcggctcgccgtcgacggcgccggcaccaacaaccaaactcgaacgtggaggggcttttggaaagttaagaatggggattttcattttttgttttgttttgaagctttcgctaatttattggtgctgaccatctagagtgagttgatgccttgcaattggctactgagctcagcatttgctttacttgatagtgctcagtttggcaattggaatatacccatcacatgatgcaaataattctagattactagcactgctttgttctatttgattatttttttactcatcagattatgtcagtgcatgtcaaaaagaccagtcagatgatgccaagtgatcaaaagatataaatactgtcgaatgatactaacctttgtactcattttattacaacatgaacaaacccttctttcttcaaccaaattctaccatcaaagcatgggatagctagggccatctcagtgccggtgagctggggacgtggtaatttcccggagttttcaatttattactattcagtttcttgatgtatgagtgcaacaagttagtaaaacaagctacaatttataatcgggtagtcctgtccatgtataacatggttatctttgtttatttcttatcttatatgctaagatatttcttctcatttttgcagggtggaagatctttcgatttgtgaagttacaccaatttactaactttgtgatattgcactaaatttaggctgtatgtatcagttatttcttccagattgttttactcacagaatagatatgtttttcatgttatcaatgcacatccttttagctagaaatatagccttggtgtttgcatgtcaactggagaagcatgtcgactgaaattggttctatttgttccaggacaatcatgtgttcttcagttcctgggttagcattgcttaacaccagcataagcaaatcttggagcgatgaggaacttgtgcgattcttggcagagaggaaagcagcagactctttgccggagaatgtagtggtggggatgaacttttctctcattgatccatggaattcaggttagtgtccaatctatacagaaatttattatgacgtattcctggtggtataaccagtcttgcattctgaattaatggtattctccaacaagactatgtcatgtaatatctgtggtctgcttttcataattcagtcgttatagaccatgaaggcttctttgttttgtcctttttgagttgttatatatatttactttactacagtttattatacgattcggtagtatagcagcattttaattcttaaatgataactaaagaaagggaatcctacatagaattgataactatttagggttaaaaggcatggaccattatgcaaaaccagaaagaaatatcttgggctctgatgaaagtccagagttaagtgcacgaacgcatacttcagccccattgattatggcaaaaattgcctgcatgaagtgctcataaactaaagtgggatgttatatgagaaatactttggcacttcacattaccctgagcatttctttttcatttttctttgtagcctgtgcaccagttgcttgcatgttttcactagaaaattctgaattacgctatttgacgattaaattatgttcaatgtgttgctcggctaggatcctttaactttcacatcctcaccagagtttgctattatgagaggtcattgtttgccagttaaactttaagttttggagatgtcataatgcactatatgccattggttattatcaacttttgtttttagatactgtacaagcagatcatgtgctaagattttggggcttcagttcacttttagcattaaaatgtgcacataagaggagcggtagcagcagcaggaggataggagatgtaatgaggcaagagtgaacttgtgagctttcttaaaaactgtttattgcccagcaacggcgatgcgatgtacacagtcatgacagagcagatgaggtgggacttaaattttattaatcagagtatatgataatgttgtcatctgaatgtttgtaatattcaagaccttaattgctttgttttgatctaatttttttaatctttgaaagaattaacgtcgctataaatagaatgattctgaattttacatggagaaaatggtattcgtacccataactgctgcgatataacattatcttctgttaaaatgagttatcgcattaatagttttcttccattagggctgccaatgttctgaacttttgattaaatttgggtccagttgtttaaatgatgacaaaagtaacagttgctcacgagctctcattctctcctacaagtgtgttctattcatctatctatttttactgttttctagcatgccactgctttgtcgtccataactccaagcaaaaagcaaaatgttcggcttaagattgaaacaaaagcaaaatgttcggcttaagattgaaacaagctttgcagaacaagctttgcagaattgtcggacacaagttacttgggagggttctcaccatacaggtgcagacttgcgcccttttctggagtttgtaggttattagctttacaagagatttgtgctgcttttaatgaaattattatatagtccaacttacgaaaccatttgtaccgtggtgcttgcattgtgttgtggcttaaaacaaaattaataaggcatggatttgcaacaatgaattagtttttgtgtgtccacgggctctgtatgtcaaaaaaaaaaaaacttgtttgcccttgccttcttgctatgaaatattgtactgtcatgtaactaatgaatcgtcatttacatgtaaaagaattgcttctctaatcttacattcttctgtttcccgtaatttagtggccgcgccgcatagcgcgcgaaacctttctagtaaattcaatgtgggctgcctgataagctaggccatacgagaattcatgtctacatttgagtcgacacatacgttggccgcattcacgtggccccgtccgagcaagccttcgcgcaacaacaaccgcaagcaagctaagctttgtgtgcatccttgaataaaaggtccactttccagtcctcaaagcaagggtgcagatggtgtcaaaaggaaaaaaaaagtaagggataatttgatccgtgctattgtaaatgtgtcaattcaaataaatgatattacaattcatttattcatagtcatgccatccaaattttataaaatttaaaattataaccatgccatcgccgttatgttttgggtcccacatcctaggagatgaaaaaacataacggcgatcaggggcggtcacggggcatagacatgggggtacagttgtaccccccaaaatttttttgcaaaaagaacagtatacatagggtatattacatacatgcaccaaaagtggattaaaatgaatattgtcgacgtttgatatcgcgattccggtatttgcatagtatggggatcattggtactaggatatatgcgagactgaggtaaaagagacggggacgaggatttttatatagattcaggcctctgaattgtcaggtaatagccctacatcctattggccgaagccggtcgttgctcttattcaccataatcacaccagtacaatatttgaggtagcctatctaattgttgtcgacatggcggtctgaagttctgactcgtagtcgacaacagggttgacttcctcctcgaatccgtgcccggcgagatcagagatagcgctttcgtctctcctgacagtatccggagacactgtagggaactagccgttcttatccctgaagtcgatatccggcgtcttgtcttggcgtatgttagcttgtatgttgtggcttctgttgttccgtatattgtggtgggtgtatcggcggtgagattcgatgccccaggcccttcccggggggtcttgtatttatacccataagtgcccccttgtccaagtagaactagggaaaccaatatggatacaatgtgagtagtccttgtcgtttccatgtagaactctggttgtctttccttatctagaactccgtccatatccaatgtcaatttccgtataagacatggtatgtggtgggtcctgccgagatgtagtcgactactattaggtatgtggtattcataatcctgacagtagcccccgacttcaatgtaaatgaacgaattcatattcttgaccgctgaccatggagtaactgttatcgagctcaagtgaccgttctcggtgagttcagagataacgttagacttcctttatcagcctcgtgcgggcacctatagggtttgtctgagtcaatctccgatgtcaaccaagaaagtacatagcatacaactaggtctcccgtcttgctgtaatcgagaatttggattgaagtcaagaaattttatctaggcgggtacaccatctcttcattttgtattccttgtcgagatccaccaaccgttctcgagcgatcgagaaggcgtagaatctgcgacgaagccttgtcaacatttgtcgtactcgccttagtcgatcttggtgtagaaccatagagacgtgaagtcttcgacaatgtcaaatagaattttcctgaaatcaatacttagaaaacaatattagatagaaatagcccccgagcgagcgatcaaagggtgacatgttataatatgtatgaaaaactgaaaataaattaaatttacaaaccaatgttttgtatatgagtgtcttctcttttaccgacttcgatcagtcagtttgttgagtcatacactctccctagcccccaagccttgtcgtcggagaatcgttctcagaggataaggctcttggacccttgacctgcctcggttgaaaaaagcactgaccctagcccccagccgtgaagttgaaaaactcaatttccgattacacggcttggttaatacgcacggcgagaactcttacatgaccagatcttacatggtattttgtctctacaggatccgacaaggccttatcggctccgggcgtccccagccgaagtttccttaggttcctcggaggccttgtcaagacgacgtaaagggacagtaggataggtttcaacgctaggtgtcgtcgtggtaagggatctctgggtaaaacacttggcaatattgtgtaccttataccaattttgctggagtagaggtagtgggagaatcgctacacctctggtcaaaaaccagttgtagccccactcgaccacttgaagtaaaggtagtgg

SEQ ID NO: 38101 - DNA, 1082 bp, Oryza sativa
gaatattgaagggagcagctggtcttgctgccgatgccaatgcgttccgcgagttcttcaactgggccgcaccacgtgtctgggatgccgtacgttctcagcagcagcagcatctgctgcaagtggatccacgaggggtaggatcagcatcagctagagacaacagaatagcttcactgcaccagattgaggccgatcttcagaaactcgagaacgacctatggctgatccaatcaactacatccacaatgtatgacctaatcgatcgtcttaaatggcatagccacaaggatacagaagcctggcatcttcgccagatcaagtatgtagtgtatgatgccgaggacctccttgatgagtacaattactatgctctcaaggtgaaggtggacgcaagcaagaacttggggcaagatcactcgcatgaaacctttttggagttcttggacagtgtcaacttcagtaaagtgatggaaatccaaaatagacttaagcaggtttttgaccaatccaagggtttaggctttcacaaaacaccaaagaagtttgatcgattagtcagaccagagacatgtcgtgtcctcgacaagccagataagatatttggtcgtgaaaaagaactgaaggagttgaagcaaaagctaggagtatgtggacgcaagagaagcaggcctgtggcatgcagcactatagctgaagcaaggaggacagagttgcctgtgctgccaatagttggcatggggggcgtcgggaagacaaccatggcacaacaaatctgtgaggatggagtggtgcggaaacactttgactgcataatctggatatgtgtgtcggatgaattcgaggtaaacaggttaacaaaagatgttctgaagtctcttggtgtaaagtcacaacattctgatacaagggatactcttatggttaatttacgtgatagtgtcaacgcaaagaagtttttactcgtccttgatgacatgtgggatgatgtcttaaaagatgagagaggatggagaatatttcatagaactttaagcaatggtcttcagggaagtatgattttggtcaccactagatcttcc

SEQ ID NO: 38102 - DNA, 1062 bp, Oryza sativa
tggcttttctgtctccacctcttccttgtgtccttaggagatctattctaagctgaattatcgatgtcttgtttgctgtgatcactactgttttataagtgataaaaaaacaatgatagtttttcacatgaattttgtactgaggaatataatgggtgcgcaatttcacgtgtgttaggatctacgaaaggaaagttctatttgtatgatgttttcttagtgatgtagttgacatacccatgagcaaaaaaaaaaaacaagaagaagaagaagaagaagaagaagaagaagaaagaagaaggggtttaacatacggtgtatcggagaggacgcggggtcggaagatttgttcgattttgttcttctcgatgtcgatcatcctctgatagaacctggccatctgcgccttggactcgcggaaagcgggcttatcctcctccctgaagcagtgagccttatcgctcatgtccaagctgtccgcgagaagctcctcccatgtcatgggcctctttctcaggcaaggatggggtagcgtgcgagggatcctcctccacctccctggcgtcctcttcttcctcgccggggcctcgcatgcagaccccgccgccgccggcaggaaggtggaggaattggcccccgattgcgacggcgacggcggcggcggcggcggcagagagtccagccattcccgcgcggtgatcgggacggtggatccctgacgaacctggaacatggagtaggtcgccagtttctcttctatggtgggccttctcatctccgcccgccgaatcgcagtctagggttagggttcttcctcctcgcgaactcgatgggagaaagaaagtggtcctgatatatatatatcgatgcgaaaagaaatttatgcatatgtcacggaaatcaacacacgtacatttggctcctgctcagctgatcctataccatataacgatacaaataaacatattgaaattaaaacaaggaaattatacttctgacagatcaggctccgagtccgccgaccatatgtattgcacggcgtcgcggatcaccccgagaaaa

SEQ ID NO: 38103 - DNA, 2270 bp, Oryza sativa
gtcgtcggccagactgatcggcacggcggaggagagcggctcttcttcgtcctcagcaagccgtcgtcgtcggtcggcagcattataaccggcggcgactcctgcagacgtagtccgccgtgtccgagcggccgtgcttggagcagcggaggggcgagccggacgacgtgaagcatcagcagcagcaacagtgcaaggagatcgagacgaactctccatggcgggaagccgggaaggagaaggaagccaatcgagagatgtgatgtgtacgtgtgttgcaagctgcagcgcttcgttttgggtatatcaccgggaaagtattttctacacatggtacctaggtgtatacatgtaatttaaacagtcatataaaagttttataaaatttaataagataggctatgttaatataaaacactatacaaacatacaagtctaaatttaatcgacatacaaagaaaaaaaataacaaattttatctgcactgtacagggactagtcactgtctgattttattatttttgtttctttagttatagatcaaatttagtcatgcatgtttgtgtatagacttatatcatcacaattgatgttactattttttttttaattttttctataactatttgagtatactctacaaatctcgtcaacgagtatagcccgtcgacaataagcattaatcccaaattctataaagttatcaaaactgaaaatattataattgtgagacccaaactaagtacaaccggatattattaattacaaattttgaaatttattaaatcatggcaaacttataattaagacaccaatctgaatacaacttagtttttattgattcagaatttcagacttattgaaacatcgaaaagatacatgttaattaaggtcgaaatactaccatgaggatcgatagatatatatgctagcctacttagctagtgacgaaattaacatgcatgcaaaataaatatacacatgtgctcgtctacttaagctagacatatattcatacagttggtaattaatggtacagtttatataacttcatcttcttcctcggtctcgatcgatcaggcttcgagttcgccgatcacgtattcgacggcgtcgcggatcaggcggagcaaaccggcggcatcatccgccggcgccggcggccggagcgggggatccgtgcttgttcggagacgtggagacgtgataggcggcttgtttccctgcggcgacggcggagcgatccccagcggcggcttcccgtcgtcgtcggagagcggcttcgtcgacccacccggctgaggcgacggcggagtattggtcggcgccctcccccccgacacgccgccgtcgaccccggccagcggcgtcaccggccgatttgactgaggcggcggcggcgccccgccggatcgtcccagctgtcccggcacatccagtcccggcgaggcggcggccacggcctcgccgtcgtcggtcggcagcattataaccggcggcgacgactccagcagacgatgtccatgtccgagcgcgagcggccgagcttggagcagcggaggagcgagcaggacgacgtgaagcatcagcatcggcagcagcttgcaaatgcagggagatcgagacgaactctccatggcgggaatgaaggagatcagaaggaagctgatcgattcgatcgatggatcgagagatgtatgcatgtgtgttgcaagatgcagcgctcgcggcgagctctttacataggtagggtttaattgcgtacggcgcttgtacttgtcgacaatgtgtgtggcgattggtgagtcaacggttttgttagttaggctgtgtttagatcgttgtaaagtttggaaaaggactgaaattggagatgatgtgactgaaaagttgtgtgtgtatgacaggttgatgtgatggaaaatgactgaagtttggatccaaactttggatctaaacacagccttagtattgctgaaccatcaaaaaatatatatttaatttggatcaactagtcgtcgttaatgtttagtactccctgtaccataatatatataccataatatgagagattttgagtttttacttgcaacgtttgaccacttgtcttatttaaaaaaatttaaaattattatttattttattcgtgacttactttattatctacagtactttaagcacaacttttcgttttttatatttgcaaaataaaattgaataagacgagtggtgaaacgtagtatggaaaaactcaaaatccgggacggagg

SEQ ID NO: 38104 - DNA, 8221 bp, Oryza sativa
gtctgtttgagggagcttaagattctgagaaacagctggctggttgccagcttctaagaatctgaaaaaactgggtttcccagcttctagctttttattttctggattctacaactacagcttcttataatttagaccaaaagctagactgtttaggggagcttctgattctgggagaagctgcagtagctaaaaactcccccaaacaggccctaagaataagtagaatttagcttgtttttcgtattctcacccgatggctctcaaatttcccaaacaaaacggcattccaatcacacgaatggcagtgactaccttgtaacatcaaggttacaacaaataactaaacgtctaaaccgtgtatactgccgggcttgggggacgctgtcgcggtgcaggttggccatcatcgtgtcctgccaacggcggagcaacagcaaccggccgccacatcggcggcggcgcgccacctccgccgtgttgatgcggcgctgggtgcttcggcgacggcgggatgtacggcgacggcctcaccagcgcaccaccgtcatccgtgctgacgctgctccgccacgccgacgcacgaagatgtggatgggaggagtaggcttctcctgaagcgacaaaaacagcaggagaaatttcgtcagtgaagaacagacagacaaattagctatcaaaccatttgttatacgtagtatttttcacatggtcaatgcgtgatgcgtttggtcagtgaatgacaaattactagctaccaaatgcactcctctctctctcttttttcacatgatgcatgcgagtgaaagcgtctatgttgcctacctagcatccgtgcttgcaacggctgagcgaagaggaggtagcagaggagaaggagaagactatgagacggtgatctatccatgatcgatagatgcaggagcaagctgaagcttgctgcagatcaatcggtacacggatggagaaaggttttgggaacacggtcagtatatatagcggctagaaaccactgaccttgtgtagttgacgagttgtcgaggtttcgagcattatacactagcaatctaccatgtgcacagtcgaaagatgctctctttttttttttgggcccaaagtgggctacctgctttgtttctcgatgcctgcttaactgtagaatagtaatgaagctagagtatcccctacctggctacctctaaatgataaaatctgagccaacagaactgcttcagtgcttggctatatcagattattgctcatctcgtgtcaagattctcagacttcaaatagattagagtgccaacatttcactagtcacaaattgcagattataattatgatatggcagtgacaatatgacattatatttgacaaaaccatgaagtcagtagcggtactagatcaaccactggataataaaacaagtctaggctctagaatcctataaatgtaacggaagattaccggcctctgccatgttccttcaggcattcttgaaaaatattcaggcgactgaaaccatagtacaaacaacaagcagcagagggacgtcaaaatctcaggtaacaatggagcaaagtttccagcaatttcaatcctcaatctttcgagttttcatgaagcaaaacatactcccggctgcaaaaaaaacaataaaacatttgtcagattttagatgaacggggttagtaaggaggcatatagaagcagaggctgatcatcattatattatatttacttttgggcaactagactcaaaagggccctaaatatggattagaaatagtaccatccatctaagaacaaaaagatgaggcttctgaaggatgaaaaccgtatgaactaggaaggggcactgtgtgcaaacttcaaaatctccacagctccgaacatatgttatacatttatacatgattgagcttgcaagtcaaggctccataaaggaaaattatgtttccataatgtagacattttgagattccttgatatttataaacattaatataccacctaaagattcatttggaaattgtattgagaaaaacaattaggcgtagtttacaaagatattacttagattattggagaaaaaatgtttatcccaagagtaccacaaatcaaaataaaagctctaattaaagagaatgccaaaagccagactgtcactttcataataagttgttaatttaagtcatcacataccaaagatacatatacattgagcaatatacaaataaacaaaaaagtgatgctttctttaattgatcatacctactattgccaaacttaatggtatccttttcaaagagttcataataacggctgggctcaatacgattctcctgaaaaaaaaatcaaaacataaatattgactgggtagaaaatattattagaaatgcgactagtgtatctgattagtagtaaaagtatcactggaggacttacattaatgaaagttccattggtactaccaagatccatcagataaggcctatcaaacaaagcagcaaaaaacatcataatctagactagcatacagaactaagataatcatgaattattagtacttgttattaaaaaaaatatatgcgttactagcaaggagtacctcacttgctttgacatcatgccatctggctgctccttctctacaagtctgaaaaggcaaagagatgagtgaatcacaatattatttctcaatctatactccttttaaaagggagcagtggtgatggtgagtggtgaatctgccaccaccccaccaccagctccctagtttttttggaatagaaaaggggggcctacatgtcaaccacccctaccaccaacttcctactttttgtgagaagaaaataggacagtgcacatgtcagtaacaaatatatacataaattaaggggcgatatacacagaaaatgatgataataatgagttaatgataattttctttatttaaaatcctgttgccacgcacaggcaatatgctagtaaaggcaaaaaacaataagattgctatgcttacctatattgaagaactgcatgttgcttactgcaggagggatgatctgtggggatgtctgcaactttccgttcccttccaaaaaggtagctgctcatccggtgaacatataatggttctgttcaatcaagatagcatcacaagacacagtcaaacaagaagagcaaaactgaagtatttaatcactaatgtaagcacgtgaatttttttaccaccgtacacatttaatttataccactataatgcccaacctttaacttgctgttcatcacaataaacttcattacttcagttatttcacttccgttcaaaactaaaactagtgagctatccatacaataccaatgctcaaacagtatcattggatatattcacaagccagtgtatcgtaaggaactgaacaatagcaaagcactaggcaggcttcattattacaaaccaatggtcctgtgtttgatccatcgattgaacaaaggttctctttcctttccccagggctagacaactaagccacagataagggcatgtttagttctcaaagcatgtgaacaccttttatgagatctagacctccactctagttaggcacgtgcacacacgcatgcatttaacttgggtggctgtgccgtgtacacatatcgaccttactctagaaaagaaagagcccttttactccccggggaaaatgtaaataatgatactgattcaatgcaagctcatatcatagtgacccactcgttagtgcctttgctcacgttaaatggttcgttccaaaactctccgaaattaagctagttcgaaaatgtttttatgttccatactcgcttcatcacagtcagttaagcttactgcttttaacagaacctacttttggtttggccatgttgggaagggaaatagagaaacagctgttgaactagacaagaacatgcctctacagactggcaaatccaaaaaatgtttttttcttctatttattagaactattaactggaacagatagcatgacaaaaggaaaaaagttagcttcatatatagagtaacaagtcaagaataactaccttcgagtggttcaccacccttgaagacgtagagtctccatctaatatctgacttgcgagcctctggaggttctgaatgcaacagatttacacctgaaatggaagtaaattgcaaactctgaggacaatgcaatacagcaaagaacaaggaattacaaattctcattggtggttaaacaaacattaatgtaaagtgtaacatttaggttcatgaccaaaaagaaagatatagggcttcaaaacagcacctgcaactctgttagtctcctcagcaagctttccagacaattcaaatgatggtttttgctgcaaaacaccaatgaaattattaaaatactagtgtatgacaaatgaagagaaaggttaaataaaaagaaagctgacatggcaagtattttgtatctgcgaaaacagcaagcatcatataaataaactgtacacaacaaaaggaagattgttattattttaaatttcatcatggagtatgccctaccttttcttttgcttccagagcttctgcagtagcattcatcttcaccaaagaatcaggatcaacactcctggccaaaatagtatcaaatataatattttcagttctaaaatttcaggtacaaaaacattgcgctcatgtagctggtcaaatatacatttgtttgttttaggtactactgctacagttgcttaacggatatgctgatatgcatcaaaagttcaaaaccattccagcaagagggtatgacacccataacacgcgtagccccattgatacaacaagaaaacaattgcaagcaatgcttctactaaaaatttacaattcgtattgaatatagagttttgcatgcttaccgtgacgctgcatctgttacagagcttgtatcctgaaataaatcaaaacaaagtttaggttgcaactaacgggccatatatgatagcaaacatgaaaagaaaccaaattggtatgaaatgaaaaggatagcgggcaactaattatatcctctagaatctgaactctgaagcaagaagggtttacatggaatacagacccacaagtttagtgtcaacaatgctgataacaaggcgtactccctctgtactcgtaaaggaagtcgttttggacagcgacacggtctccaaaacataactttgacttcttgtttctataaaaatatttaatgaaaagtgatatatgtatacttttataaaagtatttttcaagacaaatctattcgtataatttttacattttcaaactcaacttgagagttattcatgatttatattcccaaggtttgacttaaacattgtcctaaactacttcctttacaagtacggaggtagtaattttttttcacttctattcatttgggtgcaggttatcagacaaagaacagaaacaagggacaatcatgaaacaaaagaacacactacgccaactaacaggtggatatgtataagaaaagggtcagatatcattacacacctcaccatgtgctgcacttctagatgacctcggtgactggcgggattcacgtctacccctatgcctatgctcttctggagacactgatcgcccacgcctagatgatctccctgattcaccattgctctcatcccggtctgcccttctctctcttgcagaatcccttctatcatcatgatctgccctttgctccctggaattgacttttcgatcatccccatcagaccttctaccccttgaatcacgcctttcatcatctcggcttgaccatgtctcccttgaagcacccgaccgatcagaccttctatctcttgagtgatccctatcatcatcatgatccagtttcctgtccttaaaagagcccctactatcctccctctcagtctttctatcccttgacacatcctttccctcatcacgctccctgtacctccccgagtcccgctcttccctgctggtggtcttccgacggtcaccctcagtagcatctgcaccttcccgctcactctgagcccttctcaatcgtttgctccgtggtgagggcgaccgagactcccgtttcctggcaggtgacggagaccgtgaccgtgactgagcttgtttcggcgacctgacctgctccttcaccctatctctctgtggcgacctcccaatactcctaacaggagacctcctaggtgagccattcctccgaacaggcgacctctccctatgtgagctagtagtcttaacaggagacctcctcctaggcgagcgactcctcggagccggtgacctctccctccgagcaggcgggctccgcctgcgcggcggcgagccacggtccctcgccggcgagcgcgacctcgagcgccccgacctccgcgaatgctccctccgctccaccgccgaagccattccccacctggagcagcatcacccccaaaccaaaccgattcagaacagcactacgaagaaaaatcgcggaatcgctagggttttgtgcggcctcagtccgaggagccgccaaaaaaaaaaagagggagggagggagggaggaaggggagcgtaccgggtgcggcggaagcggatgcggagtcgtcggcggcgaggttatcgccggtggcgaccggccagcggcgaccgcgaaccgagggtttcttctctgtgagggctcggcttcagagaacaatccggaaccggaggcggagtccgggaaggctgtacaatatcaagacgaccgcgaaagcccaatagagagcccaagttgctaagcgacggcggcccagttagatgagggcccatatggaagactctgtggtggcccatagggaataagttcatctagggtcccttaacttgtcaaggaatccgattttcgtccttcaaccgtaaaaccagatactatgggtccctgaactatcaaaaccgatgcatattaggtccctcggcggtttcgatggtggttttggctgacgtggcacctacgtggctaatttgactcgatcacgatctgacgtggcactgatgtggcaatttgatccggaaaaataataaattccgtgggacctaaatatcagtttcacacacaaattaataaaagaatggcggggtccacgtgaccccacatgtcagtcaaaatcacccctcctcttctgcttccggcttgccgctcgccgcgacgacgacgacgaccgtggatgcggcgccggcgctggcctcgacgtccttgctggccggcgtcgtcgtcgtcgacgacgactcgtcggaggacgaggtgccgtcgacgtacatcccgatggcggccttcctgacctcgagcacgaacagcagcagtgtgagccagacgatggcctagaagacggagagctggacaacgagctgctgcgccccctcaccgtacatggaaggccgtgaagatcgagagggcaacggccatgaaccaccagctccaccgctgctttgtatccacgagcaccggcaccaattgcgggtcccacgccagccgccgggtctgctcctccgcctgccggcacgcgtcgttgtcgggcatcaggaactggatcagcaggaggtccagcgactgcgccgtccctccctgttgccagcggcagcttcctcctccctttaccttgctgcaatcgcccggcaccggcggcgggggtgagcaggcagcaaccacccgccggcgctacccgcctccgcgccgtctcgccgtcaccgacaccgcccgcgccggcggaggcgttcgggtccgatgccctcaaggagactttctccgttgacgtggtggcggccgaggcgcggccgctgaacgtgcccctggccgcgcccttcaccatcgcgtcgtcgcggctggagaccgtgtcctacgtcgccgttcgggtggagctccgcagcggcgcggtcgagtggggggaggcgcctgtgctgccctccgtcaccgccgaggaccagcccggccgcctttggtgcccatcccatccgcatctggcgcaagagagatgaagagaggggagctggggagaggaggaagatgggaaggggtgagttagcctgacatgtggggcccacatgggtcccattgttttttattcttttgtgtgaaactgacacgtgggtcccataggttttattttttttctggatcaaattgccacgtaagcgccacgtcaatgc

SEQ ID NO: 38105 - DNA, 5796 bp, Oryza sativa
catcagatgaagaccgagttaaactagccacgtagacgccacgtcagccaaaaccgccatcgaaaccgccgagggacctaatccgcaccggttttgatagttcagggacccattgtacctggttttatggttgaaggatgaaaatcggattcgttgacaagttaagggacctaagatgaacttattcccacccccataattttgaagaggaaaaagttcactttgggtccctctatttgtcgccccgtccgattttcgtcccttgaccgcaaaaccgggtactacccatcccccaacttacgaaaccgggcaaacaaggtccctcggtgattttggatgacgtggtgcctacgtggcttgtttgactaggtctccgtcccacgtgacattgacgtggcaattaaacctgaaaaataaataaaccttgtgggacccacatgtcagttttacacagaaattataaaaaaggtggggcccacgtgggcccacatgtcattctctcccccttttcctccaccccatgttccaccgcattctcgccgcccgcgcccaccgacgacacgaccccagccgccaccgcagcccggcgaccggtggcgccgcccacctccctgactcgccgtggccgctcggggtaaggcggttcccctgttgccgctcccgctcccgctcccgccgtgccgacgcaagagaggaccgcgcccgcccggctgtcgacaccccatcggtggaggaagtcggccaactgcagcagccacggcacccggcagctccgcccgcctcggcggcgctaccgcggacagcgacgcacctgacgacgacgccgcggccgctccccccaccgccgagtcaacgctcctctgcacacgctcgcctgcagagcgcgacgcccgtgggctcaacgactgcggcagccagggccacctcccaccaccccttcctctcctgccggccgccgcgcgccgagcaccactgcctctccaccgcgagagagaggggagaaagagagctgaagagagggagatgtggatagaggagaaagaaggtggggctgaggatgacatgtggggcccatgtgggccccacctttttattatctgacttgtgggccccgctattttaaaattatttttttgtgtgtagctgataggtgggcccatggtttttattattttttcaagatataattgccacgtaagcgccacgtcaaatgccacgtgggacagagaactagtcaaacaagtcatgtaggtgccacatcagccaaaaccgcctttaaaaccgcagagggacctcgtttgcccagttttcgtaagttgggggacgggtcgtatccggttttgcggtcaagggacgaaaatcggaccgggcgacaaatagagggacccaaagtgaacttattccttttgaagagaaaatccaagaaatgacaagcaccaaatttcaaaaaaaataccatcaataaatacgagttctatgaaatatcatcgtacaagtgaattcgtcctagaaatgtcatcaccgttaaggttccgttagcagtccatcctgcagcattagatgtgttgtttatcctatagcatttaacgggaggctactaacagaatcttaatggctatagcatttctaggataatcctcttgtacgatgatattttatggaacatacactcatatatcgtatttcttggatttggttgattgtcggtggtatttcttggattttctcaaccacaaactagtccagcccaacacttttggcagtgcctctccttttttttttcttttccttttttgcgggtaatgcaacttttcattttatttcactagggaaaggaagaatttgagacacttaacccgtcagatacactgttctttttggactatggaacgtggggacttcataagaaatgtttttttcaaaacagtcaaaattcattatggattattgagtctacatcttatgttaaatatatataatgaaatcagtttatactgtaattgtcaatcactaccagaactcaccatcaccatgtcccctactgttttttctgctagggaacagcctgaaactagtagggaaacagtttccctacactttttcgtagggaaaccttccatgggaacatattcgtggggaaataaaagtgccctacgatttcagctataaaagctagattcctaggatatgaaatggtagggaacattgcttacatggcatttgtgatccacattacatggcatttgtgatccacatgtaaagtgacttcccctatgtttctaaaactgtagggactttttatttaatatatttctcctagctgtgccatcacacaattatttccttttaaaatgttcaaatagtagggatatttttatatgcaatatatatctgaatattgcaccaaataggcgattcactcaaattaaaaataattaaataggtaatatatatcactaatcttacaaaccaaatcaacacgagctctcacaaatcttccatgaataatcattacttagataagcataaagatcactgagacactaatagaatcagttacatagttacataggccgtgtttagttcgcgccaaatttagaagtttagttgaaattgaaacgatgtgatggaaaagttagaagtttgtctgtatagaaaagttttgatgtgatgaaaaagttggaagttcgaagaaaaactttgaaactaaacacggcctatagtgaatcacaaggtttggcaaaaggtttgcaagcagtaaacacaagattccagatttgcccatatttaatgctgccttaatgccaatcacacagacaaccatcacatgtattcaggtcacaaaacatgatggtcaatcccacagctgctgttgcttcacaaaatacaatcatccagatgcagagggagggctggcagtgaacctagtgcttcggcttctgctgttgctgttggtgctcccatacaacaacaagaacatggcatacataatcacagcaaaaaagtgaaaccacaattattcatgcaataggaaccgaaaaaatgttctcaaacatacacagcagtcgcaagcattacagtacataaccatgtttgtgctttacaaacaactttcaagaacggttaaccaaacaaagtgcaatggaatcatgaaatgcattcatcggatcgcaatcatcaaacacttcttctgtctcaggctgatcggcagtagcttgtgagggcacatagttctcatcacggtcacaacgatcaaagtgcttatcccgtatgccactaaccctaatgaagttatggagagcacagcatgcaactatgattttggcctgtttattaggagcataactagagacctttttccaacatgcgccacttcattttcaaaactccaaatgatctttcaatgacattcctaagagatgagtgtgcatagttgaatttttcttccttaccttgaggttcagggctgtctcgatactcctgtagatgatatttggttcccttgtaaggtgcaaggtaacctggccggttagggtagccggagtccacaaggtaatactttcctacagcaagaaacatcagttagtgccacattctacaactaacaaatcaaaatgaagtacaatgcaacactatacctgtaggaggatgtggaaacacatggttgtatgttgagtgtgcatcatcaaatactctcatgtcatgtaccgaaccaggcccatccagatagtacaaatgtaaacctcatgtcgaagtcacatgcagccatgacattttgtgtggtcatgcccttgcggcacaagtactgcatgaacttgttgtttggcaccacgcaagggacatgagtcccatctatagcccctatgcaatccttgaagtagggatagaacctacggttcctcagtcttgggtgcattgttctgaattgcgggtccacaggctttatgacatcaacagcaagcttgaccacagactgcaacactttgttaaacaagctacttacagtccccatggacctctcaaatctgtcctcagcttgcctaactgattgtggggtgccaaccatccaaagaaacatcgcaagagcttctaccgaggtggatttgctactagattttaggccataggactgaaccaataggtcatgcaggaggaggaacatagttggactcattctaaacatgttataacatgcctttctatccccaagcttattatgtacccattacaacccagtcaaggcaggttgcctatactcactctagtcaaatgcttgtcaatgtggatggcatactgaaacataacgtggaagaaaccttcgtcatcatcgtccaacaagtccaacatcatcttgtttaagtcttcatccatgcgctgtcttcgagcacgacgattgtgggatgctgacaacgaccacgacgagaatgacgagaataacgacgaccgcgacgagaatgatgacgacaacgactgccctgcatcctgtcaaagcaaacaatgagttatgttagtaaagaataacaaaacatttgcaaataaatctcagccatgcagcacatagttcaaatcagcaatgtattaaaagtgcatcacacttagtaccataacaatgttcatataacagacatcacaaccatagtacacacatacataatcatacacaggattgaacaaacagacaataatacatgaacttaaaattaatgacacaacagaacatgagatggactagttgtcgacctcaacatatttcttgatgatgagcatccttcctgctggacaggtgtgaatgaatgcatccatcgcgctaccattctgggtaatgttgaccacgcccatgaacagctttgggcttccttctggagtgaccccacactccggccatctcgagtacctttttaatcttcatctcatgagcgttggcttgagcttcggcggctatcatatgggcttccgcggctctcctttcggcttcggcggctttccgtttggcttcggcgacatcctgcataacttgcaacatggattgcattaggctgattttgctcctttgaaggtcattgtactccctcatgttgctaaccattgccctcactgctggactcttggactttttacttggactcgtccttttgttgccaacactaagaggggtcagctcgtcctcttgctcatcaccatccgcttcgtcagagctatcacactctataggctcctcggcagtggccacaaacgatgcggaaccatccacagcaacaccctcaaacattcggtccatttcaggcaaatattccggcaagcctggcctaaacttcttccaatcagaatgtccctgcacaaagaagtcatatggcatgaagtcctgaaacaaatcaaatacaaagtttaggttgcaacttacgggccacatatgatagcaaacatgaaaagaaaccacattagtatgaaatgaaaaggatagcgggtaactaattatatcctctagaatctgaactctgaagcaagaagggtttacatggaatacagacccacaagtttagtgtcaacaatgctgataacaaggcataatttttttcactttctattcatttgggtgcaggttatcagacaaagaacagcaacaagggacaaacatgaaacaaaagaacatagtatgccaactaacaggtggatatgtataagaaaagggtcagatatcattacacacctcaccacgtgctgcacttctagatgacctcggtgactggtgggattgggattcatgtctacccctatgcctatgctcttctggagaca

SEQ ID NO: 38106 - DNA, 1216 bp, Oryza sativa
accttctatctcttgagtgatcccaatcatcatcgcaatccagtttcctgtccttaaaagagccctcctccctctcagcctttctatcccttgacacatcctttccctcatcacgctccctggtggtcttccggcggtcaccctcagtagcatctgcaccttcccgctcactctgagcccttctcagccgtttgctctgcggcgatggcgaccaagactcccgtttcctggcaggtgacggagaccgtgaccatgactgtttcggtgacctgacctgctccttcaccctatctctttgtggcgacctcccaatactcctaacaggagacctcctaggtgagccattcctccgaacaggcgacctctccctatgtgagctagtagacttaacaggagacctcctcctaggcgaccgactcctcgcagccggcgacctctccctcctgcgcggcggcgagccccggtccctcgccggcgagcgcgacctcgagcgccccgacctccgggaatgctccctccgctccaccgccgaagccattccccacctggagcagcatcacccccaaaccaaaccgattcagaacagcactacgaagaaaaatcgcggaatcgctagggttttgtgcggcctcagtccgaggagccgccaaaaaaaagagagagggagggaggaaggggagcgtaccgggtgcggcggactgcggcggaagcggatgcggagtcgtcggcggcgaggttatcgccggtggcggccggccagccgcgccggcgaagcggcgaagcgagggtttcttctctatctgtgagggctcggcttcgcagagcaatccggaaccggagtcagcgaaggctctacaatatcaaggcgacgcgaaagcccaatagagagcccaagttgctaagagacggtggcccagttagatgagagcccatatgggagattctgtggtggcacattttactagcgtcaccacataattttgtagagaaaaatccaagaaaaaccattgacaaacacccaaatctaaaggaatgtcatcgacgagtgcaagtttaataaaatatcatcgtacaaatgattttgtcccaaaaatactatcgtcgttagggttccgtccatcctgtgacgttaaatgtattgtttatcctatatcactaaaggaaagctgctaacagatccctagcggcgataccatttttgtgacaaatacgctta

SEQ ID NO: 38107 - DNA, 635 bp, Oryza sativa
cctgctttcagtgtcaagcaaacgacggctcaaataagccacaacatactccttcccatcgtcttcttgcgtcaagaccgcaccgatcaccctttgttgtgcaacaacatataatctgaacggcacaccggacttgggcgcccgaagcaccggaggactcaacaaatatcgtttaatgttattaaaagcctcccactgttctgcccccagctaaattcgttttcatgtttcaaccgaagcaaaggaacaaacgattcaatctttccagcaaggttagagatgaatcgtctcaagtaactaattttccctagcaacttctgcacatctctcttgcatgtcggctcttttaactttttaattgactctacctttttaggatctatctctatgccctgctcatgaattataaagcctaaaaacttaccagccgacacgccaaaagcacatttgagaggattcatttttaatctataccggcgcattctttgaaaagccagtcgtaaatcggccaaatgactatcaaacccgtccgatttaacaaccacatcatctatatatacttctacaacaatgcctaacaaatcatgaaaaattaaattcatagcacgttgatatgtagcgccggcattctttaa

SEQ ID NO: 38108 - DNA, 2169 bp, Oryza sativa
  unsure (1)..(2169): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgaggtctggaattttggcgaaacctgttttcgatgattgaataatttgaaaattttcccttgagggtaatagccctatgtcatgctcagtttgtatatacttgaacatatataatacaatatttggatggggagctcttgtctagacctaatagactatcttgctggggtcaacaatcagggtgttttcgtaaagctctcatggtcattaacgaaataaaattatatattcaaccgaaggacttcaacttctatgcaacacttgtccaacatgaatatcaaagaagacaacttctcttctctaatctgctttcttcttcatctgcttgattgctcggcaagggcgcaaggcataactagagcctaaccagcttggtcccgtggtgagcagcatcattctcatggacggatgccgggagagtgtgaggttgagactgtgctaagctgctgctattgattattgattatcagtaagggagattgaaagtaacagaagcaataactaaccattctaacagttcaccattagtcaccatctaattgtatcctagcaggcgttcctggaagtggcctgacattggcaggtgccaccacatccacggtggtcatgtctagctctgtcttgccgagcggaggaagaatatattgggggattagagagaagagagaggttgcctactttgatattcgtattggtcacatgtagcacaggggggcaaagcccttcagatgaaggaaggacttcagtcatgtataattttctattgtcattaactcaagttcttgtgagttgtttggcttgattggcttgactcacatggccttgtggcctctctatatttctatcattgtgcttccccatatttgttttgtttcataaattaatttgttcacgtcacattatatacagttgtatagcattacattttcccatagtagtgctgtcaaagttacgcgatttccctgtatccaccaatagacttcacagataacaatctaaaacaggttgtcaatactagtaccaccaaaataagcacgaaataaatatattttgataagtggaaataaatccagcaaaatgccaggttgtactttgtttctactatagctcctagtgggaacgcgttcgtccaactctcctatatatcacaacaccatggacatcaaattcgcactaatcctcccccttcatcccgtgtcacaaagccacaaagaagtttagcaggtcctccatggcagcctctctgccactgtcagctgccatcgttggagccgaagagtcggttgacaaggaggtcttggagatggagtacctctttgagaagtttttgatgccaagtgacttgtgcagcaatactgaatggcttgggatcccagaagaacatgttaggaaatttggcatgatgttggaggacagggacggttactccgtcattttctttcaggacggtgtggtgcctgggaagttgtggtgctttaggtactggaaaagcaatggagtccatggcttgaccaagggctggaggtgctttgttagggagaagggcctcaaagccggagacaccatctccttcttccgaggatctgcatgtggccgtctcttcatctgctgcaggttaggcacccatgcaacctttgcgtcatcctccaccttgcatcatggcttttctatgcccccaccacctgcccgcccgctggtgggtcttcaatctggcatgttggcaagagatgtcccatcattaggacaagctaggttgcatgatggaaatcaagatggaggcggtgcaccatcaagacatgttccatcctcaggacgacgtgtggaggcacagctatcacgtgtgtcgtcgcgccgtcaacgccgtactatgaagcactcgataccagagcccacgatagagacgccaccaattcttgagtcgatg

SEQ ID NO: 38109 - DNA, 5647 bp, Oryza sativa
atcattgctccttatgatttaatgttgtttgatatttgtgcacacagatacaaagtgtatgactacatggtggtggcttccccaaactagataacaatatataaatctatttgaactccaacttcttgtcccgtggtacccttgcctatcccaccaagcgatgccgcttaactctttctagtaatcacgcactttctaactactacaagaacagaaccatgggtcactaccacaaaacatctaaggtttccattttacaccacctataaacatacttataaacataaaaggaaatcaactgtttataattaggggtacaacctatcgtccaaataaagaatagtcaagcgttttggtcggttccctaagaactatttcatcaatggaaaaatgaagtgtgaggtgattcaatatcaggtgaactgctggtcaagaggagtggaatgacatgtgggatcacaaatatggaatgaggcaacaacgctggatggtatggtgtgttcgccatacaaaaacgatgtctaaactgtattatatgacaaaaaaaaaacttggtctttaagaattatcataccgttgggttcattccattcaatgtcaaatggaaaattactcaatagctcatatggtttaatgccaaaaaaaaattggcaggctgttggtatttcttacgatcacagataaatccgcaagcgcacgaaacaccgttgtagtacttccccttagagtattccaaccgtatcgaacacgaggaacatgtgtgtattatctactgccaagattcgattgaaggacaacaacccaagataaattagctagagaggattcctatgtcttttagttagttacttaagttacttaaaggtaagactctaacaaatattcgggaaccggccctcccctggtctactaggataagtccgggcttgagctctatgatgtacctgaacgtggatgaatacagaggataaacttggctgtcaccacctgccccctacctcactttccgtgggcacacaacaaacgaaggtaatttctaacctagacaccacacctaagttattaattactactctagccttgcacgggaacttccttctttatccagagttctaatactagagcactcaagtgcacactaagcgatgaacccgcaccgataaaaatgtatcacttaaataaactaattaaataacataaagaaactcgaatacttaattaaataatggaagcatccgacaaggtacaagcgatagagcaaaggcgacaatcccgtcatctatcaaattgccaaaatttcagttgtcacgtcatctatcagatgggccatactagtatcagaaatttcctcagaaaactatgacaccacattatccattgtttaccttttattaccacaggattgtccattagttactctctctgttcctttatgttaatcaccaagcaatattcatattcaaacttccaccattcgtcttctttacagaaaaaatctaaatacttaaatagaccaaattaatacgacttaactagccatatagcagccttgtacttaggctgagtttgaaggagtatttgggcggaattttgtcctcatttaccttgagcacactttcaaaaatactaaatggtgtttttcatataaaaattgtctatataaaagtttgtttaagaaattatattaatacattttccaagtttgcatgtcacagctagcatttccattggcacgtctagcatgagaaggagcttaatcggggggaggtgcgcagtaaattcgccacattcaacagaaataggcaaatagctacgccatcaagagaatccgaaattaaacttctatgatcgtctggcatttgtgttctccttatttacgccctgccttaaaataattttcatgcatatcacgtacgctatctacagttgtccggcattaaggttttccacggtagtagtccaaaatcacgcatttttcctggagtcctgaagaggattatttacagttgacaatcgtgcatatgccaatgtgaatgactagtgctgccaaaataagagagaaatgaacatgtcctgataaataagtagtagataataagccagcagtaatctcacgattactagctccagcaaaatgccaggcttgcactccatatttgcactgtagcctccagtgggaatgcatttcattcctaaaccccaattaaaaaaaaaaaaaaaaggtgcttggacctcccctatatatgtgcccgtaccatgggcctcaaacacttgacctgctccttcgatcgtccaatcctacgaaaccacagagagaatctcagagcggagtactccgatccatggcggcttctccgccactgcctacttccatcgatggtggtcaagtgctagatgacatggaggtcgtggagatgaagtacctgtttggcaaggtcctgatgccaagcgacgtgtcctgggacaccgaacagctcgtgatcccggacgagcacgtcgggaaactactggacatggtggtgatgaaccggccggaagggggcttcttcgtcgtcgtcgtcgaggatggcgaggtgactgggaagctgtggcttttcaggtactggaaacgcgacgacgtccactgcctcaccaagggctggggttgctacgccagggagaagggcctcagagccggagacaccgtctccttcttccacagcaccgcgtgcggtcgcttcttcatctgctgcaggtgcacctgcatgagtttcttgtcactacccacaacatcgcatcgcattcacggctcgtctgtactgccgcaaccgcgggctgcccaggaggcgcaccatccattctcaggacacgccacattgtgtctcggcaacaaagctagtgatcacagcgcgccggcaaggcatgccactgcctccttagggtgtgcggcggcgcagcctccgcaggtgccgccgacgccgacgccgcgtcgtcgacggcgcagtatgatggttcacccagaaccaccggagcacacaacggacggcatgcctgtgattctcgagtcgatggcactcgtatccaccccgcccgtggcgaaacgcgtgcgcctttttggagtctacatcgacgttcctccactgcgcccaggcggcgaggcaacacaagatttcaacccatgatgatggcgtgccatccgtggacaggaacgccctcaagaggaggcgagctgctgcggacaattaacgcctcctgatcgaattgtatcgtttagattgcaagttctgcgtcattctcgcggctttgattattgaattcttaatttgttaggactttggctcctgaacaattctttggtgaatattatgttttttggcaacatgtatggcagcagaaatgtttttcatcatcttttatattaaaattttgtttcattcttccatgcaggtcaatggtgttcaaatactttaactttcccaatttccatttccaaatcagtagcttctttttaaaaaaaaaaactaaaacactaatttcttggtcatataagtataatcctttcatgaaacccgataattattacaattagctgcccaattagtgcattccgttcgagatatgaacaaattcaaggttttcttttcacatttctacattattgcaattgaatcgattcatacagacataatgttgttcggtattcgttcatatacacacaaagacgatgttttcctgtatatatgtcatggtatttccattccggatacatggtgatgggtcccccacgtaacagtgaatctagctagtacaactccaagtgataaggcaccatttcattcgacttagctgatctactctcttgttttcagtttcttgtgagcacactcttcgaagtgctaaatgttgtatttgttttaaaaactttcttttgtagaagtttctttctaaaaaaataaaataaaatatttatttaaatttataatacttaattaatcatgtactaaggatatgctttgtttcacgtgtggctgattaggcagcctatataactctgccaaactcgacctaatctacttgtcttgcttgtcccgtgaagagaatctctctagctctttctaattcatatactcctcccgtcctaaaatataataacttttagccattaaaatttttcccaaaatataataatttctccactaacattctctttctaaccaatcacaaccctccaccattcacttttcctaactacctccactactcaaccaatcacaaccctctatcattcatttctacctactttcttgataaccgtgtccacctctaaaaatacttatattatggaacggaggaacgtagtagtatttatgcccttcctaatttgtggtgatgaaggccatgggcataggcggccctaccagatcaaccggccttgtgactcgtgccactggaagacaaccattaaagaggagcagatgggcaaccagccatccatcttgtaggtgcagccaatgtgaacgtgtcccgatagcccagcagcccattaggccccatctacagttctacactctctccaccttatctctagtcttcctagcgttatattgagcgcgaactacggaatgagcggcccttcggctttggcgatgggagcaggagtgggctacacgttgacgatggcatcgcaacgacggcctctccccggtgagctccctccgctctccctccagtgcgaagtctagatcgaggtcagcttcgattccttgcctcctctgccactggcgcaaccccgcccggtcggcctccacccactccccttcgtcttgctttgcccccgccaccaccagctatcgatcctacaactccggcggcgccaccgccgcctcgccacctgcctttgtccgcctcccaccaacggttcatcacctcataggccatccccctaaacccgatgccccacttcccccttcccattgccaccctcctctcacttgatcaagacatggtcccgatctcccggtaggtatcaataagtcgattgaggataactcaacgcgggtgatctaaaggctccgacctgaattattgaacccctcataatcactacaccactgctctgttggttatcaattgtgccgaaacacattagaacccaccaagaaggctatttcctagcgaatcaatagtacaagcaagagggttgcagaagtaatctgaatattacaaatatacgatgaatctcccaagtttgtgttccacaaaccgaactagtggcaaaattggatttcgcaaaataatgtcagcaaaatccgacatgagaacggctattgaataaatatgattaaaaacatcctagggttagccttaagtccaaaaattgtttcgaactagataaggtacgtggattgcgtttacaattctggacaactcggaaggaattttgacatgaggcaaataatgtatgaaagtggactcataagttctataacaaatacacataggctctaagagaacttctggatcagcagatatgtatgtttaaagttgatattgtcagaagacccgaactcacgaacaaaatttatctcttgtctattatagttaaaaaatgatgatgaagcatgagaggagaatagggcaaggcctgatgttggtccccgatccacct

SEQ ID NO: 38110 - DNA, 10093 bp, Oryza sativa
caaccctatcctcgaatccaaacccgagcgcttatcgtgccaccatcggaatgtatttgcgagaatcccatcacgcacatgttcacaaattaagttttacatcatgtcgtactttactcttgatgcttttctataaataccctgctagagtggaggaaatcgtgatgatgtgaaccaccaacttgtccatccactggcaccgatcaatgatcatctactagtcagtttgaaggatgccaactgatgaaacccgttacaaaagaaaaaaagaaagaccataattttcaaaaaaaaaaaacaaagaaagaccatgctcagccttgggtacctgatctaaaggaaaaattaggcgcccattatccattgttgggcacacgctctctgctaggagcatgtttggttgcttgactacactcagcctagtgcaggcaactaaacaggcatgccccctctttgtttctctatgctacaatttaaaaggacactacttgtgtagttagctagtttctcatcttgtatcttcctcactttaaatggtttttctcccaaaccacctatcctatttacgatctaattataataaatatttgttttgatttaatatttataataagatcaaacacgactatattctgataaaaaatatatgttttaactgttaaaatttgatgcttcatttataagaaacaaatgttttaactagaatttaattatgttgcacatttaagttttttgttacaagaattttttcaatgttgcacatggtattgttttaatgtgtcatttaatgtttacaaatataacagatttgtatttttttaattgtttcagcaaatagattggaatgtatcaatatttacaactccatgtttcacgtatgatataaaaaaatgtttcaattaggaatatattatcacatatatttttttcatcagaaatataatcatgtaaaatcttgttgtaaaggtttagttacaatgaattcaacggtgcaattagattgtatatcgaataaattatttaggagaaaaaattatttaaaatttgataaagaaagttgttttttgttgagagaaaattgatgttgtgtagcacatcatgcatggaaaggttaaggtaacaatgagatgtttttttcttcgatatgttaaaatcgggcagggtactaagacaaattcatccaagaaccacatttggcacttttatcaggttagtatatgcccttcgatttattcgcagaaagaagggcttactggttcaaaccaaaatataagttaaaaggaccaatatccttctttgcttatatgaattgcagtcaagtaccgtagcagagattttctttacagtaaacaccacaatattacagcagcaaaatatggatttccaaattctttgctaggacaattagtttggtgctacaacaaaaactgctccagtagcgcaagctcgggagaacgagtaaatataacttgttatataacatacaaaaactgtataagtaattaaagaagcgcatatgaaccaacaatttaaagtctcaaggcagcaattgcttcaggcctgaagtcaatccgaagccctaacaccctcctaacctctgctggtgtcaaaagccatgtcagatgcccggcattgtcaccccagaaatccagtatctccgatacccgctcaaaattcagaattgttgacatctgggaaagtcttgagaacttgtctcggactggtctctgtgacatttccgagaaatggttgatcagggagcgtacctccttgtcgagctggagcccaccaagctggctgaacctcttctgcatcattatcacttcaagcctcttgacaatgaagtcgatgattaagtgcacaaaggaatcatagttgtttgatgtcatcacgggctggagccatgcaacattagtattaactgtaaggagaagcttctgcacccatggatcattcacctcattttctccatattcggcatcatccagctcataactgacagtggcaacagtgtccagaacaggacgaacacggggtgccacagatgccactaaatgctccagtccagaatgaaggatcttcttgaaggaagcactgatctcacctagctcagataaacaggatttgattttctctcggtcagcaggagcatgaaaagcctgttgaacaacaggaatagtcagtacagctgggttgtcaacacgaaaatactatgctacgaacaaagtgattttatcagataagagtgaaactattagttgtttttggtgtaattaaggtattttgaaagctcattgtaaagttttaatttgccagcaggtttctcccacattcctaattcatttttgacatgcgcatggtctccaatacatacatttgacaattaaactttctcaatgaatgttatcagcattataatatctacaaaattcctctttcaaatataatatggttggatttatcatgtgacatgtctgtgtgttcctcaccttatcatgtctattttgcagtaaaaccatgtgtcactaacttatttcagtcaatcaaatgcactacaattcagggttgtaagcacaaatgaaccaactaggtaacaagtaacatggagtccctaagtccatcgcaaacacagtaataagatgtgtgcatgatttatgttccatacttatttcatagctaagaaatttagaacgaagcactcagctagtcagcttccaatcaggtacgcagcatcccagctccacaaccccaacagggcagtcaaattcctccatggaatgaagcagctggaggtagccaagttttactagggagttcagtgcttcaatgaggcagtagcaatgcacttaaaatattgttggtgacgactggccacaagaccacgctgtggcaggccttgtgcaatgggtgtcaaaaatgttagacatcaaaacatgtttgttgctacaaatatgttatccttttgcaatttgttctctaaagtgttgcaattgcaactattccttctcaatgatacaatgttgcccagtagatattagctagactttttacatttgttgaaccaagggggcattttgctgcaattttgttatataaatgttgccgttcaatgatttagaggcacacagtaggatgcctaagactaaatcactcaggggacgatgcgacaggaacaacttccttcagacatttgtcaagtccttctagttccaatgtaggaaaaaagctaagaggaatcaaggtcaaccatgagcatcggatttaatcttctggaaataaaactatgactacatttcctacccatctgcaggcttgccaaaaaaaattactaccattttttccctttatttcatggttgtgcagaaagatgcactttccggtgacagcaggtcatttgttttcaggaagcagcagcatgtatttgacaaatctcttcaaaggcagcaaccattctgctaccctccaagcatgcaatcatcacatccaaatatattcaactagcttagggggtcactggtggaaacctgggagcgttggtttgcaaatgcatctgtatgacaacatgcatgcaacatttgatcgttttgggtcaatggtgagtgggtaagagcacagatacagttcttgctcttgaaaaggctccttagagacgtactagttcaaatagctgcatgctaacattgattttttgtggatgagtgagcacaatcactacaaaacattgtgcaggtgtgacagatgcagcaaactgtttcaatttccttagcaaaagttagcctggtaaagtgaacattataatttgacagatattatgtactagacaacaatgttgatcagatacataaaaataggttacaaattcaagtgaaccgtggagggagcgaacaaaatgaactgttattataatgaaaaagaaaaggtgagattgcacaatttgtagcttttatctccatccaacaggagatagatttagcaaatagcagtggaccgttattgaaaacaaattgcaccataattgtaggaagttcctaaagatttatctacaggttacagcatagctaaatatatcctaactaagagactatttattcaaggaagacacatataacccttttacatatgtgatgctgttttggtgccactcataaggtgtgacaacatgatattatcaactactttctagaggcttctttcactaaacaaattacaagaactggacaaaagcaccgatatcttaaattgtaataactgagagactacttgattaatcatgatatcttaaatcccaaatgaatgcaagttatgaagagaagaaaaggttaacactgacctctgaacagagctcctcaatctcatgacggagcttcaggacatactctgagctaacatccatgttgttcagcgcagttgcaatctcctcaccagtcttctgaacaccaacaccaccaagaaagagctttgcacccaagtttggttccctcatcctccattgcagtgcttcctggtactcattgctcagtaggctcgccgccccaccaagcactgcaaaaattgagtttatacttgcagtggatgctgctcttcggcagcaactctgcagtacgaagaacacatcatccaccattgatgttgtgagaccatcaggcactggttcatcaatccggatggctttccttacattctcaaccatgaagaattcttccaggatcacataaaacccagttaaatcctgcaccattttattgaagctaccattccggaaggacttcatcgcttgtggtcccagctcaggtttgacatctcgcaatccacgaatcttattcaccataaattcagtatagtcttcaccaagctgtgtcagtgacagaatctcctcaagatagagctcgacctccctggggtcaggcccttcattgccccctgcagcattggccacagaactcaccacagagaggaggttcttggtatatgagtttatatccgaggcaagacgtgcaagtttcctgtaatcagcatatcggcgcagtatctgtgtgccccgggaatcacactcctcctgcagctcaatgatggcataggcaacaccatcctcacctctgagttcacgaagcacagcatcattctcctcaacggccaggacaatgtccttgaagagacgggtaaggcagccaacaaaatcaggccgctctgaagtaggctgtgttgcagaggttaactcagctaggtgctcgaagtcggcacgagcgcgcagggcgacgaccttcttgaggtaggcgacatagacctgcaatccctcatcagcgagagcgaggagagggaagaggcggacgaggcggagaacggcgggatggttcagcgcgtccacagcatccgccagccttcggcgcgcgagcccctccagcctgcgcttgatgtccagaaggtcgcggcggaggtcgtcatcggtggggaaccgggcgtcgatggcgaggaagtcgtgcgcggcggtggcagcggccgtgagatcatccgccgccagagcacggcgtgcggcgtcgagcgcgcgggacctatcgagcgccgcctcggcgcgcgcgagggcggcctccgccctggagtgcgcggcgtcgaggtggcgcacgcgggaggagagcgcctcggccagcgcggcggtggaggaggaggagtccctgagcgcggcggcgtcggaggcggcgagcgagaggagcggcggggcggagcggagaagggaggcggcggcgcggtcgaggtcggggcggcgggcgaggagcgcgtcgaggcgggcgtcgagggcgcgctggtaggcgacgcactcgtggaggaggcgggtggcggcgccggcgtcggtgagggcgcggagggcgacgacggaggccgggtcgccgaagtcgagggacggggcggtgtcggtggaggcgtcggggggcagcgcggcatcggggcgtggggagcgcgggatgggcaaggggtaggacgccacagccatgccggccagccgcggcgccggggatcgccgagatctcggtgggtaattcgcgggatctgggtgctctcctctcggtgctctctactgtggcctgcctgtgggaggcctaggggggtagtttgccgggctgcgggtgaagggcatttctgcggggaaaattaatttgctttcgaatgtttcattgttaagcaaactgtttttatttaaatctaggttgcgagctattatattccacattgtgagagcatctctagcaggggtactaaacacagcccctaaagaaattttgagaggtaagacaaaaaaatttagatccaacaaagcccctactaaaggccctaaaataggaaggcctccaaattatcccctcaagcccccaggcctacgggccttctccctggcccctattccacgcgcgggagagaaatcccacagccgccgagccgcgcgctctttttttttcgcgcgaaaacttctgctagcgccgccgctaaatcctctcttccgcatgcgcaccgcctggatcagcgccgtcctctccaactggccaactccttcctcgccgcactcctccctggcggatcatctccctggccggcaacctcctccctggcggcctcctgccctaccggccacctccctgcccggcggcctcctccctggcgccctccctctcggctgccagcccgcccgacgccctcctccccggcagaccacctccacgtcctgcgcccttctccccgtccgacaatagtcgaaggtattttttttctttttccaattgatttatggatgcaattagataagacttgttctttggtgagatttagcttgccagggcgataaaatggatgtgtgtatttagaaatctatggttggagcaagtattttaatctgttcacttgttcagagataagcatgcaaaaatttatgttcttttcagatattagtaggggaaattaattggtgagaaagaatctggtggtgatcactttgttgtattttagtgatctaaaaaaaatcgataataccacaactcagtaggcagggggaatgataaattgggtcgagctaatatggttttgggcaaagctccttccctttctattactgaaaaaatgaatagttcttaatgcactctgtaaataaatagttcttccgtgcactgaaatatctagactacttacattgcacctgttctgcaacagtgcatatgcatgactttaagacactgtgccacctgaaatcttgtgatcgtattctagttatatgcaggttcttcgagcaggctgttacaaaaagagaaaaaaaaaagctgctctgggtgctatatggttttctttttaattcaattttgtagagctctaccataatctgttctaaattctaatgattggaaaaatttgctaccattatgcattctaccaacatatattagctagtatctgccatttttcctgagattgattagagaagttgttaatttatctacttattgcagtgactagattgtgatggcaagtgaatgtgattcctttgtgcgcacgatgtccgaagagacccatgttgaggcatattccttgccaatgcaaaatgaagaccttcatacttcaacaaatggtgcaaaaggaagagccaaaagatcaagcaactttaatcgtaaggaggacattcaactatgcatttcatggcaaagcattagctcggatcctattattggcaatgagcaaccagggaaggcatattggcaaaggattgcagagcactaccatgctaaccgtgattttgagtctgataggaatacattctctcttgagcaccgttggggtaacattcagaaggaagtaagcaagtttcagggctgctacgaacaaattgagcgtcgacatccaagtggcataccacatcaagagcttgtaagttaaattttttattcattattattaataacaatcttgtatgtatgtgaactagcacttgaattttgctataggttcttgaagccgaggcattgtactcatccaatgcaccaaagaatagggcatttcagtttaatcattgttggctcaagttgaggaattctccaaagtttcaaactctaaaatcccacaagaggccaaggtctaggaagtcttcgaccccaattgagagtgctggtgaagaagatgaagaaggtgatgatgctaggaagagtacaactcctgatttatcacagccaagtgctaaaaagagaccaatgggtaggaaggaagcaaaggagaagttgaagaatggaggagaagatggaccatacaaggaggcgatgaaagatttgcttgacgccaaagagaaagaagctaaagtgaaagaagagagatggaaggaaactaaggagattcaagagcacaagctcttatttgctgagcgtaagttagtgtgggatcaagaacagaagatcatgttttgtgatgtttccaccttggaaccagatgtgagaacatatgtgttggctatgagggcacaaattgcagcttcaaaggtggctgccctcaatggtggatttgatggtagtagtggctttggaggtgagtttggtggtggtaattgagaagtttgagcacttcgatggaataagttggatcatattggatgatccacatgtcctttgctagtaggatatgtcatttccacgattggttcttggagtccttttgtgttaatttttgcaattatctaagtgtcatttgctagtaggatatatattacttttagatttgttatttttatgatcgaaccattcattctttcttgtaggatgtgttatttttaaattatataatgcatctccgcaaaataaaaataatgcatcactgggttcacatagcatattgtggtgatatggagacagacaatgacatgttggtgagcaatttttgttttcattggtgaattataaatcttggttgcgtgttgttgtatatggcattgtgcctacaccatatttacatgtttgaaaattttgattttcgatttgaattgtggtgtttgaaattgtaaatttaactatggttaaattatgcgcgttagaaatatttatgtttaattattgtggtgttaaacatagtgtaaaaagggattgcatgctaaaataaaagagaaacaatagtaggggctaagaaataggggctattgctagagttggaggtattttttgggtccttgggagatgggggcagccctcatttaacttttaggggctttaaaataaggcctattgctggagatgctctaatgttatgaatatagaactaaccatctacgactccctgttaggatgtatgagtaatttttaaggcctcctttaaattatatgaataaagaaagcaaagaaatagaaaaaacgcagtattctaactagaatagaagtgttaaactgatgattgcaaaacatataaaaacacaggaatgaccgcttgattggaccgtaggaaaaacataagaatcggatgagagagatacactcaaagtaaattttccaagagctttgagctcttgctgagtttctttcaaaatctctataggattattcattccataggaatttcaaatgattagaaatgattcaatccgttaattaaaaggcatttatagaaatttttcctatagaattgaaatcatcccaaaattcctatatatttcctccaaatcaaagggaccctaagtgagtaccatttacaaccaactccctctatttcatattataagtcgtttgacctttttcttagtcaaaattctttagctttgaccaaatttataggaaacaaattagcaacatccacgacatgaaattaattttattaaatttaatattaaatatattttgataatatgtttgttttgtattggaaatattagtatgtttttctacaaacttggttaaactttaagaagtttgactaagaataaaatcaaacggcttataatacgaaacgaagggggtactcaaataaaaacagtttgcttaacacttactccctccatcccataaaaaccaacctataattgaatgggacattattgacggttattaagtactagtttcaaccgccaactagcacaactaataaa

SEQ ID NO: 38111 - DNA, 1039 bp, Oryza sativa
gattggaaaattaatgtggatgcatgaattatacgccaaagtgaaggagaaattaagccggcatgcaaagaaaaacacctccagtgaatcacgtgcaaccacacggatttaggggccctcaagtcagctcaaaccgactcaaagtgggaccaaacacccgggtaccttcataggggcccacatgtcagtccctcaccaaagttggtgagcagagtggttgaatgggttcggccgaaccaatcttggtgcacctgacacccatcttccacgtggcgactcctcagcgctccccaatgacggttatgcgcagttagcggcccctaactgccatacaaccgtcattacaaggctataaatagagcttctctccctcacatgcaacacacacctcatggagcaattcactctttcgctttatattctctatagtttttagtaggaattaagcttaggagtttcgatcctatagtcttcttggagttctggatatgtctctagtactctcttctttgtgtaagattatagtcgaattaatagtattatattctttatttatatatgctcatattttattttatataattctttattgagtatatttcctatgagtagtatatactttgtatatttgtttcatcctaggctagttgatccatgctaaagtaacggtccaatgaccttcataggttgctctagctctaacttgttcatcccctagggaagatagtgatattgtttactagcataaacgtggtgtttaggctagataaatatcgttggatgtgggtgtatcccacggaaagtgaggtaggcggcaagtggtgatagccatgtccatcctttgtattcctccatgttcgggtatgacataagagtgcataaatgccataactacgttggcaaactagcagtgagtggtttctctatagtcctgggcgcctggaactatatcctacattgtaagtatgtatatgttaagtatatgcgacacgattagttttgaagtacaattgtatcgtaatatccttaggctattcct

SEQ ID NO: 38112 - DNA, 8490 bp, Oryza sativa
ttgattccattgacatctgagagtataatgtagctaacattagaagactcattgtctaaaaaaaagctaacattagaagactatgaataaggagtataatgtagctaacattagaagactcattgtctaaaaaaagctacattagaagactatgaataagtaataggtaggtaactcgcgattgcataactacataaggggggacaaacaaattattgattaaaaagagcattcaaagccaactacataaggggggcaaacaaattattgattaaaaagagcattcaaagcctacatgggttacctgattattaactataaacagaggaatcaatgtaagatcgtaacaaccaaaatgagaatggctccaaagtagaaaaagggaccacacaccatctgattacttggttacattaccaccagcatctgacatcattagcagcattcacgtgatggccccataagactaaatagaaatttctatcaagcataacataacgttcacattctcttgtgctacaaattttagttgaagaataatttcaaatgtgctttattcatagttttgggagtaacatgggtttggcaacataactgttcaaaattacaatgacggtaggaagtccatacccacatattactgaaacagaagggctacgcttgacgcattaagacctagtctgatcatatttcttaccttaactaatgaaataatagaagtacaaataaaacgacatcgattacaaaactacccaactctacccagatcatcagaacccatgaaatacaccatttcacctccccacccgaaccgcagcggcagcagcccaaacaatggaagaaacaccctccgaagtccgaacccacacattacagcataattaggcacagcctagtaggctaccgcataattagacacagatgcgatccgcaccaggcgagctccgatcgaacggaaggatccagcaggcacgcgagggggcaaacggagcagaagaggaatcgagacggagaggcatggtaccttgggccgcacgggctcggggcgcctctcgggcgtcgtcgtcatcgcgagccgcggaatgcggatggggcttcgctggagcctcctcgaggtcgtcgcgggccgcccagtcgtcgtcggcgggttggagggaggtgatcgccggcgccggcgcgggcgcagggtcggcgtcgtgctccatctcccgcgagcacgaggaggaggaggaagcggtgggggttgggttgtttctgccccttcgcctttgtgcccacttggggtttttcttggcttagcggaaaatttccgctcttttcgctgttttagggtttttcagtttttttcgtagggggattttggcctggggaaatggggaggagtggggggctacggcggcaggccgagaacggtggagagggcaatacacgagatggtgctgctttggcgacttgcggccccgatcttttcccaaacaaaatttttacagattgttatatcgaattttttgacacattaagtattaaatatagaaaaaacaattacatagttcgttagaaaatcgtgagacgaatcttttaagcctaattgcgctatgatttgataatatggtgctatagtaaatatttgctaatgacggattaattagacttaataaattcgtctcgtagctttctggcggaatctgtaatattttaaatatgtgtccgtatatctaatgtgacatgcaggggcaaaaaaattttccaactaaacaggccctgcttatcagccaaaatttgaattttcaacattaaatttggagttgatttggggtttttcatcgaagttctaagaacacgtatataaaaattttatttacaaattctttttcgtttgcaaatatgcagtttcacatataagcgaaacgttgaggcctttggcgtgctcccgtgcctcggcccgcaaggcggatcggcctaaccgagtaataactgggcttctgggtttggcctttcggtgtctggtcagggttgaacgtggtatttatgttgactagtaatcatgcaatgcagatgcaatatgaggaaatcaatgcttgcatggtaatgctcatacatcttgacacagtaaatttagatatattccaagttcatgatcagaagataatatggattttataagacagtatgaacttgtaaagagtaagatcggtccttaattagacggtacagtgtagaatatttcttgcacacattgcaaagacaaagtcagttagaacttagaaaccttgcatccgattgtctttatatggcgaatttgtaaagtttcagtacttgctccataagaattcataacaattagctcagatgaaaaaaaaaacattgaatgccatgcacaataggatgcctcctcttgtaaagaaggaaaaaaacgaacgcctattaggcatgtacaaaggaccaaggcaaaaaaaaaaatagctagtcatatatagtacatatggttatttctgagaaaaatacttttccacatattgggggttatcttgtgatgtaaccacagggagaggagaggaactttgtttgctagatagatgaatatttctgaaacaattctgtctcctggaatgcatagaattttgatcttgcagaagtcttcttaaccggctctggttgctttggtgcacatataagagcatcttcaacagcctttccaaatattcatatagctaactctctatctgatttggctagtcaaactagctacttgctccaaccgcctctccatctaccacccctattataagtctatgacaaatagaacccacgtgtcagcctcacttcctcttcctcttccccttctcctcctcctgtgtgcatcctggcttcctttcctccacccacgatgccaaccaccaatccgccgcttccatgccctccccttcctccctcacattcgattagcttcaccgccgcgcccaatcgccccgacgtgctgctccaggccaccgattccgtccccgtccaacgccatggcgccaggagaacgacgacggcggcactgggtggatggcgcggcaggtagggatggggaaaaagggagagagaggagaaagggtgtaggacccacaccgatggcaagccatatcggctggctaactttggctagtctggtggggactttagccagctggatgtcttggagaagcatttgactagtctgttggagtagaatttttgtctaagttagccaaattttggcttggagaaccatttggctaggctcttggagatgctctaatgcatggtcattttttactcttgctgagttgatctggagtgtttatgttgtttctgagtataatgttaaaacagagggagcatattgggaaggctatttgactagggctgtgtttagttcacgcaaaaaattggaagtttggttgaaattggaacgatgtgatggaaaagttggaagtttatgtgtgtagaaaagttttgatgtaatggaaaagttggaagtttgaagaaaaactttgaaactaaacatggcctagatagcattggatgttttggtttccgaagttccttaaggaaccacatcaggcaaattagaattttactgaccagcactgatgtatttttcggacgtgataaccagctaccactccatctatgatagacactattcatctatacttcaaatacgattttctcttaaactactcatccgatctacgatccgattacaccgttgtgttcgtaacaattaaatctttataacaagatctcacatgattatactttaatgaaaaaaatataaattacttttataacatatctaaattacttttagatttcactaagttacttattagacatataaaagtaattcaataaagcctaaaaataatttacatatactctagaagtaacttataacaaaaagaaagtaacttctataatatatattaattactttaaaactttattgaatttacttttatatgtcgaagaagtaacttagtgaaatctttcactaaaagtaatttagatatattataaaaatagtttgtgattttttatcaaaatataatcatgtgagatcttgttgtaaagatttaattgttacgaacacaacggtgtaatcggatcgtagatcggatgagtagtttaagagaaaattgcatttgaagcatagatagtaggaatattttttctatttgcttgatcaattagtactatagtaaagtaatattcttcaagacacatatatggacaatggctgatagcgtcgctcgttatgactaaatcgagatcgctctcgatgtagattttgcgtttctggacggctggatttctggttgtcacgctagttgagtttctgctcattatctaatctaaatatagtaattatgtagaaagtctgttatctttgatgggaggtcgtgtccgtccacaatatgagcaagattaatcggtttctgtaactgaaacaagcctgcacaactctagctcactactagaaaaactatttttcccaacgtgagggttttattttcacaggcggatatgacccttagagtcaaatgaccgcctacaaaaatataaatcggggtgaaatttaatgcccaggcggaccatttaagcggcgaatgcgaaaataaacttgaatataaataggcttgcgggccctaatttttttctaagtccttacacctctcagtcctcccctcgctccacacctctcctctcttcctcaccggcctctcccctcccctcccctcccctctcctcctctcccctcccctcacttctactctccctagcggcggctcccggcggcgcggcgggcggtgacggtggagggcggcagtggcgaggaggcgcggccgaagtccgggaggcggcagcggctcccccctccctcccagatctagccggaggagggaggggggaggctggtggcggcagcaacggcgtggagcggccgcagcgtggtccgggcggctcccctcccccctccctgtcagatctggccgaaggagggagggggaggccagcgggggcaacggcggcggctcccctcccccctccctctcagatctggccggaggagggagaggggaggctggtggcggcagcaacggcgtggagcggccgcagcgtggtccgggcggctcccctcccccctccctctcagatctggccggaggagggagggggaggccagtgggggcgacggcggcgacgacggcacggggtggccggcggcgtctccccttcctccctccctcgcagatctggccggaggagggaggggggaggccagcgggggcggcggcggcgacgaaggcacggggcgacgacggcatggagcggcgcggctcctctcccctcttagatccggccgggggagggcggtggcggtgacgacgacgactgcggcggttcccctcccctctcagatccgcccgggggagggcggtggcggcgagccgcgtgcagcgattttttttgttcgttttttttttttttgcattttcacaggtgggccgttgccccgactgtcgttgtgatgcaggcggatctccctcccgcctgcgaagattagttttggctgcctgtgaagattagttttctagtagagtggctggccgggctagctactgctgaaacattaaactaaacaaagaaaaaggaaaatattgcttatatcttcctcgaactggtagatgactggagcatcttagtgtaattctcacatagtagtcagggctacataatccggcttaagtaggttttatacccatataaaaatatgaatatgatcacgcatatcccggatataataatgccctgcaagaatatagagaagagtcagtatagttggtaattaatcatctcattttggactattctaagagcatgtgcgcgcatggtgtctaataacggacgctttctattgccctgcaaataaatttggtgatgtggaagagagagagggaaaaggaaagcaaaatgtctaaacgtttattaacggaaattttgtttcataagggtggattaaaggaaagaaggataataaaaattatttagtgcattaatggttaagaggttttgttgtctctattattgtagcatgatagtatctagtgctacaaagagctcgtattagactctacctttatatatgcctaaaaaactaatttctcaacaaaaccaatcattagaaaaaaccgaacaacttactggattcaaatcctctcagtaaactgaattaaaaaaaaagttacaacgcaccggcctgtaactaacacctagggaaaaagaaaatatggaaacacttgcatacgtacccataagcaattaatcgccggctgccgccaatcgtcgacgtcgcctccatcatcacccacaaaatcgtcgtcgatgcttttcgtcggcgctcgcgggaggagaagaggagccgcgggatcgtcggcgtcggcgtccttgcccttgatgatgcgtatggtgatgtaggtctcccctggacgcagatcccgcgagcggctaggcggtggcgagtcgtcgtccgacgaattttttttatttttaattttttttattaaaagttttaaaaaataatttttcattttgaaaattgacagaagtggtcgcctaccgccctctgggagggcgatttttaaaaatcaccctcccagagggcggcgaaagtgacgtggcagacggtcgttcgctctcgggcgacggccgtcaacgaaatttgcaggcggcccccttgccaccctccgctagggcgattttgtactgtgcggggggccgcctacaaatgggcggcggggggcctggaattttgcaggcggcccccttgccgccctgggggagggcgattttatactgtgctttatattttttataaatatcaatagttatcaaatttttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcattcgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaaatcaccaccataattaaacattgtaataataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgcatcttcggtttgcattgaaatatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttttctccgcaggcctatcgatacccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctctcctctctctctttcgttttttttggatttttagtgaatataatgaaatttcagagaggggggactgggctttatagggggaggcaaaaatcgccctcccccagggcggcaagggggccacctgcaaaaacccatgccccctcgccgcccatttgcaggcggccccccgcacaggacaaaatcgccctagcggagggcggcaaggggg

SEQ ID NO: 38113 - DNA, 8909 bp, Oryza sativa
tccgtcaattttcaaaatggaaaattatttttgtaaaacttttaataaaaaaaattaaaaataaaaaaaattcgtcgtccgacgaagaggagtcgtagtaattccagcggcccgacctaacggcaaacatggctgcagatttagacggaaaaagcttgctcacaatgtgtatatattgatataacgtacgtactactactactgtgtagcgcccgctcgttggagacgaggatcgctgtgaaataattggaatacatagctaaaatatgctccccacccctaatcagatcaggtttgggttccgtggagcagagtttggatcggatccgtgcggacggctgtagttatagggcggtaataaagtcgaggtcgcaattgacgacgatgagctcgcgtcgtgtcgatgtgccgcccgtgccaggttcctcgttgggcttggcggtggtgaccgcgcgcggcgggctttggtacgtgtggtgagggtctggtaagcggaagcatgggccgatcgatggttggcattgctggctaactgggctgttcggccttgcccttgctgggcctggtcagcgtggctaggctaggtgactggatagacctggccggcgtggtgctggctcggcctaatctagctggctggtttgagcatggccgactgggctagcccggcaggtttccggttctgaagaacttactttgggaataagttcacttgccttccctcaactttacattaagtttgttcggcataccttaccctcaatactatatatcttcaaccctaaactatacaaaaccgtgcaatttagttcctatggcagaattagcagctggtttcgttgacgtggtatcctagtcagcgaaagaaaataaataacatacgggtcccatatgtaagtgagaagaaagaaaaaaaatatatgtggggcccaacgtgtcaacgcttctcttttttacccaccacgcatgcgaggtcaacatctggggaggcagcagcggctggggcggctaggaggtggtggtgacaaggcggcttcgactaggggcgacaaggaggtggtgatggctaggggtggtgaggaggtgacggcggcgctacaccggctgtggggtagcgatgaggcgagctcagctgggggcagccggtctgtgcggtggcgaggcaacaccgcgctcagggtgttcgccggtcatcctcttgttgcccaagcacctcgctcgcgtttcatctcctcttcgttgacattggcgagccagagccacgacagcgtcggcagcagcgcagggtggggtagaggatgtagcctcaaatccgggtcgacgtcgtgaacctcgaagggagaggaggggagaggcggtcggccacgccggcgagagagggggaagagtaggccaacgaacctaggagggagaggggggagaggcagctgaccgtgcgtggtggagagggggaggaggccgatgaacctgggatggagaggggaagagaggtggtcggcatccatttcacgcccagaaatttagccctaaatttccagactattttgtgtattaaatccctgtccaggaccagccagggtacacaaaatgacaagtaatatacagttccaaacgtaaataaagcgtaaaatacttacagaagaggcacttagtcctcacaccgaaacaaaagccgcagcagcggaaaaaggcgatcctagcggggcttcagctccactccacaggcaaaactcaactggggtctgagccttggtcctctaactccgtcttcagctcagaagcactacacttctgaaaagggggaataatagtaaggctgagtacaaccaccgtactcagcaagccacaccaatgatgcagacgtgcacggggacacaaagaggggtttgtggctatttgcgtaaaggcagttgtaaaacattttattgagcaaaatagtaaaacaattgagtaattaaggtaagattaaatctccactgatcaacgctaaaccacgttgaacaggcccaaccaacccacctgaactacagtgcattaagtcgatttattaggggtgagactaatcacggtgaatctggtcgatcgcccataaccgcgggcacggctattcgaatagttttactctggccagaggtgcacaactgtacccacaagacacaatccaccggcatgtcacagtgtcatcatgtgcccatgatgaacacgtcaccacgtcgagtgattgtgacaagactcttcatataactctcccctaaccatccacaccacgctaaggtttcacccccaccccctaccctagaggtgggcagtcccctcgtgcgctgcggtgaatccggcagctggacaaccggacaccccggccgacccaactccatcacgcccaccctcgccacggtgcctaggaaagggtcgagctatacttcaagtcaagcagttacccactcccgcttgtggtaagtattgtaagtcttccagggtttcccgtgaaccggtccttaattaccatgggtgcgaccagcaaaaccatgcacccacagcccaccattcagtcgcattttagttggataattacgaccatgaaacatggtcaaatgtctcgagcacgcagctcgtcaagatactaagatgtctaatattgtaattatcacatcaactgagctagtggcaattaagcatggctaagcatatagttctagctgtgtcacataagtaacatgagctagtcgatttatcacccaaggttgacaaaggacagatatcaagtaaacatggcacaagcgagcagataggtaaatcccgatcccatgtaattagcaaaacatgcatatttatttgcaaaaggtaaaacatttgtaaagtaggatcaaaatgctcaagggaaatgtgtgacttgccttgcttcttcaaacgatcttcagaactcttttcctcgcgaccgcggacttccgaaacgatggattatacacgctggcacgcaaaacgaggaaaaactctaataaaaaccaaggaaatagtacataaaaagtaaacaaacatgtagagctcaattttagatgaattttgcaagttgaatagctcaattcggagttcggataaattagatatgaattttagaagttttgagccaccttaatggatttatagaattattaatgatttattgcgcaattaataatggtttatgacgtcaccgaggggaataggttgcgccgacaagtgggccccacctgtcggtggctcaaaggaggtcggcgcacggtggactcagtccacgcgcgcgctgcccgcgggcgcaccacgtggggggccgcggtggacggggaggacgaggtggcgccgacgtggcgccacagggcagcgacgccaggcggcacgaggagagccacgtggacggcccatatcgccccgaagggggatggggtggccacgggcgagcgggagccggctcaccgaccggccggacggggagccacggcgcatggcccgatgatcgccggcaacgaccaccggcgcgacggcatgtgcgggaggcggcagaaagaggggaaagggagaggagatggagggggtcctcaccgaggggcgccggtgacggaaggacgacggaaggcggctggcggagctcgggcggagggaggcggcgctgctccggcgatgggcggcgcttgggaagaaactgacgagggtggccgcgacctgcggaaggggaaggagggattaaggaggggaggaccagagcggtgcagccaaaacaatggccggcagcgacagtactaggtggagctcaccttgagtgatggggatggggtttcggtgacgattcacggaggatgagcggtggccgggcttgcccttgggacggcgaagccggtggaggtggttgcgcggcacggcgatggctaggacggcagtggtggtcggctggagacggtagaggcggcggtggctcggttttgcagtagggcggcgtttgtgcggtggtttcgagggggagagcagcggccggggtggggcttgatgcagcgaagccgccggcgcaagcggcgaggtgcggcgtcaactagcgcggcgacagcggccggctgaaggttgccggcgagcggcggcgatggggagcggcgtggggagagcgggagaaggcgagggaagcgccgacgaggaggggaaacgagagaagggagcccgaggatggattttataggctcggggagggaaaaacgttgccgggcgtggcggatttggggcggcaatgaccagcgacgtgggtgacatcatgggcgaagtggagctcgatcccggcacgatttttgggggaaacgtggggagagtgtagaggaggtggatgggaaccgatttcatgcggtttgggcgtgagggcgtgagcgggaggagccggaatcggcggcgatgtgggcggcatggcggcttcggcggtttggatgagggaggctggaggtagaggaagggtctgacaagcgggtcccgcagccccacttgtcggcctgaggggagggaggaggcgcgcagggaggcaaagcagacttggggaggggaggcgcgctgggccggcggcccgaggagagtagggaggagggggcggccagccttagagagagggagggcgcccaggccgcggggaggcaaaggagacggcccaagggaaagaaggggaatttaaattggttttctttttattttaattgataaaatgaactttgtgactttaaaattacttcttgagctccgaaaattcgcggaaaaatccagaaagtattttagggtacaaagaatattacaaaatgtttccggccaataatttttaagggaaaattttaatttcccctataatttcacttgattaaattgcttaaatttttatttaatttctgggaaatgcattattaagtgatttttaatcccgaacgaaaatcggggcattacaatccagcagttgctcctccatccagtcccccgtcggtccttctccgctcagccccccgccgctccttcctcaccagcgttgcctgtgtgcatcatcggtgtcgtcgagccggtggagctcagccggccgcctccccccggcgccagcgacctcccgagaagagaagagaagaaaggaaaaaaaagagaaaagagaagaaagaagagatttgggtcccacatttttctcacttacctgtaggtgtcatattttatttatttatttatttgctgactaggatgccacgtcagcgaaaccatagatatatactgctatgggatctaaattgtgcggttttgtatagtttagtggtgaagattttttgtattggggattattgacgtcatataaactcgacgtaaagttgagggacagctgttgaacttattcatacttctactttggaagaagagattttgcgagtttttttttatttcggttgctctctgcctctgtagctatctcatagtatacagagtaaattgcctctggaaaactactcaaaattcatggatacaattaataaacaaaccaacattgaataactaaacgatgatggtacgtttatatgtcaacagcatacgatgaaatgaaatgcgatacggtgtcataattgcatgggcatctggccaattttcaagccataatagtactatataaattgatgccctatttggtgggtatcttttctttctataaagttaaggccaaaatctcaaacctcatgcttctacgtcatcatcaaattgtgaaccgttggatgaatgtattaggatgaatgtattagattgcttctcaaacgttggagggaatgcagcatagagcctaacccatcagtcaccggatgagtctcttcgcctacttagtgccaaatatagcccacatgaacacattggcccatctccacacacatctacatgtatccagcccgtcaatccgtataaaatagttttatggctgaacgctccttcagttgacatgtgctacctaaattatctacaaattttggatagggctgctaaaaagaatttcttcaagaaagctatttgtttcttttgtttcttcttgagattgtacctcctatctaacaaattaatattaaccaagtcccacaacaacgcgaggagccctctagtattatatatatgtgcgttctgaagaaccaccaaaacgaacacgatccttcacccggtcacccctactggccaacgtgttgttatagacgctacttcctctgtcacatatcaaattcatttgtagctctttccatttatctcaaaataaatagttcatatttagaaaattattgcgttggaatagttatattggaagaagataaagtatgagtattggtatacttcctccgtacttataaaggaagttattttagacaatgtttaagtcaaaccttaggaatataaatcaataataactcttaagttgttgagtttgaaaatataaaaattatattaatagatttgtcttgaaaagtactttcataaaagtatacatgtatcacttttcaataaatatttttatagaaataagaaatcaaagttgtgttttagagatcgtgtcgctgttttaaatgactttttttacgagtacggagggagtatgtgggatggatggaaaaaaacttattttgagatggatgtactattaacatgagttagtttcaactatatttagaatatgtcacgacttaatgatgatgggatggcaacattgtcaaccagctttaattactccttaatctcttatgctcctagtcttgcatacctggtgacggtggtgagccatgcgggaacgacgaactatcgtataaaactttgttgatttcttagccccacatgttatagaccccatcaaaaataaaatttggtaatagaatattataaaagttttcatctttacaaaataatgataaatttattataatgataatatatttgagaaaaaaaccgttgcaaatcacggagattatgctagtgtttaaatagcaaatctggtaggcctgcctgaagccatgctgactaggagcctgctagtgacaggctggctggcaaccactttggatgcattaaatcgaccatgagcaaataatagagaagttgctcacaaaataagcaaaaaaaaaaaaccaatacctgtatttatctcagagcgatggcactcatggaataattaattttggtaattttattttctaatccttttagtacttcaattttatgaacatagaccgttgaaaatctttacatatctatattagtccccactaccaactccttatttttcttaaaaaaaagaagttaaaatgacatggatccacatatcaactacttccaccaccaactcccaactttgtgagaagaaaaaaaaataatgcgagacattaacaaatatatgctgaaatcaaggtatgctatatacatagaaaataatgataacaatgggctatataataattttttaattaaaatctcatcccaacgtataggtaatatgcaagtaatctaaatactactacaaaactaaagttagtgctgagttcatgcagtaaaaactgcaaagctttactctgctcatgcctcattgcctgctcaagctttctgtcgttgtgacctgttctcgcttcagctttttttttttttttttgcaaacacattaattgatttataattaagagtactacagacagagctgaagggaaatatcatccgcagtacattgccagaaaagataaaatatatacaacaaaaccatccattcagacataaagccaattgaactaagaaaaactttctccaagataatccaaacaacagtaatggacgagatcgacaagggactgtggcattgcgcgacgactacgtccacgagcctctactaaagacatgcacaccgctcttcggctgcctccacggaagtgacactcttcgagatttgttgttgagttgtagattttgcttaaacttcaccagactcaacaaaggatcgccaaggagttctccatcaaatctgaggagcactgaccggtctgtactcaacccgaatggaatcctcaacttaattggatactgctgcaaggagaaccggaaaaagtcttcacaccccagctcgtctgaggacgctgattgtcaacattttgtcaaatgaagaagaagaagaagaagaagaagaagaagaagaagaagaagaagaagagaagattggaatgagggagaagaaaggtgaaataataggggcagcatcaaccatatgaacatatatattacattggttactgcaaaactaatttggtgatattatcaaagacaaaaaaacttggtgtcaaaagagcaagtgcagacaaattcggtcctacatcatcaaaatttcctagtttattaaccagtgggccaatgctgtcttatcaattattgtcagaactaaaaaaaatagatttggaaacaagttccaggatgatttacttttaaaacatcaataaggccagctagtgcagaaggttctttgggggaagcgctacacaaaacgacatccattcatattatttttaataattgcattagatcctagcgtttagttcgagagtttctagccaaaaaatattaactccatatctttaactactttgggcactccaaaattgatagaaagttgggagagttctttttcctcaacgatagaggcttgttttcatgctagcatcttttgaatatataacaaaacaagagatcacttgaaagaacattcctataccgtctattatatttcatttctaactcccgcacttcatattgggaaaagtaaagatgcaaacgctggtagaagcatcatataaatggattacatagacccaaacagaatgtaatcgtttaaaacgatgtttatttagaaagtactcccttgttaacaactaaat

SEQ ID NO: 38114 - DNA, 39787 bp, Oryza sativa
cttgtccgatatattattcttactttaatatcctgatatagagtagtatcggagtattagctgatacatgctagatctatctgatcggctatactataaacatatatagtcttgttattgacatatattttaatttaagtgatttatactgtctcggcatggtgaccgatctatcccaatcacttgatttaagtatatattgatataagaagtatatatcattagtcgatcgagtagatttagttcttctttacttgttcatgactgctgatcgatgcacagatgacatcggcttaaagataaatgatatgtcatcggcatctagccgatcggctatcatttatagatttaaccacggtttctttgcttctagttcttgatgattacaggatcaaatcagctagcacgctaacacatctgaatgcgagctttggacctgcactagagttaagcagatctctcagaccacgtgttttctgtcaacatccctctgtttcagattataagacgttttaattttggttaaagtcaaactactctaagtttgaataactctatagataaaaagtagtaatatttacaacaccaacatagtttcatttgagtaactccataattgataatatttcataatttattagtttagggttaaaaatattactatttttttttacaaaattggtcaaacttagagtagtttgactttgataaaatatcttataacctaaaacggagggagtagctaatacgtgtataatattttttatacatgtattaactgccaaaaaaaatatagggacgaatgaggttttatgaaatatttatcctaaaacctgtgattctttgaaacaagttataaacacatgctacaaatttagctggacggtttctagccaaaaattattaagtccatatcttttaacaaacccgctccaaaattgatagaaacctgggagagttctttttcctcattgatagaggcttgtttccatgacagcgtcttctgaatatagtattagcacttgaaagaaaattctacagcagagaacagctcaccgatatacaaaaccagagattatgcactaaaatatgtagtaacaaaatagattcgagcgtcatgggcggcaggcctctgcaaggctgcaatgaacctgtagctgtcggcgttgcctttctttggttcttcgcgaaacagaaaacggacatgtactacatgcctagcacgttgcattagttcttagtcaagtggcagttccattctcttctttcggcgtcatgacctctttataagtggacacatgtacagtacttataagttcaaagcattcatttaatcttttattttttactccatccatttattctaaataagtttatttataagtaatcatcacattagagtaaataaaggtacaaaataaatgcattgaaagtaaataaaaaattttttatagtgggatttgataaaatagatatattctagtcagtttggttttatattggtatgtgtaggatgtgtgaaaaataaacttattttgggacggatggaatttttttaataatataccatcaataactataaaattaacgtcatattttcaaattatcacgctacaataaacatagatgttacattaaatactccctccaattttttgaatctacattaaaagatgattgtagtattagttaaaagttacggatatttattaaatgccatgcacttactcctagataagtattaaggcatactattgtatgggttctttttttacatgaaatactattgtatgggttcttttttttacatgaagtacatttgataacatgaaagagagaagagaggaaagggaaacctcgttactatatttgatattagcttagaatcgagtcttagcatttactaatactaaaaagaatttggttgcatggagtgaaaaaaaaaaagataataccaaatattttgatacaataatagataagaaattttgttgtctcaactattaaaaagatagttgtattaacaagagcatatattggaatttacccatgtccatgcccttatctagataaataagcaggagtattttcatttcccaaatttgtctgacccatttggccagttcaatccaaaaaccaagtgtccaaaatggaatggatccgtgccattgttgccttaatgccgtcctcaggcgattttctccgttgtacacgccctgattacacgggtggcaaaaaatagcctgattcttctcttcttccttttcactgtgctccatatgccctcaatatcctatcaaatccaataaatacccttgacacactaagaatcgaattataatatttacatttctgcccctcacagggctcaactgaaattacagaaaattgtcgaagggatcaagcgaaaggcttcttttatgtggaaaatggaataaaagtctcggattaaagaagcaattgccgtttcagacgagggtggcagccatataatttgcttgcgccaaaaccaaacatagagcagcaatagagaggaggagagggagatgatggcccatctccttctcctccatccacctgccagctcgaagatttctgtctgaatcgatcggatcaagatcaaatcaaggagggaggaggttgagcaattcctgacagggacagatcgggaaagctctcacagctttttctttgtttttgtttgatttgttcctgcttttcgattggaaaattgggaggggaggaaggtgatagccattgaggtggtggcatttgctgtcaccacctttagctatcgccttcctcttcctcgtctcgctcgccccccggtctagcttctttctgcaggtattcaatcgatcgagcaatcagttattttcgtttttgttcttgttttttcttttttatcatggaagctctctgttcatctgattttggtagtgaatctttaatttgtttgtatggcacgattcacccataaatcaatcgataattttgatacgattcagagagtgattgatttactgcactggtttcatccagggaagaggggaataaaattactctttttgcaaaaaaaaaatctgaaaatagggaaaataatccagcaaaatcgcatgtaattttgatgtttgttcatcgtttcaaactatacgtattaggagaaaccaatctctactgctcctggctgattttgtgatgaaaaatggccagtttcctctaaaacaatgaccaaatttgacaccctcttgttcttgaagggccggacggaaaaaacaaaacaaaagaaggcaccagccagccatggcgatggtgctggactccttcgtcacccggtgcacggcgtcgctggaggacttcgccgggcaggaggcgtgcggcgccctcggcatcggggacgacgtgcggtgcctcctggccacgctccggcgcgtccaggccgtcgtctcccacgaggagcgccgcggcagggtgctgagcgccaaggtggacgcctgggtggcgcaggtgaaggacgcgatgtacgagaccgacgacgtcctcgacgtctccatggtcgagggcggcaagatgctcgccgagggggacagcccgccgacgcccaaggcgcgctgctccctcatgttctcctgcttcaagcctgcatccgcccccaagttccaccacgagatcggcttcaccttcagggagatcgacgccaagctgagggagatcgaggaggaaatgcccaggctccccgcaggatctttgcactctgaatcaagaagggattggttcagtagaggcatctgcagtaacttctctgacgccattaggccactcgcggttgggacacaggttcagaaatctctggatggccttgtgcctaggatgattagagagggcaagaagaaggtggatgtcttggccatcgtcggcgcagtggggatcggcaagacaatgcttgctagggagatttacaacgacgagaggatgaccgaaacatttccaattcgtgtgtgggtgaagatgacaaaggatttgacagatgtggatttcttgaagaagatcatcatcggtgccggtggtggtgtcaatgttggtgagattgagagcaagaaggagctccttggaatcgtcagttctactctttcgaagaggtttctcattgtattggatgacttggacaacccaggtatatgggatgatctgctcaaagatccactgggagatggtgtggcccgaggcagaatactaatcacaacacggagcgaggaagtggcaacaggcatgaaggccatggtccaccgcgtcgacaaaatggatgcagagaatggctgggcattgttgtgcaggcagtctctcccagagtgcagttcagaagagctcgcgtcactgaaggatgttgggatcaagattgtggagagatgtgatggccatcctctagcaatcaagatggttgctggtgtcctaaggtctagaggcaagagcaaggctgagtgggagatggttatgagaagtgatgtttggtccatgcggccaatcattcctgagctgcctcaagctctctacttgagttatgttgatctgccttctgaattaaaggagtgcttcctccattgctctttgtatccagaagaattacccattcagaggtttggtcttatccgacgttggatagctgaaggccttgtaagtgacaaagacaataagttgctagaagattctgctgaagagtactatgcagaattggtaagcagaaacctgttacagctttatgctggtaatcttgatcagtgctggataacgcatgatcttcttcgctcactagcacgctttctgataacagatgagagtatcttaatcagcggccaacagagattgagcacagacccattgtcattgtcaaagccacgacacctgacattgtgcaacatggaaaacagatttgatgatccaatttcagtaaagcagcagatgagcctaaggtcattgatgctcttcaatagcccaaatgtcagatcaatagataatctcgtcgagtcagcatcatgcttgcgtgtcttggatctgagcaagacagcattaggtgctctcccaaaatccattggtaacctgcttcatttgaggtacctcaatcttgatgaaactcaggtcagagacataccctcttccattggctttcttataaacttggagactttgagccttcagaattgccagagattgcagagacttccttggaccgtcagggcattgctacagcttagatgcctttcgctcacaggaacttctcttagtcatgtaccaaagggtgttggtgatttgaagaatctgaactatcttgctggtttaatcattagtcacgacaacggtggacctgagggttgtgatttaaatgacctacagactttgtcagaattaaggcaccttcacatagagaacctggatagagctacttcaggcgcttctgcacttgcaaacaagccattcctcaaggatctacacctctgtgaacaggcaccattgatagaggagcagcaatctgaacaagaacaagagaatcaagatgaccaaaaggaaacagaggaagaagagaaggaagtacttgatgtaaccaatagccaatttagtagagaggaatcaatcaaagcgagcgaaaagatatggaacgaactcaccccaccccagaacattgagaaactagtaattaagaactaccgaggtggaaagtttccaaactggttgacaggtccaaagctgggcatatcattccctagtcttgtgtacttggatatcgacaactgcatgtcatgcacggcactgcctgctcttggcctcctaaaccaactccagtccttgcaaatctcgaatgcagactcagtcgtcaccattggtcctgaattcctcggtgctgcttcatcatcatcggccactgcttccttccccaagcttgagatattaaagctcagaaacatgaagaaattggaagagtggtcattagccgtggaagagaatcagatattgttaccatgtcttaaatcactgcacatacagttctgccccaaacttaaagctctaccagaaggactgaagaatgtttcgctgcgtgagcttcatgtcgagggtgcatatagcctaacagaaataaaggacctgccgagaatatctgatgatctccaactcaaagacaacagagcacttcagaggatctctagcttgcccgtattgcagtctctcaccattgacaactgcccaaagttgaagcatgtttcaggccttgacacactgcagcatctcaggctggcgttccctccatccacagagacattttattttgatgagctgatcatcttctggagtattgcattcccacggtggctggagctgttgatccgtaagcgcgatgggctgtgccatttcgagcttcagtgcagcctctcattgctcaggagctgcctggacggtggcaagaactggagcatcgttcagcagatccccgaggtgcggatcaccagcaccgatggcaagaggtacatccggtacaacaaacgccggtgcatctatgagacgaatgctcaatctgaagattgaagccttcgtgaaagtcccagtgcagtacgtttttttttttcatcttcattgtgcagttcatcttgtcaaggttctcttgttcagttgtgtggtgtcattacttacagaagtgtatattttcgttgatttattggcagtggtttgggttgttacaaggacacatctcagttttcctgggtagtccttccatgagttttgtttgcaatatttgccaacacgtgcattcacacaggctattatgtaagcctttgttctatcttttctaattacatttgttttgcaaatcaaatatccgataaaatttagttatcccttgggataagggacagattgaaaaactgatatgcaggtatatttttctcacataagattccaacattgatggaaactagatacgataatttgttcggagtttctaacaggtcaattcatatatctgtataagccgtaggtatattaaacatgtgctggtttaaaaagttgatgattacaaaacctactctcttcgttccaataaaaaccaacctaggattagatttgatataataattgtggaggttggtcttttttttttttttttttttgggatggagggagcatttcacagtaatctcacttgcacatgtttttttccaggttatagtaaaatgaaaattgtagacaagacaaaacaagtctaaaatgggtagggatgaaaacggtatgaaaacttcccagattccggacctattttcgaaaacaaaaactttcagtcggattttttcggaaatggatatgtttgaagtggttcctacctatgcggaacgaatgaaaatgtagaaccttgtacagttggaaactcggataaagcagagttggtagaggacgattcaggagctgaatttgtatggattcaagccgcattttcccgctaataagtgaacaaccatgatgatttcgccatgacgttcctgctatatgcgatgggataaatgtattgatgatattcatgaaggggcatcagcagtttccggctttcccgcggagtggggcgggagggaaaggagaggaagtgggatggggtagcggaggcgccaccatccaccaggcgtcggcaaagcggatgtgctccctgccggctccaaccaacagagagaaacgccgcgggtggtggagctggggtgaggaagctgctgagggtgctgatcgagcttccctagtagcaggctagcagcaagccaagcctctccatcattgggacttgggaggaagagctatcggtggagacgtagggaggagaggcaggcgccacgctgttatgtcatggcctcatggggaggttacgggaggaggaggaagcatagctgcctagaattgggctttttgatattgggccttccggtctgcacatgtgcaaccagttgtgattagggaatttttttatttttaatttttttaattaaaagttttacaaaaaaaattttatttcaaaaaatgacaaaactaatctccccagagggcgggaaatgtgacgtggcagacggccgttggctctcggacgatggccgtcaaccgagggcaggacattttgcaggcggcccccttgccgccctcggcaagggcggttttaaactgtgcaggggccacctacaagagggcggcgagagggcgtggattttttttgcaggcggcccccttgccgccctctgggagggcaattttgtactgttgagggaccaacagccaaaaaaatcatagttttgtaatggttttgatttattttgttatgtttttgtattgaatcgtttgttataaaaatttgctaaataatcatattgaaaacgaagaaaacatgagtaatgtttgtagatttgtttgatgtaaaatatcgtatttgaccgaagaaaattaggtaaataatgagtctgaaaacaggaaaattaggtagttttttttaaaaattttagatgaatactttgcagtcaaattggaggccgaggaggtggtgtgtgactttgaagtgttaggttaatgatcttatagaaacaaacatagtatgtaaaattttgtaagtattggatggtatatttttcagccggattggagctagggatggtgtgctctagatcaaactaaactacattttacaattaacactacgatctaagtctcaattcctactaatatcttctgtgccctagatctatacaaatgtgttgtgttctacagatgtactaaaatatatggaactaaaactaaaatgcaacataaattaaaaacacaatgtatttacagatgatgaagtgagcaaaccagcaggggcttcgccgctccccttcttctaccccacacccctccctttttcttttttttggaattttgagtgattataatgaaaattcagagagggggaaggggttttattgtgtgtgtgtggggggggggggctgcaaaattccaggccactcgctgcccttttgcaggcggtcccctcaattgtgtaaaatcgctctgtgtaagggcggcaagggggccgcctgcaaaatagccaagcccacgtcgccgccctttttgcaggcggccgcccgcatagtgtaagatcgcccttagagagggcggcaagggggccgcctgcaaaactgcacgccccctgttgacgaccatcgcccgagagccaacggtcgtctgccacatcacatttcccgccctccgggagggcgatttttaaaaatcgtcccccccgagggcggcgggagattagttttgtcaatttttgaaatagaaaattatttttgtaaacttttaataaaaaatttaaaataaaaaaattctgcgattaggtcggatggctatcatttcattggtgacaattagatggttgtggtttttgttggtgacaaggcttcaccacaacatagagaattgctattaactacactaagtggggatgcattgtataggtttattataggataacacaggtaatcttaaacgctacaagtaataacacaggtatacagtagtgtagtaccttggaaagatatagcaaatcgttaaatatcatatgaatacttaatttttcttcaaattgaggaaaaaatggtggcacattatgataaacaaaattgtattacatgctccttccgtttcatattatatgactttctagcataacatatatatgaatgttggcaatgctagaaagtcttataatatgaaaatgatgaagtatacttttttcttcaaaaaaataaaataaaaattctagattatgtcgaggttcgtggtagaagtttacacgtagggattggtgacgatacatgttggtaccataataatacatcgatgatacttagaggtatgcttgttagatatgggtgatgatacacataggtaccagtggtttcgttggtacgttttagctggtatcatataggtgttggcgatgatacagcataggtatatatcaatgatgatacatttaatataaatactagagacggtgcaacataagtacatgatacatgtatgtaccaaggattatataataaggttggtgatgatacatgtaagtaccagggacgaaacatgttggtgagatatacttgtactagtgacgatattttgtcagttatgaacttgtgatgccttaagatattattacaggtaaagaacccatctttacttatggttcgcaaccccttttaatccctggtacacaaccaggataaccaatccggaactaaagatgcccatctttagtctcggttgaaatagccgggactaaagagtttttttcttttcttttttcattgtttgcatattgatttcgtgccaaactcacggatcaaataagagtaaattacactagcggtccttaaacttgtaacgaggtttcacttaggtccacgaacttgcaagcaaaatgagtatcgtggaatttttttattttttctcccttcttccttcttttttttttctcccttctgccattggcccacctgtcagtgggcctctctgacctcacattagcctcttctctctatcctctctctctccggccggttacgcaggatgggcggccggctaccgaagcagcgacgggcggagcggtcggcgagaaaggagcagtgcgtaggcaccgaccggcgggaggagaggagcggtgcgcgtgcacgggcggcggctggagaggagaggagtagcgggcgtgcgtggacggcggttggcgagaaaggagcggcgcgcgtgcacgggtggcggctggagaggagaggagtggtgtgcttgcacgaactgcggccgacgagaaaggagcggcgcgcgggcgccagccgacgggaggatgcgcgtgcacgggcagcaattggagatgagaggagcggtgcgcgtgtgggggaggcgtcgccgaccatgcccgggaggagaggttgctgactgtggccatgcgtgcggggggaggcgtcggccatagagcgcgctagcttggcggtggagatgaattcgtcgccgaccacacgtggtagaagtttacatgtagggatttgtgatgatacatgttggtactgtaataataattacattagcggtccttaaacttgtaacgatgtttcacttaggtccatgaacttgcaagcaaaatgagtattgagatccctaaacttggtttaatgtatcatctcggtccaaagcctcgtttgaccgtgatcttgcctacgtggcgtgccacgtggacgatgacaaggaatttttttattttttctcccttctcctttttttctcccttctgccacaggcccacctatcagtgggcctctctgacctcacttttccctcttctctctatcctctctttctccgaccggttgagcgagacgggcggctggcgatgggcggggcggccggcgagaaaggagcggcgcgtgggtgccggccggcgggaggagaggagcggcgcgcgtacacgggcggcggctggagaggagaggagcgtcacgtgtgcgcgaacaacggccggcaagaaaggagcggcgcgcgggtgccggctgacgggaggacgcgcgtgcacgggtggcagccggagtggagaggaacggtgcacgtgcgggggaggcatcgccgaccacgctcgggagtagaggttgccgaccgtggccacgcgtgcgggggaggcgtcggccatagagcgcgcgagcttggcggcggagatgaagtcgtcgccgaccacacgtggtagaagtttacacgtagggattcgtgacgatacatgttggtaccgtaataatacattgatgatacttagaggtatgcttgttagatacgggtgatgatatacataggtaccagtggtttctttggtacgttttagctggtatcatataggtgttggcgatgatacaacgtaggtatatatcaatgatgatacatttaatataaatactagagacgatgcgacataagtacatgatacatgtatgtaccaaggattatataatgatgttggtgatgatacacgtaattaccagggacgaaacctgttggtgagatatacttgtactagtgacgatattttgtcagttataaacttgtgatgccttaagatattattaccggtagagaacccatctttactcacggttcgcaaccccttttaatcccgggtacataaacgggacaaccaatccaggactaaagatgcctatcttttttgtcccgattgagcgggatgggcggccgtcgaccgaagcggcgaaggacggggcagccagtgagaaaggagcagcgcgcgggcggtggttggagaggagaggagcagcgcgcatgcgcggatggcggccggcgagaaaggagcggcgcacgtgcatgggcggcggctgaaaatactccacatatataataccttattcatattaccttgctatttttaacgtagagaaaagtttcagtaactgaatttaggtgatggcattaaaaggtggtcttttctcctgaagatgaagacgaagatgaagatgaatattaggtttttttacgcaaaacgaggtggtattaatgtacgattgattgagttttaattattacaaacttgaaaaatagattaatattatattttagagcaactttcgtgtagaaatttttcgcacgaaacgcaccgtttagcagtttgaaaagcgtgccacgaaaatcctaatctttatccaactcatgttggagaaaagaacaggaccaaaatgtgttgcacaattcagggtgatgagacaatacacttcttttttgtgttgttcctgtactgtatttatgctcccttcactaagaaatgtaagacatggtttgtcatggcattctccataattgaacttgtccagatatagtgtagttctttatgcatcaggtggtattgcaaaaggagaaaaacataattaattcttcaggatctatgatgctaaattggttagtccatgttttgcactgttattatcactgatctggaattattctcgcagaactcttaagggtcatccgaagattgaatttgaaagagcagtggactgatgtgctacttcactttattactttgtatgctctgagatcaacaatctctcatgatagatagcatattgtgtaatgctggagacgtggatagagattagtacgttcattacaagtgaactcgtggcataattctcttgatttttgtggtgtttgatacatgtctttaatggactgtatttgattatttcaattcagtccctatcatttgatttaaaaatatagcattcatctgtaatctctggagataattttcattttgtaatatatataatagtttgttatatgcacatagatcatgattttttatgatgttcagaagactggtacatgtgaatagaaaaaaagggaaatgtcatgttgtttggggtgaattggtgatagtttatggcaatgccaatgtatttgtacgggaggtatgttatagggagatctgcagctcatccatgacaaatactatatctaggtatgcttgatgttctagatattaaatttccatagcattcttctatctactactatgttctaaatattaaacaccatgagattgttttatatgccagaaagcttacactcggattgtgtagtggtaatagattttttgtattgaaattaatttgaattaaactacagaacaattttgatttgtagtctcttcgatttgccagatttttaaccgtgttcaacaaattttcactcaatgattatttaacatcttttcacctcatataatttgaaattgatatatattatttcacgttgcaacgcacggacacccagctagtatatatgtaatttgtaaatatcatttacatgttttagcaatgtaataatcatgttgtttacttgaatttattggagcattcagttttgtttgcaaccataaatttatttccttagcaacgcacatgcacttaatttgctagcataataaattcaaaattgctagacgagcgaaaaagttagtgacacacaagagattctcttgtgtattcgtaggagagattatattcgtaagagtaacaggaaaactcaaacgaaattggctgcaaatgaaattttgaggcttaacttgtcataagtcacggctatttgctagctgacgagtactcataatgttgaacagaaactaaacaaacaaacatcaattaagttcgcccgccctatatatctgtagaacagtagaagtagcagatatgaatcaggccattgtaaagcggggttcagagcctctcgccacggatcctcctggcgagctgaacgtctttggacatgatggtgacgcgcttggagtggatggcgcagaggttggtgtcctcgaacagacccaccaggtacgcctccgccgcctcctgcagcgccagcaccgcgtggctctggaacctcatgtcgtgctgcaccgcaccaaaacatcgcaaaaatcaattaacgtacgtacaagcatccttagaatagaatgaatcgatcggcataatttaaacgtttggttaccttgaagtgctgtgcgatctccctgacgagcctctggaacggcagcttccttatcagcagctccgtgtttttctgatactttcggatctccctgcaatcgtatatatatgatataattcaaataaatataatataatataactgcagcagaattacttatggagagagttaagcatgcatgcatatatgctatggaaagatcgctcaaacaattaattaatttgcttcatcgttcagttctttagaagataaaaaacagctatagcgtggcgctgggacatgtacatctttgacatagatgctggattgaattctgtcatcattgaagaaaagaatcatgtatctacctaagggctacggttccaggacggtgtcgacgaggcttcttaactccgatgaacggaacggactttcgagcgactcctctgctggacggagcaggcataacagcggctatctgcatgtcgatcgattaattgtaaagatgcatcgttcacaagtgaaacaaaattaattagtattgtagtaatcatttttggcaaagcatttgtacatacagcacggagtggctttctaggggcctttcctcccgtggatttccgagctgtctgcttagtacgagccatcctgcaatccatatagacaagaatatgcacattatccacattggctataacgctaagacaacaattttgaagaccctataatatgaacaagaacggcgggagctctgcggtttacaaacctcacgcagatccaaaaacttaattacaacgttcacgaaataataataatgttaattaagattagacttaagaccttaattagcgccaagaacaaaaaaaaaattctaatccagaaaaaaaaaagaacaccttaattagcgtcgtagatgaataatggtggcgcttgattggcccaacagatttgaagagggtagaagaggtggaggggcgatgattcaacggctaacaattctggaaacaaaccggtgacaacagtgtttcgggtctttggagtagaggagaagagtccggatcaggaagggaggttacaagttgcgaagaattgggaagaaaatagaaaaggagaaggggaagaagaagggtcaaaaaggacaatgcggatatttgccaataaattcttggaataaatttggaactctgaaacatggttcgaaaagtgtagagagcaagcctaaaaagtctttagatatgcatgaaagtaagacatttttcgtcaaaattgagaaaaaaaaaacaaatggccgagcaattatggctttataattaattagtcgcaataaatctaatcttgtttaaatatctcgattaagttaaactaagaaaataaacaccaattcaaattttaaaagacccgtacaaactaaaaaaaaagaggaaaaccgggatgttacagacagagagatgcttattattagtacaatttacaggaaactaactagtgtggagatcgattgaagaacacgttaattagtaggacaaggaatttcattagattaaaaaaatgataacttattttatacctctcacagttcgacgagtgcagcaactgctattgctgtgtgtgcctccgaaaatccccctcaggtatgttttggtgtgcagatctgaccggagaagagggctaatttataggcgatcgggcgggctaatttaccgttccataaaccgacttattaattagtttttatttaaccagagctcgattgattaccgttgcatttaattaatcgacggctgatatggtttgtttacgtggtggcacggatcggtgtcgatgcacgccgcactgctattggctggcgctactaacacaaggatttcctggttcctgcgaatttatgatggtaatcctcctttggataaaaattgtttcctttcactgtagatcatcaagacaaatcatgccatatatatctatatctatatctatatctatatctataatataaaaaggaggagttgtccacctccaatcctacatacaaaatcattcggattgatccctaccgtccatctgcgcgagtgatttcaccaccacacgatccatccatccacgccgaatacgccgaatacttcgctcctcctcctccacccgcgaagacatcaccccacgcgcgaatacttcgcttctccagttctcctcctcctcgctcgcttgctcctcctccccgcatgttctaccgccgcgccgctgcatcctctctggagatcttccccgcgtggactgccgccgccagagcctctgattcttccccgtcgccggagccagtgcttcttccccgcgtggattgtcgccgcatccccgccgccggcgccgctgattcttccccatcgccggagccggtgtttcttccccgcgtagactgtcgccgcatccccgctgccggagccgctgcttcttccctgccgccggagccgccgtggccggttccgacctcaactccatccgccggcgccggcgcctagatccactgccgcggccgaagccgactttccaccgcttccttgagacgttcaacgagagagacgactgccggtgcgacacttcaacattatgctctaccacaacgctacagagtacagaccaggttcggcacaatactaggtttcctcgcttttaacttcacaattgcttctgttccttctggtgtttgttcccacaaaatgcatgtggcatggaagatgcttgatggaatactcaattgattattcgatacagtatcatttgttgcagtttttagatcttccaattaactagcgcaacaacaacagattctggttcctctttctttattttctgcttgccatttatatttatatttatgttcgttaaaagaaattcagcactgaagtataaatgttcacccatttctctgtgatatcaggcttgttaacaacaatgtttttgtgcaggaattcctatttattaaaaagctatggtatgttagctacattttaaacgaacaggatatgattatctgagctttgtccagctccagtctctaaagatgggatgttcagtttgtaatcatagaacacacgcgcaacaatcttgcagtggggaataccatgatgcacaggttagaatgagagagggatggcattggaattgtcaaagatttctcatacacctaagccaaagccctttcctcttttggtctttccttctttctatgtaacaagggaatgatctggtcacagaatactgcagcggtttgatcaacgaaaagcaggtgataaatgttggtgtttgacttatgcccaggttactgtcacgcccataaattcacgaaccagaatttttaagctgaatgtgcattaaatccctgtctaggaccagccaggatatacaaatgacaattgttgacatatagatccacgtcttacaaaaatagaaaagattacaaatgcagccgaaaagataaaagcgagctaaaccgggaagcttgacttcagcagcggggcgactccactccacacaggcaatccttgacggcggcgatgaaaccaactttgacaagacagctcccactaggaagattttcagttctggtgtggggaaaaagagagcaagactgagtactacccactgtactcagcaagtcataccggaagaggaggtatgatgcaggatataaccaaaggaggctaggggttcatttgcataaagcaggcatttaaaagcagaagttgaaaacagtaaaacaattgtagtaattaatcaacattaaccaatcactgtccaatgctacaccacgttgcaacaagcccaaccaaccacctgaactacaccagttcattaagctaaactaggggtgagactaatcacggtgaatctggttgatcgcccataaccacgggcacgactattcgaatagttttactctggccagaggtgtacaactgtactcacaagacacaattccacacatgttgccatgccccgaagtatcaccatgatactgcaaagggggaaatcgtgacaagaccctccgcataaccctcccctaaccatccacaccacgctaaggtttcacccgcacccccaacgggcagtgggcggtcccctcttgcgccgcggtgaatccggcagctggacaactggacaccccggctgacccaactccatcatgcccaccctcaccaccggtgcctaggaaagggtcgagctatacttcagatcaagcagttacccactcccgcttgtggtaagcacgataagtcttctagggtttcccgtgaaccggtccttaattgccatgggtgcgaccagaaaaaccatgcacccacagcccacccttcagtgtattttaattaactaacaccaatgcggtggcaccaatccaaagctatgctcatagtcaaagtctatgtaataatgtgatccccatttgtgtactagttgaactacacatagctaagcatttcctaaaccaacatctagtcatttggacactcaagttatcaatggcataaggtaaacaatatatggctgagtaatgggacccatcccacatgacattgtaaaagaatgcaacatttaatagaaatgcgggatatttgtaaattgggtacaatatgatgaattgtaacgcatgacttgccttcctttcgcactgatgagcccacatcaacgtcttcgtggaaccgcggatcgacaaaacggccgaaatctacgcgacaaacaaaacacacaagcaaaacacactataagactactgaaaaaggaaacaaaaccatttttaatggattctagggatttttatgaatttactgagacttgaatggacttaaacggagctcggatgaattaggtatgaattttagaagataaactgtgtttttactactaaagaaaagcccttaattaattattgcgcaataaatccccagggctgacgtcatcaagggagggggcggcgccggtaagcgggccccacatctcagcggctcgaggtggccggtccaccgtggaccgggaccacatgagtggtccaccgccggtccacgggaccgacggtacagatcggcctgaggccaatcggacggcgtaggtgaggctaggcatggctcggctcggcacaaagacggccggccagccatggggagcggcggcggcgagcgcgcgccggcaacggaaagcggcagtgcgggaggcagcggcggacgtctcactggccggcggcagcggccgaaggcgatggcgagcgcagagagtggcggcgcgtgcgggacagagggaaggagggaggagaggagctcctcaccgatgagcacggtggccggcgcgaaggatggaggtggcggcgatgaccgcgatgcggagggacggacgggcggcggcgacaccctaggagaagatggagaggcgtcaggagaggagataacgaccacggcggctttaaacaccggccgaagatggggtggacggcgtgactcaccggcgtgcgaggagagaggcgctccagtgggattccggcaacgtgaggcggcggccgggaaagctcttgcggcggcggcttggcacggcggcggccctagaagcgacagcacgcggccggagatgggcggcggcgacggagctcggcgagcgcggcgcgacggcggtagagggcgtgggagtggacggttaatgggggaaatgagagagagagctcgagggaggatttttatgggcgctttgggggcagaaacggccgaggatggcccctatttggccggcgacgtggggagtggagagagagagagaggtggattcgaatgcgaatcccgcccatttttgggcgtgcgcgagagcgggaagaggtggaggaggtgggcggcgatgtgggcgcgagcgcggggcgcggagtgggggcggggaggcggaaaacacggcggcgcgggcggttactgccggggcacggtcggctggaggaaggggacgaccccgacaggtggggcccacctgtcggcgttccggagggaaggggaaggggaaacaggccggcccaacaaggggaggtggcgcgggagagagatgggccgacggcccatcaagagaaaaaggaaggaaaagaaaagataaagaggaaaatgattttcctgggattaaaaatattgcacttgctcatttttaattggttaaaattatttatagggctctgaaaattccactaaaaatcttgttaatgcattagggcatggggaactcaagaaaaattccaccacgctatttccaattattagttgcatttattaattagggattcaactctaggttaattagaacaatttctccagacgatttatttaacaaatttttaaaacaagaaaaaggggaaacttcaaggcgtgacaaagattacccaccttgattttgtgcctaccttgaaacatgaagcctcaatatgattgttcaccattccagcttaccaactatattgaaatatcaatctattatgtaagctgcctttacaaattaattattactctttgttgataatgttcagagccactgagcttgttcttgctttcaaatatggtgctgctctcatgaatattgataaagtttgccatctcttcatggtagttttgtatgtttgtgcaggtcttccaaattacacatagttcattatgcttgggacagaataatacaatagttgatataaatgtgcagaaaaaactgaaagaaatttcagattgcttaatattttgatgtgagtttatcacgggtgcatattggagtgactgaacaatgattctcattggtaatcattttctcctaccttctacttccttcagtttctcatattccttttttacgaattatatacctccgtatttaaacagctttttatatatttgttttctataaatattaaatgataattactcatttttcattttttttcgtggtggtacactatgagaattttccgaaatactatgtcctgccacatggttgctgaatacattcaagggcattgcactgtccattccattcagtactgggcatatgcattacattaggcacacacaggagaaacatgccatagattaagtcatagagttctgccttcaaatttggaaagaaaaagatattcagagtggcttcagccttcaggtaatgttacgcaagcggacaataatgttgttattaatttgatatatttttaagtgctatagaaatcgatgaaactaattcaggttttgtagacagcttggtgatcaaggcctaccaatatttaatgagttatgtcccttgattgatacactaaagcttattctcataggcaattttgatctagcaaaatatgtgtgcaatgggtgcaagtaatagaagctgcaaggcatattatgaacaatcaaattgtttctgaactgaagtagcaggtttaattttggtcaggtatttaatacagaccaaatttatagtggtaagaagtaacgagaaatgcccgtgcgttgcaccgggtattggtggggtggctgaagtttgatattaacgacttatcaaaagcacacgagatgattataagtacaatgataaaaaggtcatgtttgtttttgataattaatttactctatatttggacgacttagatgacgcttctgacgtgtgtgggcttgatggtcatggcaagggaggaatgagtggcgaacaattaatgtgtctccttttgcatatagggcgacatatggaaatttatgtgatgaaaaatgaatggaattgacctaaaggcacctccccagatttatatttccccatatttatatttgtagtttaattaaactttcttcagcatttatttaatagagttgtaaccgaaccaagggatttcttgagattcttaagttatcaatggtgagattctgtcaggtgacttctaaccttgaatttgtttcagaagtcaccagattgtttaacacgctagatgctatctcactgcaagatcctgcctttttttttatctgaagttatactgagctgctacctcctcaggcttcattctgtccccgtccgcaccttcctcgatgatgataaccctaccgcaaggtaactattcatgtcatcttctttgggtattcacgcacatgtggcaacacaacagattggtacatgtgcttttctacagccagatcattgcacaatgtctagaattttctacttatttgcagggtgacatgagaattagtttatcaccccggtcgaaggtatgccccaaaaactagattgaatatacttatgtctctataaagggatattgtgtggattctatgcagctttcagattcgtatgctaaattctatatagatgtatatgctgaattttatgccccaaaaactagattgaatatacagaactatatgcagcttttactctttgaaggtgtatatgcatgctaccatgtttcctgctaagctgtatatagtgcaatttactacgtcctctcttttttttatatatataccttcacagaagacagtaatggatgcaggtagctaactgcgtggaaattggtcttccgtcactcattcgcaaaaataaaagagaagcgtctccattgcttctgaattctggtgccttgcatttgatttaacctcaggataaaaagagtcttgggatatatggcttctttactttacggattgctcttcctgcccaataaatgtattttgcagccttcaagcagataaggatcatggaggctctccaaatgatatatgcttctgttcataatctgcttgtgggttactgtttctgttgacacggataattagtccatctctgtagtcacagatgacaacttttttcccttcaatgcagccacatttttgtgatgctttacaatcttgacagtcagtgcaaaaggaccaatgcagaaatccataaaactgaacaaacaaatggtctatgttaactgagattataagcaagttatttttatactgaaatatatttgtcgccctaggaatatttgagggctaatatatttgtcaagcttaaatattgaattccaatccatgtgcacttggcttcaaggtaaacataattttatttctaagatgtcattttagtttacagtagatgtacacactttaactaggtatgctgtttttaactgtgaactcaataggtgtaactcctactatttaaatgcagatttcaaaaccaagtataccaaaattggcgttgttaagtagttgtacagcaatactgactattatttggtttttatacaatacaactctgctaataagtatagaatcacatcagacatgtaggcatatatgtgcacatgcataaccaggtgaccaaggaagctatactatagaataatgtgaactccttccttttctttttctaattagacactttattgcatagtgttgtggtttgaatgtaaaatagacagatctgttgctcgaggtttccaaacatttatcaagctatgaaaaaaattacatatttggtatcattagatggagttgtttgaatgtaaaatagatagatctgttgctcgaggtttccaaacatttatcaagctatgaaaaaaattgtatatttggtatcattagatgtccttcatttttatagttagtgtaaagggagagttatgtggcatattaatattaaattttgtatttatatgtcctgtgtgttacacgtcgtcggaaaaccatataaatttgattgtgtttatatgtttactatgatatatagtgcgggaacgtgccttgcacgtgcactcttactagtatggaattaaattaagagatattacttatactcaaattaaatattatatctctatctatactattctaaaaattaaagattccgctaaaattttggtactccctccatttcatattactccctccatttctaaatatttgacgccgttgactttttttaaatatgtttgaccattcgtcttattaaaaaaattaagtaattattaattcttttcctaccatttgattcattgttaaatatacttatatgtatacatatagttttacatatttcacaaaagtttttgaataagatgaacggtcaaacatgtgctaaaaagtcaaaggtgtcaaatatttagaaacggagggagtataaaactttatagcatacattcattaacatctatatgaatatgaacaatgctagaaagtcttataatatgaaacggagggagtatgtcataagtgtttgagttagttctatgtcaccgtatccaattcgaagtgactccacccagcttaatccaaccggctcacaccaccttgatgctccatcccgcactgcgcgcctctccccgatcgacgtcttctctctctctctctccttttttttttttgctatttctccttttcttttctcccaatcatcatgtcctcttcctcccctttcaatctcctctattttctcctccttttctctttttccctcatttttcttccaaatttctctcctcataaatatttttttaaaaattatcattaaggtgtgtatggggcaagagtgttactttgcaaatgttttccatctacagttaaattcttttactaattgaatagtcaaaatttcaatctttgatcgatgacatatagcagaaaacataaacgtcaacttatggaatagccacccgatcgatttctgagactatggaaaggtgtacataaaagattcttcatgtgatgatgcatgaagcgagtgcaaccgggtttaatactatatatgatttatgactttgttttgtcattgttttgtttttttgtttgtcatttaaattggtaaagtttttatcaatcgtggaaattgtcttcacccgttgcaacgtacaaacatctttggtagtatgcatggcccctagtccaatttgcatctttgctaccgaatatgtttggtttctgcttccaacgttcccccttccccttctattaggtctaggtcggaagtcccttaaaaaatgtgatggccttttccacgtccaggttgaattacaatttacaccagatcgagcaatcttttgtaccctcctaactccatctccctcttccttcttgcttcatcctcccgccatcgccgcgagacatacgatcccatgaagcttgctcactcactgaaaggagaattaatcgtcctagctaagtgtaatatcccacatcgtacgagattgagtcgctaacgacgaagaagaaagcaaatacttgaagaatgggaaagggattctgatgtgaccatcaaatatatgaatacaaccaagtatgaatggacttgttctggttggtagccacgtcgcaaacgtcgcactcgatcaaagcgagagttatccccttattagaagatcgggccacgagagagagcgtcatcaaattcagagaaaagagggaggaggttgtcaacttacttcattttttctcgccaaatcctataaatctataagtgatcctcacttaatgtagttattacccaatttcctatcctgtagttcatccacgtcataaaaaaaacgtcaatcattgtatgaaatctcaaaggtttggatgcacccaaatcccaatggtatggatcagaacagtccaaacgagagagcccatgagcccatttgtacgtagcctcccgccccgcgactattaccaaaaacgattttcttgtacaaggagctctttagattgcagatagacagcacaaaatcgattttcctatacaaggagctctttagaaaattgattttcgcaggcaggcctcttaatggtccgcacgtaaaaataagcctatttttgcaggtggacctcttaaggggccgcatacgaaaatcaatcttcgcgtgcagacctcttaaaggcccgcctacaagtctattccccctcctatcttccctctcatcaatttcaaaatttttaagtcccattctttatctcctcacctctcattccacagccttatctcctctcccttgtcaagtgcgttgtgtgatagggtagctggccctcggctacggagctcgtagccgcgcgccgtgatgttgggcgaggttttccccctcagcaccgatagacagaggcaaagaggaagaatagaaagtttgtgatcaactccttttcttccaaattctgaatacaaacttaagtaggctctcgggccttaattcatggcgctaatcaaatcattgtaactaattattcctattactaaggatctgattgatccttctgttttcaaatccacgcgctaatcctgctcagccgcgcgtgatcgcgtatacggcgtcgacggcgcgccttcagtgcccctgatcttgcggcccttccttgtataggtgcggccccacatgacatctctccctccctcgacgagcagctcgtcctcgagctagaatgctggatagcgatccatgaaggtatccacatcttcccatgttgccgatgttgccggttctcccttccactcgatgaggacttgtcgcactcctcgagcaagccgcatgcgggtagcacgttcaggttctgggatggcagcaccgttgtggatggccagcagtggtggtcgtgcgtccggcggcattcccacaaacttcttgagaaggctgacgtggaacacatcgtgaagacgagtgcgcggtggtagtgccagccgcacggcaaggttgttgatgagctcattgacttggtaggggccaaaaaatcttggctttagcttgccttttgtgacttgaggaagcgaggccggttcgcggtggcgtagacgcagccatacccagtcactgacctggtaggagacgtcgcggtggtgccggtcgtagaaggccttttgaactgcttgtgcttgctccagccggtagcgtatgtcagctaggatcttgtccctgtcttccatgttgcgagctactgccgccatccgtgtttcacctggttcatatgaacggatggttggtgggtcgcggccgtacaccacgcaaaacggggtatcccgtagtgacgtttggtacgccgtgttgtaggtgtactcggcccatggcagccagtggatccattgtcgcggctggtcgccggtgaagcacctgaggtacatgacgatgactcggttggccgcctctgtctggccgtcggattgcgggtggaatgctgtcatcatgtgtagcttggtgcccatgagtcgcatcagttctcgccagaacaaggaagtgaacactgggtcacgatcggagaccatggactgcggtacgccatgcagacgcacaatgtcggtgaagaaggcttgggcaaccgactcagcagtgtatggatgcgccagggggatgaagtggcagtacttgctgaagcggtcgacgaccgtgaggatgacggatttccatcctacgcgcggcagtgcctccacaaaatcgaggccgatgttggcccagacagccatcggtaccggtaggggcatgagcagtccagccgggtgaagatgttctgacttgtacctctggcacgtggcgcatgccttgatgtagtcctgtaccattcggcggacgttggggatgtggaagtcgcgccggatgcggtggatggtgcgctgcaccccctcatggccgtcgtcgtggatggcagtcagcaactctaggagcagtggggaggacggtggtatgtatagacgtgcgtcgaacgccaccatgccgtctatcagtgaccaaggcgccgcgcgtgtgccggcttggatctcatcccccaaggccctgatggcaggatcggtatcctgtgcttgccagagtcgctcgacatagtcgaaccgtggcgcagagatggcgaggatcatgccgtcgtcggtgtcgcgacgtgagagggcatcggccaccgtgttcaaggcacccggcttgtattccacagtgaagtcgaacccaaggagcttgccgacccagtggtgttgtgggatttttgcgagacgctggtcgaggagaaactttaaactgtagtggtccgtgcgtaccaagaaacggcgtccccacagatatggccgccaatgcctaatggcatggacgaggccgatcagttcacgttcgtatgccgcgagagatcggtgtcgaggtgcgaccggcctgctgaaataggcaaccgggtgcttgtcttggatgagtacggtgccgaacccatgggacgatgtgtcgcattcgacgacgaatggcttggtgaagtcgggcaaaaccaggaccgacgccgatgtgatagccgtcttgagcgcctggaatgccgtggtcgcgtcgtcgttccacaggaacccctctttcttgagcagtgctattagtggtgcagctatggtgccgtagtcgcggacgaacttgcggtagtagcccgtcaagccgaggaagccgcgcacagcttgaacagaccgtggttggggccagtcacggacggcctgtaccttggcgggatccatggcgacgcaggactcggtgatgatatggcctaggtaggagatggaggagaccccaaacgcgcacttggaacgcttgacgaatagccaatgttgttggagagtgtcgaggacggcccggagatgtcggagatggtctgcccacgtgacactatatatgagaatgtcgtcgaagaagacaaggacgaaccgatgaagaaacggccgcaggacgtcgttcatcaatgcttggaatgtggccggcgccttgcaaagtccaaacggcatcaccaggaactcgtacagtccgtcgtgtgtgcggaacgccgtcttggcgacatctgctggattcatctggacctggtggtaccctgaacggagatcgagtttggtgaagaacttggcgccatgaagtttgtccagtagttcgtcgacgaccgggataggaaaagcgtccttaacggtgatggcattgagggcggtagtcgacgcagaaacgccacgtcgcgtcggctgtcttgacgagtaggaccggtgaagaaaacgccaaagagctccgacgaatgatcccttgctccatcatgaccttgcactatcgttcgagctcatccttgtgtgtggccgggtacctgtaaggccgaacagccaccggctgggcacccggggagaggacgatgctgtggtcgcggctccgtggtggaggaaggccttgaggctcggagaaaacatcagcgaacgcgaagagcagtgcgtcgagcaggttgtcgccggctgtggtggtgtggagtgatgtcgtctcctgtcctgccacgccctgccagcgaacttgacggtcgctgcgccaaaatgacatagtccgggaggcgaaatcccagagaatcggccccagagacgcgagccagttggtgccgaggacgacgtcatagccggccagcggtaagacgaataggtcggccgtgaaggtgtccccattgatgacgacgctgcttgccagagtacgctgaggcagggaactcgctccccattcgcgacggtcaccttcatgcgagcgcgtcggtgtagcgtcatggccgtgcgtgcggctgcgtcctcggagatgaaattgttggtggagcccgagtcgagtagcgccaatagggtcgtgtcgctgatcttgatgtgcagctgcatggtggcgctgaggcggatcccgacgatggcgtggagggagatgtgcggctcgctgtcgtcgtcgtcttgagactcgtcgtcggtgtcgtctgcagtttccagcaaaaataggcgctagcataccttgttgtggccgcggccaaaattttcgttgcagttgtagtagagaccgagtcgacgacgctcctccatcttggtctgtgacaggcacttgacaggacggccttccacgatggccgtcggcggctgagcgtttggcgcaggcaaggcgagacgtggtgccggcggtgggagccgatctcgttgttgtcggactggtggtgcggcgcattgcgctcgcagctccagtttgcgggccaaactcatggcgtgggcgagcgagttgggattgtgaatctcgacgtcgaggctgagcggaggttgtagtgcagcggtgaagagctgcaccttctgtgcttccgtgaggtggccggcgcgtggcagcagcgcctcgaaacggtcctggtactccaccacggaccctgtacgcttgcaggctgcaagttcgcccagggggttggaatggagcggcggttcatagcgcaaatgaagtagctcggtgaagcgacgccaagacggtgtgccttcctctcgctggacttgtatgaaccacatttgcgcaccatcctcgagattgtacgaagccatccataccttctcctcctccatgacgtgttgctggtagaagtaggactcgcatcggttgatgaaggcgagtggatcagtcttgccgtcgtaccacggaaagtcgagcttctgaaaccttggcggtcgatcttgggtgtgttcgcccgagcttgtcctgccgcttgtagacccagtgcactgattgttgaggagttgaatggcctgtgagtttgcctcgacggaggcttgcagcgacttgatggtggcggtgagggcttccagtgatgcttggatagctgcgtctcccatggtggtcgatcgctacggcgtcgttggagcggaactggagcgtggtggctgtggaggtggtgtagcgcggcgcggcaaggatggcctggatcgtgataccaagttgtgatagggtagctggccctcggctacagagttcgtagccacgcgccgtgatgttgggcgaggttttccccctcagcaccgatagacagaggcaaagaggaagaatagaaagtttgtgatcaactccatttcttccaaattctgaatacaaaacttaagtaggctctcgggccttaattcttggcgctaatcaaatcattgtaactaattattcctattactaaggatctgattgatccttctgttttcaaatccatgcgctaatcctgcttagccgcgcgtgatcgcgtatacggcgtcgacggcgcgccttcagcgcccctgatcttgtggcccttccttgtataggtgcggccccacatgacatccctcaccactaacttacctctaccttctcccactttccaacggcgaccgacggcgacggctcaggagatggagaggcgcggtggcgggcgtcggacccaacgacgggtgcggctgtgaaggcggtggagaggtgctcgtgcggccgccggatccgaagatggggatccgcaagaggctcggcctctagtggctggatccgtcgccggcaaccgtttgtagagtggatccatcaccggccaccacagggagggcggatccatcgcaggcaactgcaaggacgacgacggccggcctcgggcagggtgaagatgatgacgacggctaggttggcagcagtggtctcccgtcaacggtagcaccgaaaacagtgttagatccgccgtcgcggggcctcgggcggctggatccgtagccggcgaccacagggagggtggagctgtcgtcggcgaccgcggggactaccacggcgggcctcgggcagggcgacgatgacaacagttctgccggcgacaacgggaggtgcggatccgcggcgacgacgatgccgaggaggaggtggccgggagcggggtcctcggccccacaacggccgaatctgcgccgtccccgccgatgatgaggaagaggcgaacgggagcagcgccaccagcctagcgcgcacgtgcgctgaccagattcgcgcctccgccatcggattcccagggttttgatttttttttatttttatattttttttggatttttagttttccttccgggcgacataagcacccgcacgcgaaaatccaattttcgcgtgcgggtacaccacccgcacagaaaaatcagatttcgtagaccttttggcacagacgggccaggcttccacacatgaaagtaggttttggctcgcacagaaaaattgtttttgtactagtgtgccccccagctcagtaacgcatgtttctccatctcccgttctgcgagaaacagaaaccaccgccgcaaagttagaagacttcatggctgtcatcaagacagtggcatcatttcctcaacttcaagaaaccatattttctccacatcatgcccctcacatttcttctactaaggttctgaataaattatatttttagttttttactgctttgaccaagttaattgaggttctaaatgtagagataaaattatgaaaaaaaataccagtgagttgcagaggttgagtagcatttgtatgaatttttacatgattttatcttgcaccacttacttttaagattttatataggcttgacattacatatatgttttattgttaagatgcaactaaatgctaaataaaattataactagcttatgtatgaccttagatgttgttgttatgcttgatttctatctttcatgttttcataagttgcatgtatgcatattttgtgtcataataaacaaaggttaaggtgaaatatgaattatgtatgagtaaatgtaattatataattttgtattcatgagatgtattcaggtgaattgccaatttagatgatggattctaacatatgtcatgttgtaattttaagtcataataattttaggaaatgattttccatattagatgtagggtcatttactttaattactatgtgatactccgcactttgctgcagtattcatggatgagtatacgttaaatattgtcgaaatgatgaaagttgaaatgttgagaaaataatgtgtggaagatgattagatgcatacttgttgatctctataatataatattgtaaatgatgtgtaattgttagtgagtgaagatgtagcatgcttgcatggattttaaatgggtttgaatagtaattgctagtgggtgatcatgtggtatgcttgcatgttgaggtttagcttctaataattgttagtgtgtaccaactatattgaaacaatagatttgcttctagttttaagtaatgcacacgagacctattatgaagtgcatttaaaatccaaaaacacacaaagaactcaaatcacaccaaaacaatcatgcaaaaaatgcaagcacactctatgttttattttattctagaactgcaatggaaaggttttaagggcatgttcactttgatgccattttcaaccttaccaaattttggtaaagttaacaaaaaaaaagtggctacatttagtttgcagccaaattttggtaactatataagaaatcctaacaaaattttggcgagttgccaaaattgccaaaatttggtaagatttttttggcatcaaagtgaacaggccgcgcttaaggtttccggtttaggtggtaaacttttaggaaattacctaagaaacacacttttggttatgttacatccgatggcccacatgtcattctaaatcgtctgaatttgagccaatccactgccaaccgtcataggggccaacctataatctactaggaaaagttagtggccgaaggtggtggaggtggttcggccgaaccagccttggcggccccggctgcttccttgcacatggcagctgcccattagttggtgatggcggttgtggatgaaccgacctccacaaccgacattccaacaataattggaagctataataggataagctcactcactttccaaatgcacaacaaagtggagtacaactcatttttatattctaggcatcactttagtatgtggaattaggtagagagtgagggggagctccggaaggagtgtcccaaatgttgggtttgtcgacattcttccactggagtttcggagaagcactgaagttatcggctttcttctctcgcttgtacctcgacggatgctctttgaatgaagtaagtattcgagacgtctatatggtatttaatttatttgcttaagtgacatatattcctatctttgcgggttcctcgcttagtattattattgagtgctttagtactaggactcttaataaagaaggaagttcctgcacaatatagtagagtagtaatcaataacttagacatgctatctaggttagcggttatcttcatttgttgcgtactccacggaaagtgaagtagacagcaggaggtgatagtcatatccttcaatgttcaagtacattatagagccgtagtccggactctgcttggtagaccgggggagtcggtgcctgaagccatcgatagtttagtaaattaacccataggaatcatctatggcctaaacctaccattagttgttgtacttagataaagtactattcttacgctatacacatgttccctgtgaattaatactcttatctcttggaatactctaaggtaaggtgctacaatggaatccccatgattcagtacatttggaatactctgaggtgaaatgctacaatggaatccgtgcgcttgctgatttatttgtgagcgtatcaagtaccaacagtggtgtgttatttttgtattctgtgtagcatgatcctattctggtctagcagagggagagggaattaagttggggtcccaacaaaattgccttcaaattaaagtttgtggaatataccatcaagtagaacttgcacaccagtagcttaattaacttggcatacgagtagtatttataatattgaacggaaactaaacaaattaatggccgacaattaggttcgcggcgtaacaactagcgtaactgatataagctagtatcatatatgttgtcgaatagcagcagtatgtgaatcagaggcccatgcagtgtgaggttgggtggaattagagcctctcgccacgaatcctcctggcaagctgaacgtccttggacatgatggtgacgcgcttggagtggatggcgcagaggttggtgtcctcgaacagacccaccaggtacgcctccgccgcctcctgcagtgccagcaccgcgtggctctggaacctcatgtcgtgctgcacccaccaaaacatcgcaaaaatcaattaacgtacatacaagcatccttagaatagaatgaatcgatcgacataatttaaacgtttggttaccttgaagagctgtgcgatctccctgacgagcctctggaacggcagcttccttatcagcagctctgtgttcttctgatactttcggatctccctgcagttggagcaaaattacttcagtcttcatgagggttaagcatgtgatggtatggaaaacattgctctgaaattttcctcaaacaatttgcttcatcagagttcgatcgatacaacagaaagaaaacgcggagatgctggattgaattctattattgaaataaaggaacaaccagcgtgaaattagacgaaaaaaattgtgaatatgtatatacctaaggttacatacctaagggctacggtcccaggacggtatcggtgtggcttcttaactcctccaatgcacggagcagacttacgagcggcggcctgcatgtcgatcgattgtaatatatatacatcaacgcacgtgttggcaagcgaagcaaaaaaaaattatgttcggtaaactattaaataatgtattgtggaggtgaaggatatattgtacatgtatagcagcgacgagttgctttctaggcgcctttcctcccgtggacttgcgaacaatctgcttagtacgagccatcctgcagcaaaccatgcgcacgcatacacatatatagacaagaacattattcacacgttggctatatacaatagtaatacatcggctttcaagactcttataaggagagcaagcttttttttcatcgcacggaggggaaaaggaggggaaaagagatttatagatgtcggttttaaatgaatcggtttttatgaaccgatacatatgagagattttatagtagtgaagttagaatggcgagagagatctgaatttataaaccttatcccaagaccttgcaatgttcgcaataatactacccctatatatttaaataactttttttggtacttagcgtgcaactttaaccactatttttgaatcaaaacataataataataataataataataataataataataataataataataataataataataataataataataataataataataataataataataatacaaaaaatattataaaagtaaagcaaaaaatataaaaatctacccatatgatttttagttatgttttaaactaagtaatttgagagctagattgttgaagtttaagaagtttaaccgagtaaactcaatattgtcacatatttttatacggaggaattagccactcgttcacaaaattagaatggacacattacctgtcgagaaaagataaaggcgaatcctacaaaagtatttactccatctatttcaaaataagtttatttttagtcttcattatttgtggccaattaaatgaacctctatcgcttcgtctagttacctatccaccatttttatactatttttttactagtagagttattttggatagagggactacaaattagtacaattaaaaagatgcatgaaactttgcatcacatcaaagagctattgacgaagcaactatgcttgaataatcaataagtcaaaataaagctaattttgttataatatttgaattgagaactaagaatataaaacaccaagagaaactttatagagatcttgggaagctaacgtgtgcggaagaatggatgataactcgtacctctgacagttcgagggcagtaaccgctttgctcttcagggatggccgactactgatctgtttcttggtgatccggacggagaaagagggcaatttataggcagtcaggagggagggtttaccatcttgtgaaccgacttaattactcatgagcctttaacgtggggtcgtttgattgccgttggtttgatcggacggctaagagggttcgattaggtggtggcacggatcagtggtgatacatactgccctcctattggctgtcgctagtagcacaaggatccctgtgtagtaggggtgaaaacggagcggatagtttccgtccgctccggtcaaaaacggatacggatagtgttcggagcggatttttttcggatagttcgaatacggatacgaatacggatattttttctccggatacggatacgaatatggtaacgcagtttccggcgaatacgaatacggagccgaatatccccggagattaagatgcgcggatatccgcgtaacgcttgatgtctctccagcctccagcccatcccttcaatttcagcacatagttttctctcggctatctaaaccctagctgccagatgggcgacggcggcggcggcggtgacgacagcagcggcaagccggcgacagtggcggcggctgtcttagatctccttggctccttgctggagttgctgggcattggccttcaatccccctagtgcttgtttctgcttcctatctccctaaatcgtgggacagtgggaggctaggagccgttaccaccgccggcggcaaggcctcttgcatgcactaatctcttaggtaatccattgatttgttcttctcctgtaacctttgttttgtgcctttcatgagatcgataaactgatgtagatcttggatgtgcttttttttactttgtgtctagattggtgatggagtctggtagtgcaagtagtgcaagtgcagctgcaagtaccactgcatcatctccagttttgcaactcccagcacctccaagccatgctacggcagctacgcaggacacttctcctactgctggtgccttggcacacaatgatgcaattgatttgacaaccaatgatgattctgaggttttacctcctcctggtaagaagcaaaagaagtgtagttctgaagtttggcagcactacactaaatataaggtaagcaagaaagggtcagatgacactgtgattgtagaggagtatgctaaatgcaacaagtgctcatataaacgtcggtgtgagagtaattgtggcacttctgttttctggaatcacttgaataacaagcacaacattaagtcaggtcaacaacaactacagatgaaaaagagtgaagatggtactgaaagagctgttgagacatacaggagctgttgagacatacaggtatgatgagacggttagcctgaaaaagttctatatggcaatcatcatgcatgagtatccctttaacattgttgagcatgattactttgtggattttattaagtctttacgccctacttttccaattaagagtcgcattactgtgagaaaggatattctaaacatatatgaagaggaaaagaagaaattgtggcagcatttgcttacactctcatgccgttttagcacaaccatggacatgtggacatctaaccaaaataaaagttatatgtgcatcacagttcattggatagaggacacttggaacatgcaaaagaggatcattaagtttatgcatgtagaaggacatcattcaggaagtaatatgtgcaaagagttttatgacaacatagttgattggaatcttgatagaaggcttgttggacttactttggacaatgcatcgtctaatgatgtttgtgttaagggtgttattttaaaactccgtaaaatctctcctttaatttgcgatggcatcttctttcatgtgagatgtttcaatcatatcttgaaccttgttgcacaagatggtctgaaacaaatcacaggagctgtattaaagatcagaaatactatttcaattctaaagcactcgccactgcagtttgaggcatttcagaagtgtgccttggaagttagtttggataacacaaagggcctttccatggatactcctacaagatggaactccacatttctcatgttgaagaatgctatctactacagaaatgcttttgataggttgtttcttcggcatggtagaaagtatgcaaagtgtgctcccaccaaggtagactggtctatggcaatagcactatgcaagtgcttgaagccatttcatgaagcaactgaactattctctggtactacatatccaacagcaaatcattttttcggtaagttttgttccatcaagctttatattgttgattggtgtaacagtacagatggaacaataaaaaccatggcaaacgccatgcaaactaaatatgataagtactgggagaagtcgaatatggctcttgctgttgcatgcttccttgatccacgttacaa

SEQ ID NO: 38115 - DNA, 10512 bp, Oryza sativa
tttgatgagttcaatggggttatcaaaaaattgtttgatgtttatgctactagtgcgtgtgcaacatcaaagaagaaaggtgctgaaatgcatgtgcatcaacttcaaattcaatctgatcctgttcataatactgatgagtttgatgatatctttaatgagaatgacagtagccatgatcatgagcaacattttcaaagatttttgcttgagagaagtcagccaatttgtagtgataaaaccgagttacaaatttacatggaacaaccactgttactatggacttccaaagatccatttgatattttgtcttggtggaagctcaaacaagcagaatttcctatcctctgcaaacttgctcgtgatttcttatgtattcaagtgtcaactgttgcttctgagtcggcatttagtgctggtggccgtgttgttgatccatttcgcacccgtcttgatccagaggctgtgcaagctttagtttgcaccaaagattggattaaagcagctaacaatggtacactttgtgtctgtgttcattgcttatttggccattccttcttgtatatatcaatatatgtatagctgatccatgatctgatctggcatcattcttaggttataagactcaggctatcatcaatgagttggacattgaaagcgtagagaggcatctggcaaacttattgatagtggtgagctattttcttattttacctctatgaatatttttcttaatataacaataatattattcgactcctgtaggaaaaagaggagaataatgatgacatggaacaggatgatgttctgatggatgaaatggatgaataatgatgttgcaattttcattcatcggactgcaagtgtactgaaaattgctttgggctgattactattttgatcttatctgtgttacctatagaactcgaactcaatatgtgttgaacttttcaacgtgtttcgatttgaacacgatacactttgtttaatctgtgatgcgtcctacaacgatgatatttatattaaattagataaatatatgtggtgcatttgtatctacgagcagtttgagtggtctctatattccgagaaatattcgttttcgtattcgtgtccgatcatattcgatccttattcgtatccgcgataattcgtattcatttctgtatccgagttattcgtattcgtttccgtatccgcctaacaatatgaaaacggatacggtaagagcattatccgtccgtattcgctctgttttcacccctactgggtagccctcctattggctgggtacgtagcttgtcgaggaattatgggatctccatcttcaaaaaagttgttttcctttttttttatcgaggctatcgagagagactaattaagatattgcatacattcatacagaacaattgtgctattttataccctaaaatcggtactataggtgccggaacagctaaacccaccggtaatgccttttcctcctccgcggattaaaaccacataaacccggcacatttaaacaaaccataggtgctggtttttaaaaaccgacacctttaatataggtgtcagttaattacaaacaaacaacattcataaattcataaattataggagttggtttttttaaaaaaaccgacacctacacccaactgagccgaactggtgagctaagcatcggccttatccattccacacgtctttatctctctcttgtctctctctctcacctctctcgcttttctctgtcacggcggcggcccaaggaggtgctagcggtggcggcctcaccctccccttcgccagatccagcttgaggggggtagcgggatgggaggcgacggcggcctctggtgatgacggtggcggcagccgtgccctcccctccaccagattcggtgggaggggaagcggcggaccacggtgatggcagcggcagtggttgtgccctcccctctattagatccaacaggaggggaggccacagtggtctccagtgacggcggcggcggcgcccgcactctcccctccgccagctccagcgggaggggagacggtgcaccttggcgacggcggctgcgccctcaccatgttgcaacgatggcaagggtggagaaggatgtcggctgccatcgtcttcttgatgttaatctttttaatgttcatcgatgttgttgatgtttatgtgttgatgtgtgctttaatcttgtatgtattctttgatcttgtcgagatgaagtggagctgctcgatagatcggctcgaatcgggccgatgcattgagtcgttttttctttgttcatggaacctcagaggtgccgactaatgtgtaccggttgaaaaaaccgacacttttagctatttctgtactaatgaatattcatcgtatttctaatgaggtgtgagacctaacaaactaattagatgaagatatagtgccttctagtctcccatcttttcatccctatcaaatagccttccttctaatcaaactggcacctcatatgtatgcatgcagtgtggtcataaaataaggttatattctgataatttgtgtatgctgctaatccgcctctaatcttctagaaatgtaactgttctgggatggaggtagttaataaaaaatattaggattcagaaaataatgttagtatgttaaagcactttcacatatgcaatgtggtcataaaataagctcataatttgtgtatgttgctaatttatctctaatcttcttgaaatgtaattattctgggatggaggtaataattaataaaaaatattaggatttgacatcagaaaataatgttagtataaactaaagacgatgtgggatgccgtagagacaagacggtccggggtggcacctaagagtgagaaggaggagacaggcgggaggcttgtgcgatgaggaaggagcggggagccgatctgcaagggtgagtgggctgacgtgatggggccacggcgtcatgtagcgaggttggtggttggcaaaagaggacgtgtgaaggaaaaggtgtaggagattgatttgcgtatgtgtagatcgaaactgagtgatgagcacgtgcgtgattttctacctgggtgaccctgtgatggcgtcatagtggagaggtggggggtggtagtctgcgaggagcagcgatggcagcatagtagagagcggcgggcagcaaggtggagacagatttgtgaggaggcatgatggcggcatggtggagggtggggtgacgtggtttccgggttggtgcaatggttactgctagagaagatatgggagtgaggaggggaggccgagaaaaaacatggctgaattgttggatttggtgattttgggatgttggatttatttaatgaatggatgaactatacggatacgtataagatacagtgtatgtaagatgaatgatataatatgtaaatttaaatctctcatattatatcatgatagcacacgagcaccggaatgaagactacaaaataacacaggagcagaaaaaataacgtgtatatacattcacaaatataatttaaggtcattacatgtaaaaaaaaaaaaaagccattctcatttcaaggctccccacctcaaacctgaacctctggactcaaaacacgccaaggggggcattataaatacgtcctttgtacaaacagctaataaatagttaatttacaagcgctaaacaagatagtaaacatattaacttagagagcaaaatgcatacttacaatatgaaataattgcaaggcgtcttgcagacagtgggcagtctcctccattatggatacgagtgatatgactatgcttgctcagcttcatccggccttgaccacgcgcagtcttgcacgatgagattgatgcctctgacccatagctcgacgctggacgcggaggtggcctcgaagtggatctccctcccggtcaccgtctccaccattaggatcagctgctcctcgctgcccgtcctgatgatcctcctgttcctcctgaacgccgcgctgggccccgcccgggcctccctgcaggccacgttcctccggcgggtcgccccccacgtcagcacgccggaccgcatcatccgcaccgccttgcggtgcggcggaccccggcccccgcgcgtgtgcttcgtcagctcctccccggcgagcacgtgggcgcgcgccacgtggtccagcagccactcctccgtcgccttgttcgacctgccgctcctcctcgccaccgacagcgccgtctcgctccccgcgtcggcggcgccgccgcgcgacaccagcgccctgcacgcctccagcttgcctgcggcggccgcgtgcatcagcggcgtgtagccatcctcgtccatcgcgttgggatcgtggcccatcttcaggagctgcgtcagggaggaggtgtcgccgatccgggccgcgtagtgcaggggtctgaaagatggctgctggcctgcgatcgcatccgcgagcgaagcctggagtaagatctgttcgaaccgatcttggttcaggagctctgcttcggatgatcgacatcgcggatttcccttcggcactcgtggcagcgatatctgcccccgccatcactagaagcctgaaaatgtcagcatggcctgactctgcagcaaccataacaggagtgagccctgaaccatcaggcctgttcagatctgctgctgagtagtgtagcgtcattagaagagcttctgcactgtcacttgcagcgaagaagtgcagcggagagaagacggtgatatccgatgaagtgatgcagcctccgcaactcaatgctctggaaagaatgtcgatgatggttgagctaaatgagcttttcttagcaagcattattgctgtgtcacctgcattgttcactatcccaaggtctgcccctgatttgatcagttcaagaaagcaatcggagtgtccacacctcgcagagaccatcagaggagtgtccccagtagaagtctgcgcattgatattagccccatccaacatgagttgtttcagtacgggcgcatgacccaaccttgcagcaaaatgtattgggtaggagacgtgtgtgccgtttgtcatcattatgggaaatctgggattggcaccagcatttagaagcacgcttactgcattcgggttctgacagagtatggcatggcaaagaagatttcgacccttgcgtggggtttccagcaaccatggtgctttatcgagcagcaatttgaggatttcaccactgcattcgtagtactctactgcacaccaaatggcgttgtatttttccccaaggcatgcaccaacacgaagttcttcacccgttgcagagtcccaacaccaagaaccaacttgcacaagacagtccaagtaagagccttcctgcacacaaattttgatacaagtatcattctaagaatgtggaaacattctaaattagcatagtactcataaataatgtggaaaattagactgcctaaaatttcgtttactgaaaaagggacggccagtgcgtttagcatactggagtggaaacaaatttggattgcttggcatacagaacataaacttaatgggaaagtagtcggagaaacaaaaatcatccagacataatgcatccccacttgtcatatatatggctgccttgaatctacagaaatggttggaattgttgcaaataaaaaaaaatgggtattattagataatgagtttttcttcaaataaaaacagtgagttaagtaggaatggcaatgcacaactaagcattgtgaacagagtactacatccatctctgtacctagactaataagaacgcttaaaagatattcagttattgcagatacctcaatcaagagtttcacagttgaaatttgccggctcattactgctgccaccagtggagtgcaattcacattagcatgtagtgcaggcttaacagacctcaagaggaccctagccatggaattaacgtcaaccccattctgacaaaatgaaagtgaaccagtaaacacacacatatatatatacacaagaaaatgttatctttgtaactggctgtatataactgatatcatttgatcagacctgcagtagtatgaccacaacatcatcaaagcctcttgaagaagcagtcaccaaagcatgtgctgcagcttcaggctgtatcatctctgaacagactaatagccgaacggcttcagcctcagcaaaaagagcagcctctgatagggaatcttcacaagcttcccgagtgactccagcctgcagaagcatctctagaatatggatgtttccttcacgtgcggcagctgttgttgcatagcctagaaataacttttgattaacatcagctccagcaacctgtattcaaatatcaagtcaattactccatgaacacaattttagagtatacataattcataatacaatatatttactaagatactgaataattcccggctgtcctgttaagcacaagcgtcttcttttcgtcttctagatcttatctccttatggctcactcgtgccggcctatacatcattcgatcagtttttcgtcataattttcgtgagaaagcaattgtaatgttatcagatagtttgaacaaaccaactctagttagcactatgcaatattttcatcatgacacttctcataactgtttagaactgactgactggctaggtctgttaacctgataaacctgtctttaggcatgtctatgtcacatatatctagatactaatacggctccaatatatatgcaggaaacaatcgaatatctgtattatatgaaagaatctaatggtgcatgtggcttctaacgatgccatttatggactgatgaacctaaatcaagacaacgagagtacgagacaatatcagcattatgtcctcagtgcgacctcgttaaacctctacactgaacctagctatttctgtacctcaaataccgagcagtatacttttttacaacttgatacaccagccacctttccaccacctccactctaataatcagccttaaaattaaagctactgtagttagaaatattccagctatttatctctattagaaggccgcttaaaattgccaggtttgacattcctatagtatgctagctatctcgctctagtataaaatctcattgcaaacttaggtccctttttttggcttatcatgtgaaggttttcccaagttcttaattaatggtacgttttcttaaaagtttttctttaccagcatttcttagaaaactttttttagatgaacattttaatattcaattcattcatttgtgcgctggaataattgtcataaactcaggtttagccatcatccatcaactatatcaaacggaaccgtgcacctgatacatatcttattgtgcggttcctgtattagcgtataaaatatacatgcatgttcaatatacgtgtaaaaaatatatctactattatacttcatatgccaaataagaaagccttaaaaccgcttacatggctaccttccccatgagctctacgaggtgaggtgaccacacgggactccgcttactacctttttagaacattatcatctataatattaaagcacatggataacaaaaaatatttccctctaaaaattgggcccactttctcagtaaaatcagcttagagttaacaacagtaaaatctgataatttatatatagcaaagcttggaaaatatactactgagaaattgcttagcttcccaatttccaaatttcgagaatgtgctcaaggtgagttgtgatgtatctcttgtgggcattggacctgtggtaagtcaatagcaagatctgccatcttctcaaggacactgttgaatgcaactactaatctacctaactttgtaaggggcttcacagaacaggtccaaggaatcccatctgttttgtatcacatcaaaggtttgaagtccacttcaggcacttgtatagtgggggcactaggaaagatttgagcatcggaacaccaccaacatgaaaaaactcataaaacaacatagcttgtgatgagaaaaacatttttcattaggcactgcagagttttagccaaggagtacatgctagtcaaattaataagtgatatagaagtttcaaagtggaaccgaagccatcacattcttgtcttgaaaacaaccgaagaagattatccatcccattccagaagggagagcagttgccatcacaccataccaaaaggtgtaacaagattacccatgtccctaatcctaactcaattcagtgatatgcattggcaaacctgctaatattctataaaccaccattagaatagactgataaatctctccactacagtaataattttaacaggaaaagaaggggatctgcaacagccattcgtttgaatggttttagtttattcttaataatttagatcagaaaacactcattcataatttgtgcgaatttattttggattactatgaaagggtacaagtcatccagaatgtttttttactaatcattacttccaatttattcagaattccctccgaacgtacctactgaacaaatttgaaaattttgtcatgacagacaatgcgcacaaattatttcgctctaaaaatatttggtcagatgattaaacccttggagattgaatgcgaggggattcaaatcttggaaagtgagagaaatgaccagtctgttgacgaaaatttggttacgatccttaccaggagggtgcgaacaacttcggcatgaccggcgtgcgcggcggcgaagagcggcgagacgtcggtcttgagctcgcgggactccacgatcacctccccggccgcctcctcgcggagggccacctcagcgcacctcacccgcaggcgcgccaccccgacgcggctcgccgcgggcacgccatcgtccgtgtcgtcgtccgctgcggcagcggcggcggcggccgccaggcacgcctccatggtcaccacgtccccccgtagggcagcctccacgagacgctgagcgggcgacgcctcctcctcctcccgcgccgccgccgccacagcggccgccctgcgccgcgacatggccgccaagtgtgggaggcggcggcggcagcggcgtctaggtggtggcgctcgccaggtgtttgcggtgtggtcggcgaggagagcgaggaggccgctggtgctgcgtggctgccaacgttcgggtggcgaggcgactggcgagactttggggagtaggtggaattcgaagtttgaaactagtcgcactggtataaaagtgcaaacgcgtgattttctgaagtaaatatctgagtcaaattgtttttgttttttatttcttgaatattatttttaaaaacaagccccgttcaggtctagaagcttttactagtgttttttttaagcaatttggcacgctttattaatctgcaaacataattacatcgttcactataatgttcagctagaaaattggagtctcatcaatccaattataagaattcttaaacttaaaagtataattagctacaagcctacaacatgtgccacacaatttgcttccctattacaatgctcaacagagactttaacaaaatcatatatcaaaatctggcattcatataaaattgccgctgccgtagttgcttaaaaacctccatcttgcatcgtctccaccacctgcaaacaatctgattgagtaaatagtactccctcattccctaaatatttgacaccgttgacttttttaaatatgtttgaccgttcgttttattaaaaaaaacttttgtgatatgtgtaaaactatatgtatacataaaagtatatttaacaataaatcaaatgatagaaaaagaattaacaattacttaaattttttaaataagacgaacggtcaaacatttttaaaaaaatcaacggcgtcagacattttgtgatggaggtagtatcttgacaaccaatctgctgggcgaggatgagtccatccctgaggacgtaggcttctgccattgctgcatcagcaacatgagacaagtacctacaagaactagctaaaaaattcccttgtgaatctcgttgacagctctggttcctcctgtactcgagacgatgtcaaaggaagcatctatgtatacgagaattccttcaggaggtttatgctatccttcccatggttttgcatccgactttttcttcgccatcttataatttagtgttagagcaacaatagatctagcagccatctgaatcctttcaccattcactacttgtcttctttcccaccaaatgtaccatccccctgttaaaatcaattcagcaaagcttttaccagtgtttctttcagaacatgtgccattcggagtgagagtttcaaacttatagtccctcgttttctttgtacatgcttctcaaaatgctaaatgatttttttagaataaaatagaaaagttgctttcaaaaataatattaactacttttaaattattttaagctaatacttaagggactacttattgatcttt

SEQ ID NO: 38116 - DNA, 2109 bp, Oryza sativa
tgattagggaccaaaccaagaacttctccaagtctacttctacctcaccacgtcacttttggcccatagaagacaagaaatcaagttgtacacgttttgtattcggattcgggcctcctgacagcatcaacttcaaacggacctagccactgatatagaaggagtttcgaggcccatgagtacttgttgaaaaacttatggagtctactttcagatggttttggtcccatgtcaaaattcctaccaaaactgccgggaatctgcaaaacaagccacgtacctcatccagtccgaatctgatttgggtgttgggccttgtaactgtgtcgtgggcttagcccaaggaggtgtgcgccctaggacaaccctagtacgtccctaatcatattaaatcagtagctgtcatcgtttagagtcgggttttgcttagattaatctgttaggaatagtttcgccgctacatcggtttgtggaaccccaaattcgagtgtttaatcatccatatgcaatttggttgcaatctatcttgttcttgcttgtgttcttcgattcgcatgcagggattagccttctcggcgaggtcaaccgggtttcggcatggttgataaccagaggagacgtggtgctgcgattgcgggactcagtagcatgtttgttcagaagccggatcgagttatgttgcgattccgcccaaatcgactgtttatcaatagctatcggaagatcgggacctaacaccctcatcagttggtaccagagcgtggttgcccgttaggtaatttatcttcccgtaaccagaaaattgccacacaaaaatatttattctttacctagacaatttgagccgttgcattgttctattagattttgcgttgttgaattatagattgcatcgtcgtatcgagtgctggtttagttttagatttaatttttagttttgagtattgcatctgttcatcactttcacttaggtgtagggttcgtctatgagttgtacgtcagttttgggtccagttttgtatttcgtcggttgttgccgggaccttgaaaaattgaatcgtctcgtcatcgagattccgtttttatacttttgagaagttttttgtcggtcaagtttggagttgcggctagggtttgcgcttttgccgaatttccctttggccgtacccctccccatctgcaactaccacctccccctcacgactgaccacctttatcacattgtttggtattttggtggttgtagatttgagatatttttacaaaaatggaacctacatgatgtgagcattccatttttgaggtgatctaattttagttttacactttgcatttgagacccctgtaatatttatatttacatttgagtccttcttcgaggtcagtggttcaattcttgttgaaaaaaagtaaaaaaataaaaaaagaaaagacagaaaggtgcaaagaaaaaaaaagaaaaaaaaagccgcacctaaaaaagaaaaaaaaaggcataaatgtgcttaaaaaaagccgcaccaagaaagaaaaaaaaaccattcatccttggagtatgttttcagagtgcagagttgtgcattgattcatatatagtccttagtgttgtcgggtgcttgcttgagctagagttgagtctagactaggccagcacattgactagtactttgaactattattcaactttgcattttctgattagtataattgcgttcctttgctactatatattgtgcctcccaagctccatatatattcttctggtcagcaccgctttgatccttacaatcgccacatcacgttcttcaaggtgtcacaaactagccactggttgtaccatccttagcattgctggtaagacacttgtaagagcttggtaaggtgctctatttggctgagttgttgaggggcatcactacaccacgtagcagattattagggataaccttcattgtttgttgttgtttttgtgtttgcaatgatatgtatgagtggcgctcaaaatcagtgataccaacaaggtgcacgtgatgatagtactttggtgcaacaagtgctaagttctcaactggagaaagcggagcaatggcagtaccacgaattatttga

SEQ ID NO: 38117 - DNA, 797 bp, Oryza sativa
gtaagtagtagagaaatggaaatgggatcagatgctgaattgaggaaaccccacgaacgccacgaaatcagtaatcaacgctccaactcagttcttgctccaattccctcttttgtgcaaaagctccaacttatccggactagtcaacagttttacctgaggctgagggagataaacgttcaaatgttatacagaggctgactgcattactcgagagatgcatttaaagaatcacttagcaccaccaaaatttatatttagtcttatctgtgagggactaaacagagttcaaaacaagtgagtccagcaggttatatacactcatcttcagaaagaactaaccaaaattcgtataaaatggtaatgaattagtcttgaaatattatgttagcatcagttgcaatggcagatcgacggagtttgacatccacaaacattttagcacggctataaaaatatgttatccagcttggccactacgcccaatggatggttaacacttctcaaagctgggattgcaagaacatggctccataacaaagctcattaaccccacagaaagaaagctcaccaaggaaccttctatttgtcctgaaaagacaaacgtcgcagtgtaaatacaagataatgaaaaaacggcagacactacattttagccatatgtacttacagaccaccaagagcaccttgaatctgttgtgttaaaattagaccacctagagaaccttgaatctgttgtgttcaaatttgtgattttcattgtaagctatactcagtgcacagctctaaaagtgtat

SEQ ID NO: 38118 - DNA, 9821 bp, Oryza sativa
acaagctaagaaacctggtcgtctaaccttactggacctttgggatctcgtaaagggacttgaatgcaatctagaacttcgaaaagacatggaccactccaccagctacaattgcttttatccattcttgtcttcatattagtccccaaaagaccagagattggcaagaagtggacatctgaaaagaatgccagaaaaagcaaggtaaaagtaatgtattgtggataattccatcattatcataaccacagatcatcacatcattgttattaccacactcagttgagcaagggctccattcaacaagtgctggatataatatatgacgctatgtcaacacccaaaagccaatctctaactagtaaccacacgaataccaaaaagcttattttgtttggacaaagaaaacatatgagtttcttttgattattatatgtaacatttgcaggacacaggaaacatcataaaaagcatatcatatactccaaatgtatccaaaaatagtgcttcgtgaataaactcccagcatttttagtataattagggctaaattaggaacaatcacaaagctaaacaatctaaaccaggaagtcaccaaataatgggaaggaaaactatggaatgttacttactaaactttttgcagatggcataataggcaacaataaagaataatattcctgtcttagaaggaaataaccatgtagatgaaagatgtcttaccatgcttagaaaaagaagatgtgaagcttcaactttgtgataagctaaggcatcaaagatttaacaagcaatgaagcaaaccacaacagaactgtctaataccccatcctatttgatcttttgatttctacaaaactagccaaatacccatgcgcttcaatgtctacaatgtgttccatagattctaaacttggaaaatgtatatatttttcatttgaacatcaatcactaaataattctattacaaatgacatgcgcaaagacataacttttcagagaagattcttggattaataaagcataggtgcagcgcggaccgtggatggtagactcatgaccaccactaacttctttcataatagaatagaaatttcaaattaaattgagaaaaatgaacagattttgtgaagagatatctccaacctaaaattaacgcatagagaaaagagtgaaagatgatcccattcataattatatacctttcttaacattgtaccctgatgatttaagaaaaggaaccatttttccttctatttcatcatatctgaaaccacataagtgaaataatgatttttctttacccaacatgcttatttaagaggaacaaattcttctcagtggatttgttatcaatgtatataccgttctttcgaccagccaacagtagattcatccatcttatttatgaccacaaccaacttagaaacacccaaagtttttgccagaagcacatgttcgcgagtctgcccgcctctttcatacccagtttcaaattcacctttccgagcagatatcacctgagggaaacaatgatacattcatattatatcccagcagaaaagacggtaaatatgatttcgaaagattgcgccactgcttacaagaacaccaatgtctgcttgagatgcaccgcttatcatgtttggaacataacttttgtggccctgtatgtcagaaatatattgaatacaacattatataaaagaacacagaaaccattataaaatggatcaaataatcatcagaaagtagcatgtcttgtaataaggtgtaatgacttggttagcaaaaacaccctgaattgttgctactttgctacacaaaggtgacactcaaaaatgagctgtacaagcatgaatgaagacatagtttcagtcaaacaaacagagcaacaaacacatacaatccctataaatcaatcctaagaccagtttgagacggacgtaaggtaccaaggcagttgttgcttccacatgaacgattccaattatttcaaaagggggaaaggaaatacatcaccattttatgtttaagtcttctgcttatctaagttttacgttcaagttatttaaatgtatgaaactatcttaaaatatgatagaatcacaacagttgctccataaagcaacacaaaatctgtttcaaaatattgaaatataaaactatgaccttgcattactatggtatatgtaaataagtacagtatatgaggcaaaaaaaaaatttaccggtgcatctaaaatggtaaatcttgtagtttctgtctcaaagtgtgctctcccaacttcaactgtcttcccctgaatagattcaaaataacacattgtaagtacaataagtgatatttgacagaattattcaagccacgacaaaaatcaaatttcatgaattagaagtatgatgacctagaagcaggattggagctggagtatccatagacaccatttaaactttgttggattcggaaatgtttggattttagttatgtaacaggcaggccatgaccattgatttgcatggttcatattactggtctatccaatgatccaagaaaaacaggtgcaatgatgttacccaataatccaaacccaaccatcagaatataagcaagcagatggcagcaaactcttgaaggcagtagagagatgaccacacaagtaatctcaagatatcacatgctcatcactgtcgaaacaggatgtgggagtggccatcaaggatcatcagtactggaactagaacaaaccttaggttccattttgatggataagtctttgtggtccttggtcatggttctttattttgcttttgggtagtttcacctttttcaggacagcatcactccttaagcatattttcagttgctaggacagctgcagttagtaggacagcagcagttagcatctcctttatatctcctttatgctttattaagtttggatgccctctaggacagcatcccattcaaattttgaattttagactaggagggtgcagcaataggcttgcagccagctatggctatatatatgtatccaacctccctcgggttggtatggctttgagtttgcgaatggaagaaaactagaaaaattgccccatcttgagtgccatcctcttatcaatgagagtaaccattgaaattctaacatctggtatcagagccacactttcctgtaggctaaacatctactgttccaccccttcccaagctcggttgagctctcagccagcagcagcagcagcaccggctgctcttccttcccctttcccttccccctctccacgcagcagccccccggaggcgcgccatgtccgatgttcggtctcggcgttcggtcgcctcgagcactcggcgtaagcaggacgccaagctcgccgcagcagaagagcacaggcgagcaacggctcagaccgctgcagcagcagcgagggcggccagactggcggcagtggagttggcagcagccagggcagaggcggaagcagaggcggcggaagatgcggcacgtgcggcggaggtagaggttgagaccttgcgcagcaacatcaacggctccatcggcgacatcaccgccgacagggagcttgaggagctagcaagagggagggcgcgggagcgggcagagcgtgctgcccacccccacggcggcggcggcccaagggaccgcgcgcccgccgatgggaacccagacgggcacgggtgtgccggcggcagcccggagcgcgcgcgcggcggcggcgctccgagtggaggtggctggttcgacagagagcgtggccctcgcaggcagcgcggctctccctcccctgaccggcgccatggccaccacggcgtccagacggtggtcagggactttggtcccggcggttggtggcctaccctcaccaaaaccaactatatcgagtgggccgcggtgatgagggtgaggctccaggtgcggcacatgtgggaggcagtccggtacggcgacgtcgactacgacgagaatcgacgggcgctggatgcccccatcgctgcagtcccgcccgagatgcagttctcgctttcccaaaagcggactgccaaggaggcctggcaagtccacactgcaggcactccgcaaggagtgggagaacctggctttcaagccaggtgaggatgttgatgactttgccctccgtcgcaacactcttttgcagaagatggtgcagtacggcgacaacctatgatgaggagagagccgtcgagaagctgttccgctgcgtcccagagaagtatgggcagatcgctcgctcgatcgagtctctgctggatctctccacgatgtcgatcaaggaggcgataggtcgcctcaaggtcatcgacggccatgagccacagcctctctcggggcctatcaccattggcgggaagctccatctcactcgggagcagtgggaggccagccaaggtgatgggaggaagggggagtcctcctcctccccgacgggcggtcgcaagtagcgcatggcatgcggaggtgtccagctgcggtgggcgcaaatacgtgccgagggtggcgcccgcagaggcgcccagggcggcgccgccggcaaccacaagccagcacgagacgacgcctaccgcaactgtggcaagcttggccattgggccaaagactgtcgacagccacgacgcggccagacccacatcgcataggtggaggaggaagagccggctctgctcttggcacacgcaagcatcgagctacctccggcggcaccggccgcaacggctttcctccaccttgattagctgaaggtactcgtctccctctgcaacggctccagcaacgacaaggctgatgggtggtacctcagacaccggcgcctcccatcacatgaccggccgacgggagttcttcatcgagtttgactccagcgtccgaggctccgtcaagtttggggacgcctccggcgtggagatcaagagcggtggctccgtcaccttcaccgccaagtccggtgagcacaggctgctcaccggagttcactacatccccgcgttgaggaactctatcatcagcgtaggacagctagatgagaacggctcacgcgtgctggtcgagcacggagtcatgaggatttgggatcgccgtcatcgccttcttgccaaggtaaacagaggcactaatcaactctacatcctcagcgcgcaggtcgcacaaccagtttgcctcgccgctcatcgggacgacgaggcgtggcagtggcacgagcgcttcgggcacctccactttgaggccctgaagtggctcagtgccaaggagatggtgcgaggcctgccgtgccttgaccacgtggagcagctctgcgatgtctgcgtggtaacgaagcagaggcggctcccctttccacagcagacgagcttccgagccaaggagcggctcaagcccgtgcacggggacttgtgtggtccagtgacaccggccacaccaggaggacgacgttacttcctgctgctcgtcgacgacctctcccgctacatgtgggcgatggtcctcggcagcaagggagaggctgcggacgccatcaggcgcgcgcaggctgctgcggaggccgagtgcggccgcaagctgcgcgtgctgcgcaccgacaacggcggcgaattcacggcagctgaattcgcgtcgtactgtgctgatgagggcattcagcgccactacaccgcgccgtacagcccgcggcagaacggcgtcatcgagcggcgcaaccagacggttgtggggatggctcgggctctcctcaagcaaagggggatgccggccatcttctggggagaggcagtggtgacggccgtctacatcctcaaccgttcgcctagcaaggcactcgacggcaggacactgtacgaggcttggcatgggcgcaagccggcggtctcccacctgcgggtcttcggctgcctcgcgttcgccaaggagcttggccacatcggcaagctcaacgacaggagcaccccaggggttttcatcggctacgcggagggctcgaagacctaccgcattctcgacccggagaaagcgtgtgcgcacggcgcgcgactagtgttcgacgaagggcgagggtgggcatgggacaaagcggacgatgcttcgactctgacgtacgacgacttcactgtcgagtatgtccacttcgagggagctgggggagtaggcagctcttcttcaccgagcatgtctaccccagcccccgagcctccactgactccggcagcgacacaccctcgagcaacgacttcaactacgacgagctcttcgccgacaccaccacagtcggcgaccccacgcactccagcaccaacagccactcctccgggcacgtccaccccgacgccagctcgtgttgagcacagcccggtggagttcgctactccgctctcccacgacgaagagcgcatcgacgcgtaccacgacggcgagctgctacagtaccgtacgatagaggaccttctcggcgaccagccagtgccgagactggtgcctcgcgacctagaggtgcagttgcaccttgcgtgcgacgacgatgagcctcggtctttcgcagaggccgagggacacgaggcatggcatgccacaatgcagtcggagatggacgcggttgaggagaaccacacctgggagcttgctgacctccctcgtggtcaccgcgcgatcacccttaagtaggtgttcaagctgaagagggatgaagccggagccatcgtcaagcacaaggctcgcttggtggctcatggttttgtgcagcaggaggggatcgacttcgacgatgccttcgctcccgtggcacggatggagtccgtgcgactccttgcgctggctgctcaggaaggctagtgcgtccatcacatggacgtcaagtcggcgcttctgaacggcgacttgaaagaggtctatgtgcaccagccgccggactttacgatccccggcaaggaggacaaggtgctacgcctgcacaaggccctctacggcttgcggcaggcaccgagagcgtggattgtcaagcaattttgctatatatttgtcgacaaattttcccccaaaaatttgacagatgtaattacagtacaaccgtagtgtaattacactgtaacttgaatgtaattacactgtaactataatataacttgtatgtaactttcaaaaatctctccataacatgttattttggtaaaatgaaggttgtgggaacaatttttttcacatatgtgtgtactgtgatttttttattcctcaccaaaacaaatctttataatagatctaatgatttaaaattacgtgaaacttacattcaagttaccctgtagttacatgaagttacagtgtaattacatacaagttacagcgtaattacactacgattgtactgtaattacatctatcaaatttttaggagaaaatttgtcgacaaatgtataggtggtcccttgtcaagttggattccacgctcaaggggatgggctttgagcaaagcccgcacgaggcggccatctaccagcggggcaatggaagaaatgccttgctggtgggtgtctatgtcgacgacttgatgatcaccggcaccaaggatgcagaggtggcggcgttcaaggaggagatgaaggccaccttccagatgagtgatctggggcccctctccttctacctggggatcgaggtgcaccaggacgactccgggatcacgcttcgacagaccgcctacgccaagcgcgtcgttgagctggttgggctcaccgattgcaatccagctctcactccgatggaggagactgaagctgagccgcgacagtccgacggaggaggtggatgccacacagtcttgtggggagccttcgctacctcacccacacacggccggacttggccttctccgttggctacatcagtcggttcatgcagcgaccgacgacggagcaccagcaggctgtgaggaggatcatccgctacgttgcggggactctcgaccacggtctctactacccgaggtgtcctatcaaggcacacttcgtcgggtacagcgacagcgaccacgccggcgacatcgacgccagcaagagcacgagtgggattctcttcttcctcagcgactgcctcgttagctgacagtcggtcaagcagcaggtggtggccctatctagctgcgaggccgagtacatggcagcctccgccgctttgacccaggtgctctggcttgctcgactgcttagtgatctcctcggcagagactggagcggtggagctcagggtggatagcaagtccgccctagccctggcaaagaaccccgttttccacgaacgaagcaagcacatccgggtgaggtaccacttcatccgaagctacttggaagaagggagcatcaaggcgagctacatcaacaccaagaaccagcttgcggacttgctcaccaagcctctcgggagaatcaagttcctcgagctctgctccaggatcgggatggcccaacttccccacaagacgacgcacaagacttagggggagaatgatggataagtctttgtggtccttggtcgtggttcttttttttgcttttgggtagtttcacctttttcaggacagcatctactcctttagcatattttcagttgctaggacagctgcggttagtaggacagcagcagttagcatctcctttatgcctcctttatgttttattcagtttggatgctctctaggacagcatcccattcaaatttcgaactttagactaggagggtgcagcaataggcttgcagccagctatggctatatatatgtatccaacctccctcgggttggtatggctttgagtttgtgaatggaagaaaactagaaaaattgtcccatcttgagtgccatcctcttatcaatgagagtaaccattgaaattctaacacatttccctataggtacatcctgttgctgtggacttgttacaacagcagttaaagaaagggttcatgccagcagcatggttacatcgttgacagaagttatcaatgaaaacagtgaactcctgtgctgcccatcagctccaaattatgtaatgcagcactgaggctccacttttctattgggaacgagtcaagaagctctatgtcattaactacaaattgatattcaattgactgtagattgtttatgtcatggatatggatggacatggattccaccactaaagttggattagacatcttgaatattttattagcatatatgttgaacatctctagtctggatagtggatacaatatccatcccattcctgccactaattagacggtttgcagaataatccttactaagaattttcacccgagttccaagcgtacaaagcctaatgtaggaagcaacatatttttgccataaatgaaaaacataaggatggctagagcatattcccaaggatgatacctttgcccgttcttcctcatttgtatccataatgtatgccatgtacctgtggtattcatgtatatgaatgagaatctcaccaacatgtgataaaagtatcactttcatgcccaaaaatgtaatcaaaatcatttgtgccgtataagcgttagaaaggtctaaaaggtgtaatcaacatgtgataacaataacaataataaacatgtcattttggacatgtccaaagtcaaactttaaacatgtatatctttttacatatttcggtgaattgtataaagtcatgtgtaagtttgttatggaaaatgttctcatgaggttaaaatattgttgagttttttataaatattgtaatatactccctccgtcccaaaatatagaaattt

SEQ ID NO: 38119 - DNA, 543 bp, Oryza sativa
  unsure (1)..(543): unsure at all n locations
atctaaaaagctaattactttatgtccagaagcatcattaactaacatgtcggctataggcataggatattcatcttttggagtagctttatttaaatttctaaaatcgacacacactctaatcttacccgtatttttcttttcaacaggcactatattagagatccactccgcatatcgacaaggccgaataaacccagctttcaataaccgatcaatttcttgtttgatacggtcatacatatcagaattaaaacgtctagggggttgtttatacggccgaaaaccagatttaataggcaacctatgctcaactaaatccctactcaaaccaggcatctcattataactccaagcaaagcaatcaacaaattctctaagtaatttacataccttgctcttctggtcagcccccatgtttgcattaataaatgtaggtctaggaatactcccatcaccaatatcaacctcctcaagtggatcagctgacgaaaacccctgacnnnnnnnnnnnnnnnnnnnnnnnnnnnnnnnnnnnnnnnn

SEQ ID NO: 38120 - DNA, 12860 bp, Oryza sativa
  unsure (1)..(12860): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtccacggattggaagtaatccaagcattccgaaatggacgtgactagacagctaccggtcgctggtttgcgttatcaagcgaccactccatccagtgtaaatccacctttaacttaaaaaatacaaaaatatgtatctttttttaatctatttaataacttatatcttttaaatcacatattggttttaagatctatttgcatcattgtactacactcaaaatatatgataaaacgagatccatattaaatatatttaaacattttattaatttaaaagtaatttattacatgttaggtagtacttttacatcttatacatgattaattcttattagttactttaccttcatcaatgttattttcaatccatcaaaggttttatcttctattctcatactacatgaaaaacaaaagtgaaatcaatgcttacaacagatttatagaaagttacttctgaaccatgcaaaagttacttccaattaacattgaagttacttttaaaaattattaaacttactagtgctgattaaatttaatttctagatagagtcatatttttatccctacaacaaatttacttctaatgtcatgacaaagttactttccttttgttttaagttacttttataatgtatgtaaattactttagactttattgaatttacttttatatgtctaagaagtaatttagtgaaatctaaaagtaatttagatatattataaaagtaatttgtatcataatataatcatgtgagatcttattataaagatttaattgttacgaatacaacggtgtaatcagatcgtagactatatgagtagtttaagaggaaattttatttgaagtatagatggttcctatttgcttgatggactagtaatatattttctgtagagtaatgtgtagagtaatgttttcaatggtgtcgcgttgtaagactaaaccgagaggcttctcggtttagattttgagttccgaaatctataagtatgtctattatataaaattaaaaaaatgagaaattgtacgatacttatatatatgtacctataggcatcaaaattttatattaaagattttaagtaccattaaagataaaatatgatacctccttgtattttctaaagaataatatatacctaaaataaactaaagggttttcccacgtgattccatagtgaactaattttttaaggtacaattggatttcttatacaaatcttagtgtctgtgtacataaaatatataagttgtatgcagtagatcctaaaaagagaatttgattttatatacaaatttcatattctattttcatagatactagttgaatgcctatgctttgctacggataaaagaaaatatattataatattttctaaaataaataaaaatatcctcgcaaaataaataaataaataaataatatatttttcatgaaatgtgtaccaatttagattttattgtgttttatatgtagttatccatttagagttgattgtgttttcatattttaaaagttcagggataatttataaaatttacaattggagtatgtagagtgacaaatctactatcaccaccactatcttttcctttaaggatgtatataaaattgcacgattttttatgcaatatgtctgttaacagtgaaatttggtaagcccaaagttaccatcggcttagagtcagtatcggcttcaaagttctagaatcggccgatgagagtcaagtcgccacgatgtcgtgttcttggtggagtcggatcagtcaaaggaagcttatctagaagagtctgagttcaagaaggatgcgatatgacagtttatctattaattaggcatagtttgttagtttccttttatctttaggaaagtgtgtttagtgtccaataaggactttatcttttcctttttagtttctagctttcttgtccgacaaggactagtatctccctatgggtataaatatgtacacccggggtcattgtaatctatcttcacgattaatacaattcggcgcatcgccacctcttaccttttctgctttattttatcgtccggcaggacttggaacctgatgcggggctgcatcggtgttcgatctccggcgaaggggtaagtccaatgttccgtcggcccaggcaattgtatcgtctacgtcggcatcgttcaaggctacatcagtacattcgacctcttggattgctctagtttggatgatatatttgcctacctatttatcatatgtctttgttaatctatatcaatttagctctatcggctgcttctcgttttagggtttatgccggtatcggctaaatcgcattgctagattagattagcctaggcatctaccaccctgaaaactcagtcaacagcttgattgtctagatattatgtttcttttcatacttagtgctgcatcagttaagtttgatctactaagtcgagcttagaaccataatctctagccagcttcttgattgccaataagggtttcatcggggtttcaaccgatgagttatttggacgttgcatcggctcataaggattgcatatacatataagttggatttagccgatgacaacaaaggtttcactgtttaatctaatcttgtggatttcatgacatcggatctacagccgatgtgtgctttaaccttcggatcgatgcttatttatcatatcattgctagccgattggtttatactggactatattgttatttcattacatcgtcatcagtcgattgcctttatatcattatctacattagacattaagccgattgcttaaaccctatcgctatcggctggtatcggcattggctattatcggctatcggctggaactgctccattggcttgtcagccgatcggctgttttgatctactattttcatatcttgtcagttgcaggatcaaactgactggcacgcccacatctcatcaatctttggacctgcacaggagttaagcagatctccctggccggtgtgttcgatttttttcgtcaacaatgtcttaaattttttttatcaacaattctaggaatgattgtgtacatttatgtcaattaattaaatttgttcttgtaacctaggcctacgatgaaattttaattttttttcccatcccttagatgataatttaatgattctcataactgacctattaacttattacttatcacatcatatccaactactggacaataaactattctaatataaaaaatgtataagattgcatgaaataaacttgtaaaaaattacaaatttacatgaaaaaaattaaacttagataaaactaaagtaaaaccacatataacaactaaatttgcacattgcatggcaccaaaagtttagccttagccatgtgtgattttcaatgatagccaaaaactttgcaaatgtttgtaaatcaatatcgtgaatctttctctttcttcaatgaaaccaagcttctaaagcgaacatgatgaatctttatcatctgtcctatcgacgtacacactccttactataaagaatcaaatatgactatgaatttagacaaacacatatctagattcctagttaggatttgaattttttttaacggatgaaataatagatagatagatagataggtagataaatactccatccgtttcatattataagtcatttgacttttttctagtcaaacttttttaactatagaaaaatatagtagtattttcagtacaaaataaacatattatcaaaatatattcaatgttagatttaataaaactaaattaatattttagatgttactaaatttttctataaacttggtcaaacttaataaagtttgactagtaaaaaaaagttacacgacttataatacagaatggagggagtatatatataggtatggatggatgggaaaatgaacctctcgctttttttaaaaaaaaacacacacacacatacgactttaaatcgatttaaagagagaaagatgttgcccttttatggtcactataagactatagattgatgagactacttataatactccacatgtgctactaacactataatcatttgaacagttacaaactaaattaccggatccggagtgagcaaagtttattacaccggccacacaagagggcagaggctgatcttacgtgtacactagatgactccgatgaatggatgaaaaaaaaatatatattgtcactagaccaatcttcaaatgttgaagtagtaggagtattaattaagcgtaatgccaattcagttgataatacgcgtcacatcagatcacctaaacaaaagggattaacaaggacttactccatccgtcccaaaataagtgcagttttacactattcatgttcaatgtttaaccgttcgtcttatttgaaaatttttatgattagtatttttattgctattagatgataaaacatgaatagtattttacgtgtgactaaatatttttaattttttcataattttttaagacggatagtcaaacattgggcacgaatatccacggcagacagaggtagtaccgagttagcatcaatgcatgtaggagtacacgtacttaggccatgtttagttccagggtaaaagttttggcgtgtcacatcggatatacggacacatatttaaagtattaaacatagactaataattacagatttcgcctataaattgctaaacgaatttattaagtctaattaacccatcaataaccattgtttactgcatcatcacattgtcaaattatgtagtaattaggcttaaaaaattcgtctcgcaatttaattaatctatatatttgatttttttctaatttaaaaagctagtaaactttttttttctacgataaaaaatgtttacgttggaagtaaacatggtcttaccccgtcttgtgcgctaggtactagctaggcagtttactatagccactagaatatttgcgcatcgccgtggtgcctgctgtcaggggccaggttcgttgcatcgatcaaataaatatcaattcacgaatttagtcgactttcttttccacgtacccccccaggtaaaacatgcgtccagtcttataatattaagatttattatattatcttttttcatttagggttattttttagtttgatgtcaacatatgccctaccaaattattgatattttaaatagtagtttgactagtgtttagtttgctatcaaaatgtatcaataagacgtataagttgtcaaaacattaagggtgtgtttagttcacgctaaaattagaagtttggttgaaatttgaatgatatgatggaaaaattggaagtttttgtgagtaggaaagttttgatgtgatggaaaagttagaagtttaaggggaaagtttggaactaaactcgacctaacactatcaaaatttacctatagtttagcaatgcaaatattttgacatggtggcaaaccaaacaagtgcttactttttgaggaagtaggcaaaggccgagtttagatataaagttttttttcaaaacttccaacttttctatcacatcaaaaacttttcaaaacacacaaactttcaattttttcatcacatcgtttcaattttaaccaaactactaattttagcgtgaaataaacacacccatagtataaacaggcgaaatgcccaagctactgtcggcctgcaggcatgctggtctgtggccggctggatgtgggacgcacctggactgccggagatccaggttcacctcctctcctcccttcacttttgcttttcttttgtgcagtgggggggggggggggtaaagcctgtgccaattcttgtttatgcaccaagagacatgcacagaaactttacttgacacgtgcatgggctgaaattttggaggattatccaaacaaggccttacgggtgggcctaatattgcacgttctctggaatcccgttccgggccaaacaatcacggccctacacgcttacgagtgtcagagatgggctggggtccgacagatcacggcctagcagggtagcacgctgcatccggcccacaggagacctcaccggcgttgagaaactgtgccggcgagatgccgagatgtgtgcttctgaatccgagtcgctcttgtcgtagagaactaaatgcgtgcaggttgcagactagcttgcagttcatgcaaatgacgtgcgtgcactttgaatcatgaatggtaattgatctgtgtggttcaattcttctctcccctcgatcgatcaatccagacaaaagtttgaagaacttttttttttaaaaaaaagagttggggagagaagggttttcatctatacggcgcgaacccccgaagctcccgcgtaggcggagggagaaagcctcccccaaacatggctggcgtaatgcaaagcaccgtcacagtgctacacacacgacgcagcacacgggggtttgccggcaagcctctccgcgcaacccacctacgcccatgggaaaaccggccctgaaatcccctcgattattcccctatatatcgggctccgccggagagttccctctccggccaatataaatatcatcccatcggggtggcgcacacacgcggcaccggcaacaccgcgggacgaacgcaagccgcgggtgcacggacaattgccggcggccaacccacccctcgttttttaccccgtcgcggcgcttggctcgcgacttgaccgggcccagttgtgtgacacgatggaatttttgcctgaccccgacggctcaaagcgccgccttagacgaaacccagatggggtgctcgatcgatcggccccctttgtcgctgctccccaaccctaccctccgaagccggagttacagacctgcgctactaggcccggcgatcggagatgcgaagggcgcgcgctttatcgtcagcggcttccgatcgaaatggcgaggtgggacaaaaatgtagcggctgctactcgatcgagccaatcgggttcaaacttccgcggcttgatcatgccgctgtataagtctgcaacgctaagagccatggccattagggcagtcccaacccatagtgtccatatgtagtgtctatagtgccatgtcaataagacatcacaatagaaactacactctacaacccgtggtttcttaaagtgggccattaataaatacatcatctctcttctctaccaatcatatttattcttcatctattatgaagacactattctctcccaatgtaaaacttgatagtgtctaatgcataggttctcatgttgaagctgtgtcttgtatgagacccagtttcttcctctcttcactctctcttaattaaactagtgccacataagctaaaagtcctacatggcaatatatgctatagataccatcctagatggagggttgggactgcccttacttatttacttccaccagggtgatgaaatcggaatgcaagctagcgtgggattcccatgcatgtgctctagtttaggcagcgtcatgtgttcatatttcatcagtcgtatgggacacagaccgaaccacaggtttcagcctttcaaggcgcaaaatattggaatccaacgctgcaccaatgaacacggtcagttgctctaccagtccaccttatctaattacagaaaaactacctaacggcatcccgtggagacggaataagtggataaccatccattcttatccattgtctttctgtctctctctccccgatcctcgcttcgtcgtcatcctccgccccactctccctccgtaacttctcttttcgttcctagtaggggttgggacatgattccatggcaagccctttaacaagatcagaattgtccagtatttcatttgctaatgtcgcgtcgccgacggtggccatggggctctcacatgccaggtccgggaagagatgcaacgatttcaaggtgggaggtgagttgaggtgtgtcgcagacgcatcacacttgtgtgggtgtcaaggatatgggcaacgacgctccggatcaaggatggcaacgataatgaatggcatccctccacctctaaggaagtagccatctcattttcacgcttgcctttgccttttttcctttctcctcatggctctcatcggtgtgaagacatggtactcgcagagtatttgatgcatgggtatcaagttcctgatacctaggtatcgagtaactggtacccagattatccagattagtaccataagtaacagccctgatacctcaggtatcggtgtaccaggtacctatatcagtctagcacccataggtaccagacctaacactggtatcgggtagctaggtatcaagtacttggtatctagatcagtctgataattgtaggtaccaggtacctagattggtctgacacccataggtaccaaacctagcactggtatcgggtagctaggtatcaagtatttggtatctagatcagtctgatacctgtaggtaccaggtacgtagatcggtctcacccataggtaccagacctagtactggtatcgggtacctaggtatcaagtactttgatatctagatcagtctgatacctgtaggtgcgttttgatgcgaaaaaacacacactgccctgaaagatctacttaacttcagtgcaggtccaaaatcttgcttttaggttcgtgagcgtgccagttgatttgatcctgcaatcaacaagaaagaaagacaagaaaaccgcggttaaatccataaacaatagccgatcggctagttgccgatgacatatcatttatctttgagccgatgtcatattgagatcgatcggcagttataggaaaataaggtaaggctaaatctactcgatatatcggctgtagatattaacgatatataatccttccgtcgatgtatatttaaaccaagtgattgggatatatcagtcgccatgccgagacagtataaatcacttagatcaaagtatacattaacacaaagattataaacatttatagcatagccgatcagatagatctagcatgtatcggctaatactccgataccactctatattaagatattaaaacaggtagaatatatcaaacaagaagcctaatatactttaatacaataagatcttaatacaaagggcagatttagcatatcagtcaagtatataagatataaagtggctaaatcaggtaagatcggctaaaaccccgatgctatctctctcgatgatcataaagcaagccagatatcataattatatattacttaatagatcgaactcaaccgatgcaacattaagcataaagacaagtataagatctaaacaagatgatgaaaatctataagagatggtagatacatgatataatctagattaataacaaaacataactctaccgattgcttcctaacagtaagaaccagtcgataacaagttatagagcgcaattaacagaggttacaacgtgtatatgataacttgatgaatcacataaacaggattagagtgccataaagatggaagcactaatcccgagaacgtaaaccgccatgacaagtttacctctagttgaagatcgaatcgatgtagctcaacccgaaagtaagaactcgtcgaaatagaacgaaagtaaaaagggtggcgatgcaccgagattgtattgaactgttgttaattgattacataggttcgggtcatatttatacccgaaatacaaaatatgtccttgccggacacgactcttatctctaacaaactctaagataccataagtctttgcggtagacttttgtccaaacatatctctaaggaatttacacgaaatgtcctaattaatagatacaattgcctatcgagagctttatctctatcgtggcaatcctcatgaagcacattgatcgattctagaaacagctctaaagccaccgccatcggaatcggctgcatcatctctatcggttgtcctctgtccgatccatctcagccgatgtcatcgcagccgatgcatactctgttcttcgaatccatctctttgcgaatccgccttgattccaatgtcgaacctggttcatattttaccaaatttggccattaacagtaccagacctggcactggatatcaggtacctaggtatcaagtacttgatacctagatcaatataatacctatatgtatcagacctggtactaggtatcgggtacctggtacctacctggcactgggtatcggatgcctaggtatcaagtatttggtacatagatcagtataatacctatatgtatcagacctggtactaggtatcgggtacctggtacctagaccaatctattactcaaattggccctggtgttagcatcataacaatcgaaacaggtgcgttgtgtctgagaagttgtgcacttacgtgtggtcccttgtgaggacacgaagagacgtgggctgacacatgagccctcacgtggggtgaagttgataaaataataggagaggttagttgctcaaatagtcatactcattaaattatctcgttggaacggaagtccgtgctctagtagttctctaataattaacacggcatcagcatcactcatagcaagaatcgatcaattattcaattgtattcgaattcagatgtatggctgaccgggaaatctaaaatgaacgtggcagagagggggggggcgcctcctctccccggcgctttttcttttttcgggatttttttcttttcaaatctcagccgacgcttttttaactttgtaatgtattttaaaatttagatctttcatctcaaattttataattttcaacacaaaattaaaaacttgaataaatcttgagttgaaagtttttagattttgacttcaaagttaattttaaggtcatagtttttaaattttgacttaaaagttcaaatttcaagttgaaagttttaagttttgggtatgacttttaggcttttaatagaaagctttaaattttatttgaaactatcaaatttgacgtacagatttcttaaacttttagtaaaaaaaagaagaaaataaccttaaaggttaccttaattatcgtcattatcactgtccaaaagaaatgttaccttaattatcattattatctcctaattttattagttacactaattatttttaattaccgttattattcaaactaattcggatatatatgcacttttccgcgtggcactggggctagtgtggcttagagcatatacaacagcagactataaaccaactataaacacatcttgagaagataaaagaggagagaaaagagcagcgagctgcagatttatagaattgtggttgatcgggacgaatatatcggttagaaaagataatgttggtcggcaaaactataacactaccatctgatgatcagttggcaaaaatatgtatgtggcctttgccgacagatccttcgttggggattttgtgtcatggtgtagtctgcatggccaaaggcaaagaacaaatccaacccctatatggagcatggttcaatctaggatttgtctttgcttttcctcgaatctattaactatcgtggacctccgtctggaccagtggtttaactgaaaaaactagaaccaactcttggttcggtctagttttgtcaaaagaccgtctaaacatatgaacagtaaaaactagccagttgatctagcggtttaatatagaaccagtgaaaaagctgaaaggccgccctccaaaaccaactgagcaaagtttgttgttggttaaatatataaaatagttcattatctctctgagtaattcataagaatctcggttggacttgtctatatctgtcaatctgtgtgtgaatgttacattcagttctcatcgatttgccacacattatttatacgtagattaacaagattaagactgtgtttttctctcaactttccagcctctactccttcatttttcacgcacacgttttctaaactactaaacggtatatgttttctttacaaaaattatatataggtaagttgtttttaaaaaatcatattaatttattttttcaaagaaaatagctaatactgaactaatcatgtgttaataagtcgcttcattttgtgtacacgagagatgagttcttaacttactgagaaagaacgcaaccttaacaaagaaaagaaaagaaaatgaaaaaaaaaaaagagttggcgagaggggttgaaagcgcgtgagagagcccaaggctcccaaacccccaacggggaacggggaaatccccggcgtgttagttgtatttacacgttaggctcgccggaccggaggcgccggaggcccatgtcctcaacggctcacaccggtcactgactcgattactacaacaatggttaagttgccggggccagaaggcaacgtttgaaccgcgggggggtgggtccggagtccggacgctgcgatctgaccctgggccggagacttctcgcgccaaacaaaccacgagctcgggctccgccaccgaaatggcgtcccacggtgagccgagccttgccctcgccaactctaccctccgaagctggagtgacaggcccgcgctaccagacccggcgaccgagtcggggatgtggccg

SEQ ID NO: 38121 - DNA, 15884 bp, Oryza sativa
tccccgtcgtcgtcctagtccaccggcggcggtgcacggcggaagcgccgccgcttctgttgcccggtccgccgcttcgtggcctttggatacttgggagggagttggaacggatatgatcgtacagcacacgatatacgaacccgtgtacgtacgaatccgaaatagtactacatatctacatcgttattaagagaacaacgtttgataccgcgaggtgcgcttattaagatcaagtcgttctccaagtggcagttgagtcatggatgttattcatccagtaacagattgtaatcagctaaaaaaaagtgacaatctgattacaattcttcctcgatcaatctaggaacgcggagtcgtatggaacaatagcccggcgaaattttgttttcgtagttggatcaattgacagtttgacacatattactctagaacattgcttttctctagtgatgcaaactttggttgaaaaaagccatgaaatcggggaaaaaattctttgcgacagtgccgcacgacgcttctagtgcaacaccgtataagctgccgatgcgtgtctcgtctgctgcagcccgactgcccgaggcctttcgttgagcccagcagacgtctcccacaacaccgcatagatcaaccgcagcataccttctacaatttctatttgtgctagatcacgaacagtaattccaaacccaactgctatcgatcgatcaacctcttgtcgtcccggtccattctggtccctgggagcacaccactatagatggctaaaaggcccgaggcccgacggcccggcctagggcacggcatttttgcccagcccaagcacggcatggcccgacggcccgtgctagcctggcccgaccactcggccgtgcttgggcccctccaccggcacgcccgatgggaaaatagacttatttaaaaaaaggcacgatgggccatccatacctttgggccggaccggcacggcctgactacttgtgggtcgtgcctaggtaggaggcgcagcccacgggccgtgccggcccgatggctggtgggccgtgcctagccgtgccggacgggccttttagccatctatacacaccaccatgtttgagtctatccccgacgagaacaccgacggcgggcgtagaggagggcggcggggccccataaattccgctgtatggatgtgtgggtagggcgccatttggatggtgaagggcggagccgcgtagcagccgccggattaaatcttgaaacggtggagagaatagttggagctaattaagcgcgtggggaggcggtggatctcatgatggagagcagcgatagaactcaccaacgatggtaggcacgcgacgggaagagggtgcctcgaacctcgattaattcctaggcagactagcttggccgatagctgtggcttggtctacgtggtgttacgggataggtcagctcggcttgggatgcagcagacgggactcgcgtagccggtctagactgtgccgcacgggatcgtgtggcactgccgcaaagaattttgattgtatttctctcgcacgggaggaattaagctttattcagctcacaagctgtggagatcaatagatcatctaccggtccaaagtttctgatccgaatgacaattgggagaatactggcatgtttttgagtcctcaacttccacagtttagttaggttaggtactgatgtctgatggcgccttaacaagagtgctgaattaataaaagcatattttcaaggtaatcaatgcctctgtcttgtactatgacgctatttgcgtacatataacgtttaatcattgtagacatgggtatttttcgtttgttcaggtatccaccacgtgagaatagcatgggacatgggtatttttcttttttttttttgagaatgacatgggtatttttcgtttgttcaggtgaatagcatgggtatttttcgtttgttcaggtatccaccatttgagaatagcatttactcataagatggtatttgaataataggatttactcataagatggtatttgaataataggatggcataatcattttggacttaaattcagcgaaaaagagttggcgagagggaattttatatttgtttgtcaaagcgcgcgaatcctcgaggaacaaacaccggacatgggctcaaccgaaggattcctccggccattggttgggaagcccgcccgcatgggcaggagggcagtaacggtaaacgagggcacgcgcgcatggcgacacacccccctcgccgctcactaccctacccaccaccaccacaggcgcggcccccctccctgttgggtcagtggtgatggccaaggcaaacctccggtgaaatcgagggtcacagcccgaatcgaccgagatagatcgacagggcttcgccacgataaccagaggcgcccgtggtgtttatctgtaccccgggggccaggagatctcaagcgacgctgagccaaacttatacatatcctccctcgccaactctaccctccaaagccggagctacaggcctgcgctactaggcccggcgatcgagccggggatggagtcggatttatcgcccgcgatctgcgcacgaaatggcgaggtgggacaaaaaatggtagtccgctgggtaattctattgagggcgtgactcgtgagcctggcggctccgttgaggcgttgatggaccgccgccgctgcttagttccgccggcagtgatgcactcggtttgaccggaggaagccctggttcgagctctgctctgctctgtgttaaccatttgaaaaattgttatctgtgagtaagtttcaccttgggtgctaatgtcgcataaagttgtgaactcgtgagtaagtttaagtttgaacatcaatttcactgcatttcaagaatagttttgcaagaggttggtcacaacacgtttcacctgtgtcaattttcacttcaccttcactgtctgtggaaagttacacctggtctcctaaaattttttagttctctgctgacagcaaattcattccttactgtacaaaaaagagttggcgagaggggttttgattgaaagcgcgcgagagagagcccaggggctccccgaaccccgagcccgctagggttgggggaaatccccggcgtgttagcgcattttagttagtgggcttcgccggaggcaggaaaactctctcagagatatcctcacaccggttcactggattcgattaacagtgattagtcgcgggggccagaagaagcaggcggtaaccaacaacacacagggccggctggcatggttctctgaccccggggggctctcaacaaggcgcgcgccaaacaacaaacccgatcgagctcggctccgccgccgatcaaagtggcgtcacgcgcgagccgagccttaccctcgccaactctaccctccgaagctggagtgacaggcccgcgctaccaggcccggcgaccgagccggggatggcgccggatttatcggccgcgcattccgcgtgaaatggcgaggtgggactaaagcgtcggtcgatccgctagctgtagctgatgacgaagaaattaaacacaggagggtcttcgtcgtcggcgtcgatcgggaccgctggccggcgagtggcctgggccggggcctgccctccgtcgatggacggagtccgcgccgccgccgccgcctgacgagctcaggctcagccagccgccggtggacggacggcgatcgaaacgccgctgcttctgttgccaggtccgccgttcgatctcgagctaaactttgctctgttcttgggcctagttcgggctacacatggggatggagagacgatcgtgcccgctcgcgtcgtatacgggccggaccgtgcacgtttcggaagcagtaatatacttaacatagtaggacgacgtttgccaagccatattggagttcgtttgtggtgcttcctaaacggagtgttttttttaaaaaaaaagaaattctacatgaaaattgttttaaaaaagtcatattaatcatttttaaaatattttaactaatacttaatttatcatacgactaatttgctgctcgtgcatgggattagttcctaacccacacaaaacaacacagccattgtctcgttccaaactcacaagtagacaaaaaaaaacctggcttaagctagtcgggtgagttgtgttcactgttcactgttcaggacttcagggttctacttgtttttaagccaaaagaaaaaaaaatcggggaacaccgatagacctggaatatcaggtatttcgagaaatctcagaaaaaaaaaagttgaaaacggaacacactttggttagatttgaatactttttgctaaattgggaaaaaaaattgggctggaaaatatgataaatgcaaagttaactgaaattgaataggctttgttcagattcaaaaaataaaaataaaaacggaattttcgggtgaaatagtatcattttggggtttaaaatttcgtgaatttcaaagctcgcaacatgtgaaggaagtcggcaaccttgaacttttcctgtagcagctgcatgcggcgccggcgctgaccatcaggaaacttggcaccaacgaaaccaactcctaccccaaaaacaacaacgcccccaaaggaacttggagaaaacgtaaccgagtccaacccaacaacacagctactactcgatccccaacgtggtataagacgagcactgcaccgtcgtcatctatagtcgacccaacacagcgacaccaccagcgcccacctccatcgccgccgctcccctcgcctcccgcggtttacgctcgcgcgcaggagttcttggttggctgactgcgagtaagcgaatcatccggcaatcatggcgtcccgtaagtctctctctcccggtgatctcgtatcctgcttctttttttttttttttgttcttgttgattttgccaattcgaatcgatcggtgtatgattttttttttcaaaaatcggttctgcattgcaggcgtcaggtttgagaattccagcgagattggagtgttcgcgaggctcaccaacgcctactgcgtgctccccgacggcggagcagagaacttcttcaggtttgcgtagctgcattgcattggcgccgtgtgaatcttggatttttagcattggtttgaatccgatatttgttatggtgtagcgtgttcgaatccgagctcgccgacgtcgtgccggtggtcaggacgtccatcggcggcacgaggatcatcgggaggatgtgcgtcggcaacaagaacggcctcctcctgccgcataccaccacagaccaaggtatcaacactactcagtactcaccatggatgcctctgctttactctgcttgtcgtcccggaatattttcttcagtcaaattcagtttcaagtactcagattttaatcaaactgagataaacaagagatctgatttcaccaccaggattcacttgtgaattactccaatttgtaaataatggggacaacgaactgtttttttaaaaaaaaaaattaaaaaacaagaagtcctcttggtggcatatcttctttctgataagaaattgacctgacatgttgttgatgtttccagagctccagcatctgaagaacagcctgcctgatcaggtggtcgtccagcgcatcgaggagcgcctctccgccctgggcaattgcgttgcctgcaacgaccatgtcgccctcacacacccagacctggaccaggcaagtcatctctttggaaaatctactccaaaatcacagagttgagcatataggagcaattagcaaacaatgccacagcttaagcccatctgaccaaactacattgcctgtaaacagggaaccgaggagatcatctcagatgttcttggtgtggaggtgttcaggcaaaccattgcaggaaacatcctggtggggagtttctgcgccttttccaataaagggggccttgtaagtttctatcacaattaaactaatcaacatcactaatcactggagtactagttattaggccatggcactggagcttgcagttctctgaaacctgtgaatgatgcaggttcacccgcagacgtcggtggaggaccaggcggagctgtcgacgctgctggaggtgccactggccgccgggtccatcaaccggggcagcgaggtggtggccgccggcatggcggtgaacgactgggcggcgttctgcggcgccgacacgacggcgacggagctgtccgtggtggagagcgtgttccggctgagggacggacggccgggggcgctcggcgccgacatgagcaggtcgctcgtcgtcagcagctacctatagagagaggaggagggaccggtttttgctttgggggattttcggtcagaattcaagaatgcttaaagccaaaaatatcccttgctgtatcttgagtagtgacagtaaatgttcgcgtggatcgatgcagttttgatcctgtgtcaaagatgaattttgtatctttgcaaatctggaacgatggaagtgcttttttgaagtcaaaatataatttagtattatgctcagctcaggaaagaatgttgtcttaaaccagaatattaaacaaagtgaaggtagccaacatatgtcagatcacagtgcagcaaagagtattttctctatcagtaaagacttgttggtagagtacaacacagtgcaacgcaaacaaacataagttcatagggcaaaatcgttaagaatgcctaaagaaaacataatgtatcattagctgaaggactagcaagcactggcaaaactgacatttgtttgctaacaagtcaagagacagttgacacgcataaaatgtgaccaaagtaactcttcattcgtagcacgtcaatgaagcagacaaaataaaactaagattaacattcataagattccaatcctactcgcctgctcggtaaggcaatagccgcaaaaggttatccaagtgcaagcaaacactactagttcattacatcgctaaggcattattatctcatcgtcatatatattttggcaggacataagcagcacatgtattggatggccacaaaataaacctaacagaagaacctaatcgagcaattcagacattgcgttcttcctgttgaacggatcggtagcagcaagcaaagatgccacagccctattggggaaaatgtcatcagccttcatcctctccttgaatccataaggtggggtctttgcattcagatatgcctcaagaagcagctgatactgtctaatcctcccagtataacccatctgccgcaccttgctgaacaatttctctgcattatggacgtctcctttcttggaataactatcaagcagcatcaagtatgtggtgtacaaaggcttaatcttgttcttatatgatagcttatgcaatatggaatcagctttctccacctctcctgcatccgaatagagcttcacaagtgaatccaatgttgagggccctagtctgcaaccatcatcacccatccgctttgctagctctttccccttgtcaaaaagctttttgttggcatacaccttcagcatagcattgtagtattcgaacgagagtgtcttccatgtcttgaacatattctcaaatatctcctcggccttttcaacatctccaagcttaccaaaagcctctatagcagacatgcactcatctagacgagcattgacctcacaaaccttccagatcctttccacatcagcttttttgccaagaaaagcatacaggggtaaaacaaatttgcaagcagaacggttttcattgatatcatccccctctatttgctccaaaattgcctcagctttctcacgataaccaccaaatatgtagtgccttgcaattgtggcttgaatcagaagatctggttcaattccatctgcttgcattgcctgaatgaccttctccatatcttcaatatctctagcagcacccttggtgtctacaaggagcttataagtgaagagggaaggcttcacattctccttttccatcattgtgagaacatcaccaagcttcttcttgtccactctcttgtagagtagcagaagctgattgcaagaaaatacggtaactggaaatccaaggtccttcatcttattgaagacttgttctgtttttttcacattggctatagccacacagttagccaaaagagtcctgtatacaacctcacccctatgagatgcaggaacattctcaatatacttttcagctttgtaaataccgtggactttagctaccaaatccacacgtgaagcataatcacgttctccaagatcaaatagtttggattcttcaacatactccagaagctgcagaaaatgaagtaaatatcttctgagttagaaaacacaaagaccgaggtaaataattacagtgaaagagcacctttcggtctcaggctaacctagattacaaagcttaagtgttttagatatgaggttgttcacatgaaaaaagtttatgtatcaagttccatcaaagtaaacaccgtgtacagctacaaataatcaaagaatagtgaaattttgaaaattggtaacatgcatcggtacaaatgcattcggaaggaaggtggctttgttattatctaagacagctatagctgcatgactaagatctattagatagctacattggtccactaagttaccaataagaatttgttttgtacataagagtatagacagttgacacaattttgctagtaatttacaaagaacggtagcattcatttcatcatgacacgatagattgcacataaaaagaaacaagtatggctatgctatttcaaacatcatgtataaccaaacatgagtattacaacgaaagatttaaaagcacagatggcacaatatgtatgttaaggggtaaacatgcttggaatgcataacagtaaaataaaatggtggtcaataaaagctgcagcataaagaagagagaatcaaagaaatggagtaatactcaaaacgtgcatggaatgaacagaaaaagacaacgccctttgacaaacaaaaccaacacaagcactctaacaaatttcagagtctgatactatagaaaagaagaagcagtttgcacaccattcacatgatctgcaaagtaacaataacattctcatactaaattaagtttaggatgtaacatagaagtacaggtggtgaactggtgatatctcaacaacattgtatttttcaacagtcaaggaaattatgtgtgcttcttatatccctctagctgtctagcatcattcccatagtaagagactaagagtacttcatcacttcttctttttttaatactctaggacttcaagaagaagcatatagacatatcattctaaagtgcccctacctcatctagtgcatgctacattttacaaggctatagctcttcatttatgtgcaaaaccaaaagctcattcaccattgacatcgcaaatatgtttcagaaagtaacattcttaacacatgccaagctaacgagcataacagccgctacatgcattatcgataattataaatgtgcagaaaggacataacgtttgctatcatggaaaaaactaaaacatgtaaaggccaagttaaacacctgcaaggctttggtgtagagcttccgcttccgaagactaagaaggacataaaagagttcacttctttccaatgtattgccatcattaagccattttttcgttgctccagcgacatcaacccttggagataccagcaaagccttaagaagagtggattgtgacttctttatcggctcctcaggttttgcatcagcctccacttgagacaagccaattgcatcaatggtgtcctcatcagaactctcatcggatgtcaaatctaaatcctttttatcagcttctggtggaacctccagatcagaaaacccttcctccaactcatcctgcttatcaccagaacttgcaccggcctgagaagagaaaaccctactccacatgaaacggcctgatgagaatgatgattggcagaccaatggttttggttgatgacagcaatccaatttctgacagtcccgctcatgatgctcttctacattctttgcatctgcatttagaattacttcaaggtttgcacaaccacgggcactcaaagcttggtaggcacggaccctaaagcagcagcaaacagttagccaagccaaatatcagtattaacaatgcatgaaacatgggatgataggtacaagttatgatcctggacatggattcacatgcaaacgaaatacaaaatatctgcttcatttcacaataacatgaccagatgattgaaacaagcagaggtgttgttccatcttccaacatatctactatcgttcgtacataatgttacacaaagtaataatcatgtctacatagacaaacatctaagatcggttacttcttcaagcacatctacacacagtagatacacagtcatgtctctcacatacatccaactgatatatttcagtcaaacccaagatgataagactgcaatttgcatagaaattcaatagattacaacaaaacagagtcccaacctcaggtggataatacaaacaactccctactccccaactgaaaaaataataaatcactagcaatgatcaactttctccccaagcaacgcctatggccattaattacaagaaaccgtgtcctgttaacgggggacgccacacattttggcaccgaggaaatcacacaaataaaccccccaagaactaactaaacaaggcatggatggatctacttgtcgccaccacgcccccaacagggacagaaaataagagtgggagaaaggcacggataaagaacaagataagccacagatttattatatcatcaatcatctgtcaacgaaatcccacatgaacagcggcagaggggggggggagagacaggggaggcgcgggcggcggtacctgagggggttgcccgcgcggcggagcgcccacatggcggcggcggaggagacggcggggtcgtggcgatggagggattccgcgatggagaggggaagagagagagagagaggggcagaggcggctaaaaccccagggggagggggaggcggctaaaaccccaggcggcgacgcgaatggaggggcgcggcgggtgaggtgaggtggtggtttcctgttccgggctttgtgggttgtggctggcctgggccttttagatatttcttttttttcttcttccgtgacggtggctgcggttacgcggggaagtgcacacaaggaattaatggtaatatattgcgcggcgactggcgtgttaaaaagttgggttttagggcattctctaaagggggaataatcatttttctgaagatttatctcttcaagttggtctctctctttttttttttgataaaggaagtagttttatcatttgcattgttttttttaaggatttgtacagcttagagaaattggacattctgccactgccaagagtgggcttcgccacaaatggcatcggtaaaatgccacttccaaccgatgacaaaccgttgctttgccatattcaccatttcaaaagattttcaccattttccacacttcaactgaccaaaataaccctctctccgatgaacatgtgggagttgtgggcgaggagaaggagaaggggcggcgctgttccggacgccgtcgccggcgagagaaggacgaggcggtgaccgtcgccggtgaccgtcccgggggcgcggcgggcgcgctgctttgtggcggaagaagcctgcggctcgcgtagctggcgacgaaccacgccgcgagcagcgggaacatggcgccagcggcgaaggacagcgtcgacgcagccgtagcctgggaggatggtgacaccgccgccgcttgcagtcgcaagccagccggagccgacgccggagccgggccgcgtgctcgatttcggccagctagacatcgagctgcgcgtggccggcgacgaggccggttagcccggacaggaggacggcttgccgatggccaggcgacggcgacgaggccggccagcccggacaggaggacggcatgctcgtcggcggggcacgccgcgccgatgccgagcatgagcgacgcagtggagacaagatcgtcgctagcgcctagcaccgcggcgcgcagccactggaagtgcatgccaccgccgtcgtgggtggcttcctcttcctccttggcctctgccacggttagctcggtgtcgccactggcaaccaccactcagatcgaagggcattttgggtgaaaaattaggtgaaaatggagtgaaatggtccaaatagcaaaacaaatgtaagcccagttttggcagtggcattttaacgacgccattccgcggaatggcattgtggcgaatcccactcttggcagtggcgtaatatccaatttctcgctagggagtaaagaaaacagataaaagtactactccctccgtaaaaaaaaaaactcaacataggcaaagaatgtgacacatcctagtacaataaatctatttacatcggacgatggagagagaggaggcttcctgaagcgaccagcgagtcggaaaaaaaaaactttctcccccaacctctcttccccgggtttccggcggctcgtcgccagcgacgatgggaggaggggtcagatcgcatcccttaaggtgtctagtgtaggtttctggttgggttttcccgtagtttaggtcgagtcattctcgttctattccttcttcctctccagcgctagatctatggtgatgtgaccatggctactatagatacaaccgtcgttcacatcaagatcaagccgtccaagttctgcaatccagttcggctacctgctacagtgtggacttcaaacggccgccaaatatgcatgcaagctccattttggatccatgattacttgatggaaagctctcagagtcatctttccaatgatctagcttcatcgccaaattccaacccagtcggccaaaatcacaaaaaaaaggtgttgcgtcacctataatgggcctatgggcctgtaacttctctgggaccccggcccaagtggggcccatgtggggtgcgccccaaccaggtggagcacgaccctagggtccccttaggtcgtcctcccacctccttaaatagttaggtacccctttagagtttcttgggttttgatagattaaagtttagccagtgctacttgcttgcagcgcacgtgtcggctagatcgtccgtctgcttgctcttcggaaccccaacttatcttgtgtattcattcctatttgctattcagattgctttttcttgttctgggcttgtttcttcgatttgcttgcaggaataaggttatttcgcaccggcaagatcaacaacccaggagagttgtattgaacgctaaggcgcaacagaacgtcttgtacggttgtagtcggatcgttaacgtttctcccaaatcatagttatcacaactcaccgaaagatcgggccaacaacagccttgagtgtcgagaggaactcagggttcatcaggtggtatcagagctttcattactcggtgagtttttatcttcctataaccagaaaatagccatacaaaaaaaatccgtatcatttacctagccatattgtgccattgcattgtttttttcagtttttgctttgttgaattttgtgttgcatcgtctcgtcgtgttgctggtcttagcgtctagttcgtttagagtttcgagttctggtcatgttttataccagagtcgtcgtcgcctctgtgtctctgttatcgtcgggacctacgaaaacggaatcggcttgctgccacgattctatttttgtagttttcaaaagtttctatcggttggatttggagttgttgagttgcatcttgggtttgctgattgccgtgcttctgttttggccgtgcctgtgtcgtgcacgagaggaggaaagtgaattaccaatctgattttggaagtagtcaagtttgttttggaaagatatagtagattggattggttaaaaatcagtttcatttttatcccatacaccaaatcctaattatcggctaccatccactccacctcctggccgactcccactcgtccctttggccgagtccgactccctccctccctttcacggttccaagttgtgtcaaacaccttggtgaatttttgtttggtatcggttttgagatctgtttggaaaaacggaaccggcataaattcagcattccatttttgtataatttgaattttgggtttagacttttacatttgagtccctgtaaattttatatttacgtttgagtccttgtaaccttacattaaggtccttgagtcagtttttgttaaaaaaaatcaagaaaaaagtgagaaaaaaaggcagaaaggtgcataaaaaaataaaagaaaaaaaaactgcaccaaaaaaaacagaaaaggaaaggaaagaaaaaaaagaaaagaagaaagaagaaagaaagaaaagagaaaatactgttatgtttgagctgaacttcatatatcagagttgtgcatgagttgttcctagtgctatcttgtggtatcgtttgtgtctaggctcggtctctagtacgttctagcctaggaccagcacggtacttgactttgaaccattattcaactttacattctctgatttgagcatttgctatccctttgctacatatttaagcctacccagagctccacagatatgattgcagccgtacagcaagtgtttcccaaggcatcgatacatccaatctccattggggtgcttggttaagtcggtgtacatcaccattccgcttgctttggtaagaacttgtaagagcttcgttaaaagcttgagtgtgtgtgatatttgagctgccactacctagtagttgataggagcgtgcatatttttgtgtgtttcttgtttgcttctaaccatggcaggattgcgtaagggaatacgagaacatcgacttctacaccttcgacgagatatgacgacttctccacgtgatgcatatgaggtacatgactataattttgaacaagttgcatctaagttaccattctatgatggaaagtattgattctgttgcatacattgattgggagctagcagtagacaatgaatttgatatatatgatttttctgatgctcaaatgattaaggctgctagtaataagtttacctcttctgcattattttggtggacttatgttagtaataaacctgaaacttaggatgaattgaaaaccatgatgagaaaacgctttgtgacttcttattacaaatgtactctttgggagaaattagaacatctgaaacaaggtgatagaactgttagggagtacattcatgaatttaaggtctgtatcatctacagtggtctcaaagagtgcaatgaaaatacaatgcgtagatttttcaatgggcttaattctgaaattcaggttttgcttgataatgtgacatataattatattgggcacctattcatgcttgctcgtagcattgagagttagatcatatcaaaggcgaggatgcatgaccaatgtgatttatctcctatttctgaatccccaatatacttatgtaatgatgatgtgcaaacattggaggagcaatcttttgtctcccctgttactaacgttttgcaggaagatcagcacatccaagaaaaggagaatggtatacttgagaagaaagaggatgaagcacctacgatgtctgaagaaagttcgcaaggtaaattaaatggtgctgagagaaatgaaggtgagtattctcaaggtgagctatacttgtccacttttcatgctatagtagagcaaccattagtggaatcaattgctgagttgcctttgtcacaa

SEQ ID NO: 38122 - DNA, 22175 bp, Oryza sativa
tcggccgaaatcacaaaaagaaggtgttgcgtcacctataatggcctatgggcttataacttcgtctggaaccccggcccaagtggggcccatgtggggtgcgccccaaccaggtggagcacgaccctagggtccccttaggtcgtcctcccacctccttaaatagttaggtacccctttagagtttcttgggttttgatagattaaagtttagccattgctacttgcttgcagcacgcgtgtcggctagaccgtccgtctgcttgttcttcggaaccccaacttatcttgtgtattcattcctatttgtaattcagattgcttttatcttgttcttgcttgtttcttcgatttgcttgcaggaataagattgatctgcactggcaagatcaacaacccacggagaggcgtatcgatcgctaaggcgcaacagaacgtcttgtacggttgtagtcggatcgtcaacatttctcccaaatcgtagttatcacaactcaccgaaagatcgggccaacaacagccttgagtgttgagaggaactcaaggttcatcatatggcggcggagttggttggagaagagggcggcggagatttttggagatggtttggatggccttttgaccgagagaaggaccggtggcctctactacctgcttttggcaaatcaagtggagacaagtggcaggaatcgatgtggaggagccagccccaaatccaagatctaggcaagcacttttcctattgttttccttgtggcagtaaccatgcagggtttttcgtttacgttgagcacagatcgcatgttcagtcctgatcaacaggattgcagttagtgcttctcagattcaacggagaactccgtggaatatttatgttgatcccggtgaagcacaccaaaatctacggcttaacaacgaacctcaaaattgtgccgttcccgtggaggcagccgaagaggattaccagtttgtcaagtagggtgtatgctaaaagaggtctttggatgtaatcgtcgcggcaatgccgcggctccctgctgatcacatctttttacagccccatggtttcattaggaattatgtttcctttgttgaactacccttcctctctagatggatggttaagtactttatgtttcatcttttgttgatgtaccgggaattatttccctaatgctgtcctctaataaaaggtttgtgttttcaaagaaaaaaataatacaatgaatctagatagccttttatccagatttattgcactagaaaatgtcacatcccctcctaggtttagctattttgggacggagggagtaggtggcagggagtaagaaaaatattacttgttgaaacttgcaaacttgtcaaaattgggtttggcgataactagttttgactagagtaaaatgcaccagcggttcttaaacttgtcatgatgtttcacttaggtccacgaacttgtaaaacacacatcaagatctttaaacttggtttattgtatcatcctggtctaaaatctggtttgaccatggtgttgcctacgtggcacgcaatgtggacgataacatagactttttttattttttttcttccttcttattcccctctcatcccctccccacctccttttccccactgacggagatggcctgacgccaccgacgcctcccctcccactccgctcaccgccggcggcagcgccgcctctctcatccctggcggcatcgcctttcctctctctctttctctctctctctctctgcgcagatcgggccacctctctcctccccaacgaactcctaggcgaagggcgacggtatcggcagcgtcgagctccgtgtggcagaggacaacaagctcgagctctctcccctctccattggcgagctcgaggtctctccactctcctcacgactgtcgggggaccgtggtggcgacgaggacagcgaggtcgccagatccggtcgccatggttagtgacaacgacaacgctgcacggcgaccgacaaatgcagcagacatggcggaagggagggagggacggctttggtgcgcggagggatgaggagcaacggcagccgcggctaccgccgctgcttcggcggcgcgtgcgcgtagcgcggcgtgctctgcaccgtcgccggccgggccttctccagcgtgcaccagtcgtagtccgggaagtggcgtgacgtcggggacggcgatgcggggcggcggtgcggcagcgccgccggggaggtagcacggcagcagcgacgacatggagttggcgcaccactcctcgccgccgctcgcgcacccggcgtcgagcagtggggatctcgcccgccgcgacgacgacgaccgcgacttgggcctcccaatgtccacctccacgatcttggggctccggtcgtacccgtacgacgacgactcgatgctcgtcgacagccgccggctgtacgccgctacgccgtgctcgctcctcgtatcgtcggtggcgcacctctcctgctgcatccatcgccaacacacaacgtcaagatcgaacagaactagtacggcgaatatatacatggtgatgtgtcggcgagatttcgccagcggcgtaccagcgagcggcggggccaaaagggagcgtggtggatgtgagggagatgggcggcggcgccggcgccgatgcagtgggcgcgcacggtggcctgcgcgcgatgagcgcctgcatgctctgcagcgtggcggcggcccgccggcgaacgaggaagccacgcaccagcgcctgcagcttcaccagagccttcttcgcctgcacaaacacacggcatgagtactccatcgaagcagagctagaacacgagcacccattgctttaccagcaagcctatgaatgctgtttggattctgacagcggcgctgatgcgcagagggagggagggggcagcaggcagtgggagcgacggcggcgcacggagggggcagcgacggcggcgttggcacacggagggagcggcggcagcgcaagaagggagtgacggtagtggcgtgcaggagctgcggcacccaccctgcccctctcactaatcccatctcatcgtgcacgtggcacacgcacacgtggcatgccacgtaggttagaccatggtcaaactagattttggaccgggatgatacaataaaccaagtttagaggccttgatgtgcgttttgcaagttcgtggacctaagtgaaacctcatgacaagtttaaggaccgctactgtattttactcttttgactatgaggagatatatttggttcgaacagattttgatgtgatttaaagggtgggagatctcaaaactaccaaaattttgtatgttaacaatggttggaatacgtttgatttagtttggtaatgatggttatagtatactaggtgaaaccccgcgcgttgctgcgggactttagtatggtaacaataaataaaaataatgtgtaggatttctagataatataagattacgtaagttaacgtggtttatgataatttaaatttgaatagtatatagaatgatgatttaaatgtaaaagtatggtgatatgactttatgaaagaagaaaagtattgggatagtttggaccgtagattaattatctaaaggctaaaaataattaaggtgatatggattaatgagagaagaaaatgagagagataatttggaccatagattattcatttaagcacttaaaaaaaattgatgtgatatggcttaatgagagaagagagaaataaatattaattaagtgatgatgaactatatatgtatatagcatattataaaaaaataataaatatatattaaaatattatgtgaattatgtgcgatgatgatttaacatgcttacatttttgaaagctcgaaaatttaataatttataaaattatagataatataacatgtttgcatgttgtttaaatttaatgattgttagtggatgatgatgtgacatttttgcatgttaagttttagtagttagtgggttacaattttatagtaagagatgatttggtttattgtcctattaaaaattgataaagttgaaagtggcaacaaaacaaatataccgggaaatgctacgctgactagtggaattatttttcaataaaaacttcatacatgtatgcctgatatatttatgtatatggttagcagttgacaaaaagatataggaatcaatccaccaactaaacgtttgttaggaaaattattattggtgaacaaataaaaagcgctagtcatagctctcaccattggggttttcttcaaaatatttgttaggaaaaatggttgattaacaaatataaagtccttaccatagctctcactactgtatctttcttcaatgtttgttaggaaaatagttgatttaacaactgtaacgtgtttggtattgctctcaataatggatttttcttctacagtcatgcattgatcttcctttttcatacctatcaattattgattcagctactaaatcaacatccaactacatatgctttcctttctatcagatgggacataaaagaaaatgtaacatactcctaagaaactacacttcggtgaatatctacaaaggtaaataatactaagaccaataaaaaataatagaaattcatatgcttgaaacgatataaaataaacaaatttaactaaagtcgatcatatgtggcacttttgggacatcgcttaaaatcttattacacttgctcttaagagatggagccaaacataaatacattgtgacggtgatatgggcccggggtataaaggctatagaggagaggcttcccccggtagccacgtggccctcccccagagggggttgggcccgaggcggggcggcagccgctcccgcatgcccgggcatcgggctaccccgacctcctccgcgcggcgtcgcatgtgccgcattagacgggcgcttccagcgcccacctaaccgcatttaaggcggtctgagagagcgcaccacgcgctggcgtggtgcgcttgactgttccgtgaccggtctgtgaccagtcgaataaccgatgtggccggggtagtgcgcctgtgcactggctccatgtcaggcaatcctatcgggggcttcagctccactccacaggcaaaactcaactggggtctgagccttggtcctctaacatcgtcttcagctcagaagcgctacacttctaaaaaaggagaataatagcaaggctgagtacaataactgtactcagcaagccacaccagtgatgcagacgtgcaaggggatacaacggagggcttgtggctatttgcatgaaggcgcgttgcaaagcattttattgagcaaaacaataaaacagttgattaattaaggtaatattaaagttgcataaatcatcgatatctacaacttttattttggtcattttgctatatgactctatttcaataatttgaatttgaatttcaaattatgacaacttcaaacaatattttcaaatactaaatgatttcaactgaaaaagttatcaacatcaaagttgtataactcatcaatatctataacttttattttggtcatttcttcatccgatgaagtgatagtaacattgttcacaaaatttacatatctcttatatggttttgaagtatttaaatagcaacgaaattgctataacgtcacaggttttgggccggtttatgacgaaatcgataaactgtcacggtattatgggccttgtatccatagttgcatatccgtgacaatatctaaaaacatcacgaaaatttcgtcacagattaaatagattcttgtagtggcggttgcaaagcattttattgagcgaaacaataaaacagttgattaattaaggtaatattaaatctccactgatcaacgctacaccacgttgaacaggcccaaccaaaccacctaaactacctagttcattaagccagttaaaggtgagactaatcacggtgaatatggttgatcgcccataaccgcgggcacggctattcgaatagttttactcttgccagaggtgcacaactatacccacaagtcacaatccaccggcatgtcaccgtgcctacgcagacacatcactatgttgagtgattgtgacaagacccttcacataaccctcccctaaccatccacaccacgcaaaggtttcacccccaccccctaccccggaggtgggcagtcccctcgtgcatcgcggtgaatctggcatctggaaaaccggacaccccgttcgacccaactccatcacgcccaccctcgccaccggtgcctaggaaagggtcgagctatactacagatcaagcagttacctattcccgcttgtgttaagcactgtaagtcttccagggtttcccgtgaaccggtccttaattactatgggcgcgactagcaaaaccatgcacctacagcccacattcagccgcattttagttggataattatgaccaatgaaacatggccggatgtctcgagcatgcagctcgtcaagatactagatgtctaaaactgtaattatcccattatgtgagctagtggtaattaagcatggctaagcatgtagttctagctaggtcaacataagtaacacaagctagtcgaattatcacccaagtttgacaaaggacggacatcaaataatatggcacaagcgagcagataggttgtacccttatcccatgtaattagcaaaacatgcatatttatttgcaaacggtaaaacatttataaagtaggctcaatatgctcaaggggggaatgtatgacttgccttgcttcttcaaaagatcttctgaactcttttcctcgcgatcgcgaacttccgaaatgacggattctacacactggcatgcaaaacgatgaaaaaccctaaaaaccaagtaaacaatacatcaaaagtaaacaaacatgtagagctcaatttaagatgaattttgcaatttgaatggcccaatttaaagttcgaatgaattatatatgaattttagaagttttgagccatttaaatggatttctacaattaaactcgatttattgcgtaattattaattatttttaaagggaaaataggtgatcgctgacgtcagcaaaagggagaagcttttcgcacgtcagcggctccaagggaagggcacacggtggaccaagtccaccgcggtctaggtggcgccgaggaccaggagcacaggcggtccacgggcagcgccaaaataggcaacggaggaagggggctggctcgtcagccggctcgaacaggcggcggcggcacccggccggacggccagcagcgacggcagcacaacgcgggcaaggggagcagcggaggaggggaaaaaaggagaggcggagggaggcggcggcgctccggtgactgacggcgacgacagagggacggccgaggatcaggacgacctaggaaaggtggtggcacggccgggcgaaacccctctcgcacgcggggagcggctgaaggcagccaaaggcggctgtggcttgggagcgcgagggagaaggcgtttaggcggtgggttggaggagcaaagcagcccccggggtggagcttgatgcagcgaagtcgacagcgcaagcggtgaggcgtggtgatggctagcgcggcggcaacggccggccggaggcaacatatggtagtggcggcttgggttggcggtggaagcagcgttcgggcggtggaatgaaagaggggcgcgtcggttgttctgcaacgtgaagtggcggagctggtggtgcaggtggcgtagggcggcggcggctctagcggcggcggcgcgcggccagagctcgtcggttagcggcggagcacgggctcggcgtggggagaacgggagggggcgcagggagctcggggagaatagggaaaaatggagagggaggtgctgggagtgtttttatagggctcggggatgaagatcgtggccggacgtggcggatttgaagggggaaagtgggggtagcgacgtggggtggtggcggcttggccgatgccgatttttgtgggacgagtaggggggtttggtcgaggaggtggaggggatgggcggcgtccaagcctgcatgtgagaaggcgcgaggaggctggaggaagcggcaatgtgggcggcgtggctggcggctgccggtgggtggctggaggttggggatgacaggtggggctgcgggtcccacctgtcggagagagggagggagaggggaccggaatgggaggggaggtggactttgagtgagagggggaggggaagtgagctgggccggcctgagaggaggcggtttttggcccaaagcaaaggagaaggattttaattcgttttctctttattttaattgattaaatgaactttgttctattaaaattatttcttgagctccgaaaattcgcgagaaatttcagagagtattttaggacaccgagaatattacaaaatatttttggccatgatttttaaaggaaattttaaagtccctcattatttcacttgattaaattgctttaatttttatttattttctagaaaatgcattatttaatgatttttaatcccgaatgaaaatcggggcgttacaatacccatcgggttctcttgccccatacccacacccgcgatggataaatattcccacttaaataccacacccgtcgcgggtacagaatcgtcccgtacccacacccgtgtaggtaacgggtacccatacccatataattgacttgtagaatttatagttttgtactgtaattagccatattagaactgtaaaccattaatattttctctagcaacaatgctattaagattatcattcaaaggcgagtaaaaagaaaattctacaacgcgagtaaaaagaaaattatacaacaacattacgtaatcaagaaattaaataataatttcatataactaaattggaataatgcttaatatatgaaaggagttttatgctataatttagtagttagagggacttacgttatttattgttttaggttcaatctacgagtttctttttaggttcaatctatggttttctttcaccaacggatggtgggtacatataggtataggtaaaaaacatatccatacacacttatttaataggtaagagttatttagtagatccgtagatataaaagttagaacattttttccctgatagagtaaaaacccgtcggatatcgtgtcatgtttcccattgccatctctagtcgagtatcgcgtaaaagaaaaagaaatctccccgtctcgttctcgttgtctcctccgctccttgcgccgccgccaagacgagtcgcgtcgcggctgaacaggggagggccgggcggcgatctccatctggcgagcagagcagcggaggggaggggatcctggtgagcatccgcgtcctccttctgattcatctctctctctctctctctcccaccccaccgggactggaatttgcttgcgttcgtgaaccctactagcttctcttctagatcttctcctcctccttaatttgatagccttaaacctctcttaattcaagtaataacagtttttttgttcgcccaaaagtttgcgggttcaattgaatccccatgtcccaagttggatccgcccctgcatacgagtgacttatagttcatgatctagtacacgaatatttcccagttcctttgatcaacaagctaactcaaactccaatggagattgcactgctgttttagcttctttttttttttttttgcactcatattgcgctcaggtcaaatgatagtgcatagttatcagaaagtgctgtaatcttgcaaacaaaaagttttttgtccctttacatggaaaaaaaaaaggttctactttcttttcttgtttggatgatgagcgatagaattacagcctacatttccagcttactaaggagcatagctttttttttattatataataatttgaattggcggttgttcttgtcaagtggtaccctacatattaacccacatttccagcttactaaggagcatagctttttttttattatataataatttgaattggcggttgttcttgtcaagtggtaccctacatattaacccagagactaatgaaacattttttttctgttatagtagttcccagtgtcaaacactgtatttaagcattaatttttcggtgctcttttgagatgccgcctttgctatgaaaatatcctgcttggaccttagtgtatgaactacttcagccattaattgtttgagggaaatatgttatcttggcatcttttgatgtcctgaagtattcattgcaaatgatcaggttgcgtatgatatgatagtaaatggtgcaagttcaatatttttctggaactgcatgaactttgtcacattgcagtgttaatttattatgtcctaacctgaattattttatgcagaggaaatgcaagttaataaagaggcacctctggggtgcctcaagccaatttctcagtataacctgcaagagcagagaagcaacgggtttcctgagaatagtgaaaaaaagaatgatagtattgcaacagaaagagtcttggaggcatctcctcttccaaatcaaggctttttcagacccgttcaacggacagaatattatgcctatccatttatttatgctgattaccaaatgccgggacagccacaaccttacaacttagataaccaattttatcaaataaacagggaccacagttttcctattgagagtagagttcaatatcttccattcaagatgccccctcaaggttaccctcctgatgcacaacttcaggaatttcaatattttgtggttattgactttgaagcaacctgtgacaaggagaacaatccacatccacaagaaatcattgagtttccatctgtcttggttaacagtgcaactggacaacttgaagcttccttccaaacgtatgttcggccggcatataatcaacttttgactgacttttgcaaggagcttacgggcattcaacaaattcaggttggtgcctattatagttttgaatattcgttatctttgataaccacgcaagattaaaaaggtttcaacatgattgcttggcctaatagccttcattgctaagtgatcatttatgtacttaaaagtgtataggaaaaaaagagccaatgtttcatgttactgccgattgaaaaaccagtgtacagttgaggcactaggctccaagttgggtggcttaccagcttgcatcacctattagccaatttagagaactggtataagcacactaaaattttcttagaattcagtaaaatttcttggtcaaatgtgtctcctgtaggctagattagataaatcaccatttatgtatttgttccttaggtgctttgtatgacaaagatcaatttacaatccatagtccaaagatgtactgtggtgttctacttatcctatcaatccatgattggtcgaacacagtcctttcacacctggatcttctctctctttgatatgaagctttgtttctttggctaagagctttactgaatcatcttcttccaaatattccaactcactattttacctgaaccatccatagagccatcacatttctgctgatattgtcttcagagccatccaaggagagatggcagttgaacattatgagcagggtcttgttgttttctgtttcttgtttgcaattgatgatctgtcaagaaaacaactaggttctgtatttcaggcaacatttgatttgacactgataaagtggaaactgtaaggaagtatgcatttccatataaatttagatttggttgcattatgtcagctattcttagctatcatatttcaagtttagcacatgacaggcatagttacttataaccttttgtttacgagctcttcaagttgtgcttaaagtttatgtttaaagatggtttttttaatggcaaggttggctctggagtctataactcaacatatttaatccatttgatgacaaatcatacctaatatgtttagtgaacaaattatcgttctttattctttcatatatttaaactcataatatttacatattaatatgtgaattttgttatcttattgaaactgcattttacccactttgaaaaattatgtcttactcacacaaatacgatcgatagttttaagtattctttcattcagaggtaatatagttttttccatgcatgtctaggtagacagaggtgtgcctctaagtgaggcattgctcatgcatgataagtggttggaggaaaaagggattaagcacaagaacttcgctgttgtgacatggtctaactgggattgccgtgtaatgttggaatctgagtgcagattaaagagaatcaggaagcccccttactttaacaggtaacagatatcccatatttacctggcccttgggctgcctgttctgtttcgatataacattcacatgctatactaatgtgtttaggtggtgtttggatccagggactaaacctaatctctgtcacatcggatgtttggacactaattagaagtattaaatgtagactaataataaaactaattgcataaatgagagctaattcgcgagacaaaatttttaagtctaattaatccataattagcatatttactatagcatcacataggctaatcatggattaattaggctcaatagattcgtctcgcgaattagtctagggttatggaatgggtttgtcattagtctacatttaatacttctaattaatgtccaaacatcctatgtgatagggactaaaattttagtccctgattcaaacagccccttagttttgtactctcttgcacgtaatagtttagttgtgtttgttgcacaaaattttacatggatttgtaattatgttacaacttgccatgttaatgtgacttggcatttattcagtcgtaacaatagattactgtctcaatgtattattatttttcaatttctagtgtgaaatttaggtcatcagtgtcatgacccgaggccatgacaggataaacaccgtcgggaagatagccgggcggcgtcggctcctggagaagggatgtagatttaggctagggagaagaacattgttgggagggagacattagactaattgatattcattgcttcacttgagatgaatacaatacttcccttatatagagatgatgtgacttgacccttaagaaactaactcaatctaatcttatccatctcctaaccaactgctacagtggccgtggtactgttcatccgctaggggatgcccatgacactacacccctccatttgagcagctcgtcctcgagctgcaacacagtgatgccatgcctgatgactctctaaataaaacttaacagtgacttaagccttttacatctcgacttgctactttagtgcaaactaataaatctaagatgacagaagctagggtatcaatatcatcttgtcaacgacactcactggtggaccccatccggatgctgttacaggaaggattgaagttctccacgtcctaagtttgtaagcccagcaacttagttttgacgttactgaaaaaatctcacgtggccacctattaaaccaggaccatttggaggtccccgttgtcttcagcaatagtcgacccggccagcccaacagccaacacatgggaggaagcaaagctgcatctctctgaaaccgcggcgccgccaacgaatcggagacacgcagcccatctaaaacagaaaatcgtgctgccacgcaatggcctcgtaccctggctgcgcgcaacacgcgccatcactgtgctccaccttcacgcaaaacgccgacccaccttcgtgccatgccattccgcccgcctccgaggaccacgctggcgctgcctcttgctcctttgagttcgagaaaccagcctctgatggaggaaactgagacgatggcaccactgctggcaatgtcctcgtcgtgccctccacggtcttctgctgtgttgccatctcttgctccaccaaggagtccgccggcggggacatctgagttaatggcatagcaactggcgccatgactgctaggtctaccgctgccaccttctgctttgtgcgcccatcttccacctcttttgatgcattactctccttcaacatggccttcaattcaagcacatttgctatcaattccttagtgatcccgacaagaggtgttgccgctgcgggggtgctactagaaggttgcgcccactgtatgttcagccaacaacagccgtcatagatggcacggccattgagtttccaagcatgctcagcggccgctctagtttggaacggaatagaagcctccacatgtgttcccatctggaacactttgatattcttttctgctccgtaaccatcaaacaactggtggagtagatactcatccaccgggtacactagatggctcaccgtgatacggagaactcacttggcattggaagccatggtgagtggctctgataccaagttgtcatgacccgaggccatgacgggataaacaccgtcgggaagatagccgggcggcgtcggctcctggagaagggatgtagatttaggctagggagaagaacattgttgggagggagacattagactaattgatattcattgcttcacttgagatgaatacaatacttcccttatatagagatgatatgacttgatccttaagaaactaactcaaactaatcttatccatctcctaaccaactgctacagtgcccgtggtactgttcatccgctaggggatgcccatgacaatcagtttacatatttaccattctcaagggaactccttttttttctggcatcttcaaacattaacatgaggagccatgccattttgtgtattgcaaaccatggcattggtttaaacctgtacacttatttaatttcactacaaaatcagcataaaaagtccaaaggaaactgaatgaagttcttaacttagcatacatctacttagaatcaagtttgaattgaacatgagttggaagaagcaaaggggaacaaaaacgaaaagcaaaccaccggcacaaacaaacttccctttcttgcttgccctaatgttttaatttttgtagtatgttggagcactacatggagcatgcacttgattctttttaaaggagccttcgtgttaattttgtagtaaactgaagtgttttccattattgcactgaacagaaacaagaaaaaagaaagtaatttatctgaacgcagcaaaaaccatgtcatagcattagaccaaaagttttacaggatgaactttcttttcctgggtcaatctggtaatatattagattcagaacatgtattatgcaaccacttcttttgtgatcatgtacaaagtgccagcttgcacatttttcttgttcttttactgtgtcagtaccataatcaggcaggccaccagtcagcagctgtactgtccttgtatgtttacctgagattctatcttcaattaggcagcttgttaaaatttccagttagagagattgtttagcccttgttagggagactcatcctctaaacaactggatacaacagttgattagtggtaaagccacagttaccgatccatcctatttcctgcttttgtccttccttctgcctggccttgcattgtggcaactggcaactggccagtgaggcctggggctgaacccacctattacccatcactgcttgttggtttcccttctggttctggaacgtgacgtcaaacaagctaagataggatgggatttactaacttgtttattgggactaagcagcacaattttagactaagttaaaggcttacagattaagttattaataccaagatttttggtggctaacatcatgattattaagacgtcacataggcgtgacctaagcatttattgggagacaatgagagggagaagcttaccctggaaaccctagggtctcgctgtgtagtggatatgtgctacccgcctcaaagccagcattttctccctgccttgatgttgcggcatcttcctccccagctcatccccatcggccagcttggtaccatattcttgcaatttttgggttacaatgcagtccgtcctctgctgctccttctcctgatctaacattgatttgctgctctccctcccccatcctttctttgctttgcttcttgccccacctaatcatgctgtcgctgcttgctgttgtggcagctaggcttagacactgagaggggcagggtgccagggaggttgagggagcgagcaggctgtacccaacaatttgagaccctggtgcaaaacacaaagtatacatatatttgtgtcaataaccaaaatatatatttctcattatattactgcaatatatgttttcatttcacaatgttaagaattatattacgcattcatgctaaaatagtaaagattgcttgtaaacacttaatatatcttaacttatactgaaaagcgacatccgtctaaaattacttgaaacaaattcttcaacaatatatatctgataataattaatcttctgccaaacatatttttcaactgttatatttttttttacgtaagaattttttttttaaaaaaaatgatgcaagcaagtgttataattgcaatccattaagtctttcttgtgccatagtattatatacttaagcaaaaaaaaattgcccctaattttagaattttagggggggggggggctattccatttcccactctgaacaagctcatataagggcctgggagtgagagaggacgatatgtgggttggcctagtggacagaacaaaaaagatgagggttgaagccacatttcaagacccagggtcattgtggatccgtgagttagtagttaacttggtttgctgtatggtcatgaagtgtggcagggagggatgagaacagaggaaaggagagggacgagggggatgtgggctgggcctatcagcctaggaggttgtaggaagttggtaagccactcagactcctagacaaaattgaagaaatacagcagccttccacagctccttcatggagaaaggagagcaggagcacaaggagattgtggaggaagcagcttggatgctttatgagagatgggaagagtgagaggcttcagcctgcagcttttatatttttattgctttcacatttctttacatcaatgaaaggagtagccagagaaagcagcctttatggttttattatagcggtacattaggatcttttttgtagagtactatcaattatgtgattattgataatacgtgttgtaggtattttataattatttaggtcatgttctttttagctgaaatccggatgaaagttgatggatgatctacttgtttataggtatgtatatatgtgtgtgtgtgtgtgtgtgtgtgtgtgtgtgtatgtgtatatatatatatatatatatatatatatatatatatatatatatatatatatataaaataaagttacagtaacttagaaaaaactaagcaacgctgacagaaatcgtacttttggaagtgtggcacgaataatcctattgataatctggggctataggctaaaaatagtggggccttaatttgttatttgataattctataattcatcgacactgatttgttggggtcgggtcatatcctgcatcctgaactagcatttcgaagaaaactatccccttgtaattttttacattgatggtcttcaagtcccatccagttgttgtactcgggttaccggtgactatggggctgggcctggtgctttatttggcttttttttatcgaacacagaggagagctgctttaattggccggtttggggttctgtgtgcattcttttttgtttcttcgttttggctgtggtgcaaggtattctttcaccttgtgcctttagtgtgtcttaactgcagttgctatactctgatcaaaccagattatgggataagtttttactattcgctatgatgtaagtatgaaatattagggcttgtttgaagtctttgaacatagaaatttgaatggactttgtaagaaacagtgcaaaatcccccattgacacattttactatggaaattcacttttccaaaggtatcaagttcaaattttgtggaagtagatagtctatttagaagtagactatatgttgcaagacaagcatgtttggggaaaaaaattgtttgccacaaatgaaactcccattctcatttgttccactaatttttgtggtctttgacatttgcgacattagcagtcttctaaaaaaaaggcatttttccggtttgactgtcagggggttgaaaagtaaaaatgagaaaaagacaaaactcatagcataaaaatatcataaagtacagaatattgaaggatcacatttgaaaaaaaaggctcagaaaattgatatactaagaaaaaaatctatgaaaacttctactaggtgacaatgataagtttatttatcatttatgcaacatccttaagatcttaagttttctgaaagtttacaaattctatagaaaatatcgtccttgtatttttctgttacgattttctgaactttccatgcattatgcttgaattctcttaacagttaccctgccctgtaagaaaaggaaaatgacatttttaggaggtcactgtggtagtggcaaatatgaaaatagtgaagaaaaaagtgccataaatgagaacaggacactcattagacatgaactggaaaattcatcatatatgttctgtatatttttttatatttcctggtttgagattatgtttcatgctctgttactatatccaatttgcacaagaaatcattgtaattaacaaggtgagaaacaaccttgaatgtgttattagtggaagtataatgttaaaaacaagaatagcactatagactttttatataaagttggttaggttaatagagtaatttgactgtttttttcttctgtatgctgcgtgtctcatcttatttatgatgagaagtagtggagatgtttctgcatgcatactcgatactctgttcagtttcatagggcgcacgcgaatatcaatgttcaaagtttgtatttttttcttctagaattagtccagcattatctagattttgttttaagaattggcaccattggatttatattttaaaatactttcctatggccataattttgttgtttgaacaatatggtgtaaaaaagtaacggtcaaactttcagttttggagacccaaccaaatcaaacagtgccttgtaaaaatccaatgtacagagtaacatgtttttacttggctttgtaatgattaaaagtcatgttggagtctctgagttaaaaggcctgagtttattttgaatattcttatagaagccaaccgtggttctaatattgacgtcttttgcacaaattgcaggtggataaacttgaaggttcctttccaggaagtgtttgggggtgtccggtgcaacttaaaagaggcagttcagttgtctggccttacatgggagggccgtgcccactgtgggctcgatgatgctcgcaacaccgctcgcctccttgcattgctgatgcaccggggcttcaagttttcgatcaccaactcgcttgtgtggcaatctgccccgcagtcaataacgtgccagtcgtcccctgcgcactctccgtatcccaaccaatcacaccataagccaatggaagtgatgggatctcctgtgcaggttaacccatacgccggcatcacagtgaagaagccgatgtactgccactgcggcgtgctgagccagatcaaagttacctacagaccaggcccgatgcacggtcgatatttctacggatgcggaaactggacatccacaaggggggcaaactgtgactactgggtatggttgtcatgaaagaaaatgaaatcctgcctccatgcgaaatccgaaatccgaaggagggcaaagacctggagcttttaacaagggaggctactagtttgcagttggtttggcttgctgcgcctccctcgtcgtatatatgatataactttgctcataagactattggaagtttgaactaggtagtgtctaacctgtcaatactgacttctgttgatagaagagaatgggggggatcagatgctgcttaggatgctttatccatgaataatcttaagtttgtggacgcttggttttaacttaaaagatgggaccatcgtaggtgtgatttgtgcgacaagatgtctgaagtttgggcttgcaggttgttttgctcacattgtgccagtaagagtgattgttagaacagagtatacacacatgcatcatcattgtcttcttcctgaaatttagaagtattaaatcagatgctaaaacttcgtcctataaatataagaacttttccagcattagcgtaaatgtgcggcctataattagcgttgggaagcatatcataatcatgggagcacctctaattctaccaaaagcacaaatcaatgaccatagttgatacagttaaaaaaaagcttcacggtttcagactttcagtgctgctggcagtaagctacagataaaaccatcgttgacatacacttggaacatgtatgtattgtagatttcggagaattgaaaaaaaagtggcatgaacatgtatgtatttttcgattacacggtacacacacgcaacaccacacctgcccatgcacccaccaacgctcaaagagacgaaactaacatcacatctatctcactaaaattttattgaaagcctatttatgagtgtgtaatatattcttttaaaccatggttcccttacatgtaattaactgatcgcacatggtcttgtacaactagtaattttgaggacgattatgcatttgtattttttgttttgaatctatttatttgccatccgttacgcatcaggttattcatcaaaacattacatagatttgagtgctgctgacagccatgaaaattctcgagacgcagcagaatgaactaattcccaggaagatcaaacgagtagaagttgctaatttcattgctgctgacaatgatttcattgctgtcatagttcacaaatcacatgtgtagtgttcaagctatcatagaccaagttcacaaatcacatgtgtagtgttcaatcgacaaaacacaatccatcagtcacagaaatttcaatgcaactgaatggtcacatatccttgattagattattgacatggcgctgtgtccatgacagtaagctagtttttcctaagagatgtcaaatacccacgggatagtcaataagaccgttcccaattcccattctaatgattctctgaaaattaggatattacagatacataagtaataatggaacagtattttacagcggctaacagtacaacatgggccagggcctaatgcacttaaccataagactaagctacctgaacacaaggatctcttttggattatagtatgtgcaaatatctccgaatcaagtcctttgcaggattgtcaactcttccaggtaagatcaccatcacctcccaaacccgaaaaatgtggttgcagtcaagttacttgcgcttgctattctttcggccgagcaagccagagggaactaagggcacgaagccgcgaagagtaatcgcttatcacaagaagcgcacgggcagactgcctagtggtcagtatcctttgcatctgttgaagagtctgctgccgcaggttgtcagccttcatatagtggaaaagataaagaggatttagtacacaattttgaactatagtttactcgaatccgcatactacatactccatggacatcataagactatacccaaggtttacatacataatttacactagaaaagagagagagagaaaaaacatggtacctggcgaaggaaattctcaagggtcccaagcttccccatggccattgccatttggcccatgtagtttgccacgtttcccgttgatccagaagaaccaagagacccagccaatgtttctgccaaggactgctgaagggcctccattccttgtgaaagagcatcttcagcttgttgtgaagactgctgaaggttggctatccctgacagctgctgctcagtgagaggttcaagctgtgtcgaaagaagctgcagttttcttacttttagtaactc

SEQ ID NO: 38123 - DNA, 1743 bp, Oryza sativa
gtactaacatgctctccaatggcaagaaatgaggtatgcaagagttatgcaaagcaagatagtgttttatcaaaactacaatctgcctattacagcacaagtttacaatgacctggtgatatgagtatatgaaatagaaggaaaaataggtatagactgataatttgttcttgatatgctaataatattatggtagaaacattggttttggtaataggaggggctttgcaatagaaggatggctcaaataaacaacaagaacatcgtaagactttacagacctttaaaagctcggatggtcggaatcctcctagccacaagaaacacctctcagctggtgtcttccacatgcctgataacacatgaaagacatctgctttggccgcatttcctttctgcttgaaaatctcctcatagtgtgacatgatcttgtcaacaacaccacggagctcattatcacctgcatgagcattgactgcagaccttagctcattaatttgcctattgtgttcttccaaccaacgtgcatactccatatcaaaagccaatgcccctgcaagaaaatacagtataattgctctgtcaacaaggcagaatgtttatgtattgctttcatatatcccattgtaatgatcaaccaaacagttgctgctgcaaaaaagagtgattatatattaaacattgaaggatttgatatataccatttccactcatggaatgagtctggtccactgagctggatataaaaatgccctgtgagaaattcccgtaagcctacttgaaatgaactcttgcagccagagctcaaaacagcgagacacaatagaagcaaacctgctgacgagctcgttgcaattcttgttctagttgtgtaagctttagcctgctattctccaattgttgaacatatgcctaaaaagatgaagttattcaatattgcatcatgaccatgaaaatttgtacaaaagctgaaaagaataacttgcatcaaccattttccctttttacataatgtaacaatatcagcagaaactttaaaagtatattcattgaaatctgaacagtaagccaactagcactgaccattatttttccctccttttgtttccaagatttaacaagcagacccactaaagaccttttgtgcaaaatactggtaaaaatcaccagacaaatacacaaaatacttactacgatataaaaaatggaagtttagtaacccctacataaatcaatttaccattctatttgcccccagcaatatatggtgtgcactgtgccatcacaaaatcctttctttctatacagttacaacccactgacagcaataattaccataaagaagtcaccaagtttagccacgtcatcaacaagtttcagccattggatcaacatgtctctcgattatcagccgttagataaacttgcagtactaatcaaggtcatacttgaggcccagcccagccaggctgcctatctcctctttccccacgcaagtacacaaacacctgattgactaccagaggctcgcattgtatgatagccatgtgtggctcagatcggcactccttgatcacccagggtatcacagccggaaaccatcagaaatgcaataaaaagatgggaagccaaaggagcgcactgttcattccttttaattaatctcctcttaagctcaacaatcaatccttctccattccttcaataagtcaatgaaatatgatggttcactgcaatggatca

SEQ ID NO: 38124 - DNA, 7505 bp, Oryza sativa
agactgcagtcttgcatgcctatataccttggagctctctgccatgtcccgaccagcatccaatctctccagcaaggacaggcaatcacgcatataatgccttaaatatgttacttcatcctcttaaacatgtttagttctcatagattgtagattagtacacgtcatcagcagagagatcatctctggtggtccaacctgatggtagatgcctatgatcacccatcaccatcgtggcctttcactgccaagctacatgccttaattaaattgaaccgtgtatatttgtgttgtgtggattgttccacagatttgagtataagaatcatggccggtgtcagctcaatcaatctgaatcagcttacagaacaggtaagagaacatctgtggcatccttattctcgtttgtgtttctaattgcaggtaataaattattttgctagctcagccgctggagcaacaagcatacttttccaaaaattgatgaagccagctgaccaactcaactgacggtttaccctgatatagtgtgtaagactgtaaatgtactacttgttttaataatcatccctcaaattgtgcaagtgtttaaataatgagtagccactagactccattgcatggatgataagttaaaaccaggtatcttctacctttcaataaaattcattactattactaacttgattatttcattatcctagacatgtacacatctagtgcagccttatatattatgatgggaatatcgtttctcatgttgcccaacaaacaaattttctgatttttgaggtgtgcacatgtctgtctgaactatttacccccatacccagccgatttttgcaagtgattccccatagaattttggcaaaacttttccattttccatgaatctgcaagtgatatagaagttcccaatgcaacgcatgctatcttctagtagaaatgatagtggaatcctaatacaagaatacagtttaataatgcctagtaacagaatgaaaaaaatagaacatggtataaaccatcaattttcaaaacttgaaaaggaataaacttctttagtataaaagctacagcagaacacaagtacctttttcctcaaacgactcttccttgcagcctcgcgattttgggcgagccgacgcaatgtctacaaagtgataaggaaaatatttgttgcaacaacgataatatgaaacaaaaaggagagagctacttgcaaaattttaccttttgatcttcatgtttgtccttggatctgtcagagtcagaagcagcagcaagagcaagctgacctggttcaagctgcaggtgacaacataactatcaagctcccgatattcctattttatataataatgaattttaccttcttgattcctgatgttttacataaaaaaatgaataagactccaacttttatgaaaaagaaagatcagtttgttttgaaatgtctgtggactaaaacatattcaaaaaaatgaatttgatcacttagctttaattttgtaaaccaacaggcattagcatgtaatttttgtttatgcatcctattacttaggccacgttcttttgcacaactccaaactttagcttcctcattttccattagaacacttttcaaactgttaaatggtgcctttttttgcaaaaaaaaaatctatatataaattgttatttttcaagtttataatggtttctcgttttgcatgcactgaaaatctccgtaacacctaagggaaagaacacagccttagtatctattaaattactttctgccataacaaatttctcaatgcaaaaaagcccacatctttatcatattacgcaacttataaataggcctgttacgatttgcatttcatatttttcaataaacgtgtctatatcttttgatcatgctatataccaaaagttaaattacacaagctattggaagggataaaatatcaaacaaaatgtattcaaggaactcaagcgaattcaaggtgcataaggatccaaatcgcatgaacgaattccacaaatctcacaaaaacgtgccataggcaaactttgccagctttcttaatggggaaacccaactgtttatattgttttctggtagtccctaatttgatagacctatgtgtaggtcccatgcacagcacatatgcattgctcagtagctcaattggattattaaatgccaacatatcaaactctgcagcaaagggcattctctgataacaagattttcgtatgaaactaactttctatgtagagaatgccaacatatactgaacgtttcaatatatacatattccatgaattttggagattattactgaacagctgacaacgatagcctaattttcatataaaacatcctctacagtatacatccttacttcgtcagacaaccttgctgttttaattttctattgctagaattgatgctctttctcacttttgaatgataattagtataatagtttagtagtttcctccaaacatgaaactggacaattgatgctttgtgcccaatcatatcaaggttaacaagaattagtctagaaaaaagaaagaaagaaagacttgccatgtggttatcatcggtatcatctgttgatgtatctgtcctagggctcatatctgccattgtaaagaatcccaattcccaatgaggaacccacaaatgaaggctagtacagatcgttgatccttttgtagtggcaagatgtagatccaattgttactgcctgtattgacggatacaacatgtcaaagagacaggttggctattaaaaaattaaaatttggtgaaaatagataacactgcacatgatgagtcaaccagaataagtaccacatatacagtttgaaatggagcacacataatagctactccagactaatgcattttacattttcatatagcatgtccatctgtccatttgcgatgatagaattcctatgctctaatacactctaaatgtaaacagtttgcttcatcatgcctatgtccaacaggaggtacaattgaaatacacgcagaatcagtaacataaaaggatcaatattagcatatagattattctaacctcttctttacaattattgcgtggctatgtccaacagtcaggcttttcaggtatacaagcaaataaggtgaaagtagaccctactgtaccatgaactttgcatggctatgcatataaaatgtaatgttaaaaggagaaaataaaaacatgtgtttttttagtaagacagcaattataaatgcgctgccaaataaaatgcagcgatacctcaagaatgtggggggttcacccaaattgctgagaagcaagctgctactagcagtcgtgtagcactccaccacagccaagcattcaatggaatcctcaacgaagcggacggattagctggaggtaaaagagaaacatccatctggatttaaggctctgttcgtttcctggagttcccaactcccccatctcattttccgcgtgcacgcttttcaaactgctaaacggtgtgttttttgcaaaaagtttatatatgaaagttgcttaaaaaaattatattgatctatttttgaaaaaaaaatagcaaataattaattaatcacgtgctaatggactgcttcgttttccgtaccggagggatgggttcccaactcaaccaaaagaacacaaaagaacagagcctactctggacgcatcggcaagttagaccacctcatcgccagcgaaagaaatgaggcggagccgagcccggacggatctccgggcggccgggcgggccacggcagagttgcggcgcagggggaggaggagccgaggaaggggacaagaggaataccttgggacagcgagcctcggcggcggagaggggtcgacgagcgacgaatgggaggggaggggaggggaggggaggggaggggcagccgccgtccggccagcgggggaagagcggcggaggcacagagcagagacgaagctagggctttctatcctcgtgggcgggagaggcgccccccaccgtcagtccggcggacagtggggagggagggagggacgaggagggggagctgatgctcgtgggcggcgcgcttcggccggaggaggaggaggaggaggggcacggccggcggcgggggcggagaggggaggagaggaggagggtttgcgagagagagagagaggagagatgagagaggggtttgtgttggggcgaggaggggggatcgcacttggcacgcgtgacgtgaggagggagagcggcgctagcggagtgaggtgaatttgggggtgagaaacgagggtatgtttcgggagcttcttccaagtgcagattcttgtataagctagcggctagaaaatctataaacagttcagtttttcataaactttttattccgttatccgccgaactttttggttgagaccaaaacttccaaccccataccggaagttccaacttgaatcgaaagttttcatcactctaatatgctatgaagttgtgatgtgataatttttaggaacgcctattcacccccccctctaggcgacatcaaggtcctttcacatgtctctttaacgaacggtagcgcgccacgaagtgcgcctaaagtcctagtataccttgttattggtaactcatgagcccatgtagcatccaccacctccatggcagtatccatcctccttagaagcatcgatatttttttacgaagataatagattcagaattgaagattgatggttaatgaattgtttatatttacttgagtagcataccttgttgatgccctgccattcattcttccaagcagccaggcacgcggataatgggcaagataattagataaacaaaaaaaatagagacaacaaaataaacatttgagcaacaacaaatacataaccaactaacaagcagtccagcctagcaggcaaataaaacaaaagacatagcaaaatagtgggagttatcatacgcctaatggcatatatagataatagtggtccacaattccacactctaaacaaaagtattgtaagtccaactcattgcctcttagtattcatcatcaaactcattaaaattgtcattagcatccaaattctcttcactctagtgggaggttcattacaatcactcacatttgtatcatcatgtgtatcctcctcatattcttcttggtcagattgcatattttactcatcttcttcagttgttgttgtattcctttgacgcctttgaaaggttattagaccaacacgattgtgagctctccttggaacattgtgacctcgaagatagtgtgtcgtaccaacagcttcatccacatcatcccatgtaatgtcacatccatgagcatcttcaactggctcattgccccaaccaaactcctcaaaacactagctatgaacttgtagctcgaacaaataaaatgtatatgaatcaaagggtgacaaataaagtatctaagcaagatataaggtcaccaactaaatcaattaagcatgcaagtagatcgggtaaaaataagctcgagcacaatataaaagatggcaaaaacgagcaaaccaaaataggagacacgttgatttgtttcccgaagttcggatccacggatcctacatctccgttgaggagccacaagggccgggcctatttcaaccatttcctcacgaggttgcacaaatgcactcctcggtttcactcttgatttcttcccttgcggaggcgaaattgaagccttcacaaactttccgtggcacaccacaaccttcggtgctcaccggcgacgcctagccgtctaggagaccttagtccccaagagtaacaaacacaatcgaagatttgcttgctatgaacccgagtgctcaaagtatggagtgaagctcactagctctcaacttctcaatctctcaatccaactatctccccttctcaaatccctctcacaaaggggcaccacaaaggatggagtgaagctaactaggtctcaactcctcactctctcaatccaactttcttcccttctcaaatccccttcacaaagaggcaccacaaaggatgggaaatagagatggctatttgggtttggatgtgtctaatgttgcccaagaacaacagccactcaaggaaggggtggaggagtttatatacctgagcctctcaaaaactagccgttggaggcaaagacaggaattttcggaacttccgaaaatttacagaagcaaaactcagtttcgcagccattttcggaactttcgataattttcggaacttccgaaaagcacagagtaaaacgaccataactttttgctcgggagtccgttttttataatcttggactctatggaaagctcacttagaggactacccaactcaaccaagaacaagatctaaaaccactcaaatgataggttaaagcttgggtttctctcaaggtagcactatgataggtcactttgagcaccgagacatatacaaacgcatcgacgttgcatccctcttaatagtacggcattcctataatcaaatataaataggaagagaattataccaataggaatgccttctttctatttccttcctttgtcttaagggacgccaacgccaaaaccgtttcaccgtatattcttcaaatgattgatgcggttacttgtagcttcaaatggtctcgcacggtccatcatgacaaagccatcactcacccttcaccacaggatttggttcttcagcgccaagccccttgcttgcccttcaccaccgcatggtccatcgcgaccgagcatcgtttgcccttcaccgtcttgccatagtagccacttcgtatcccacatcttcaatatcttcgctttgttattctttgtattttaggtgtaatcatcttcaatatctttgctttgttattctttgtattttaggtgtaatcatatcacttgagcgtcaacaccttttcaatacttggaacctatttttctcattcaacttagtgaaattattagtctcaatgatccggttgtcaacctccacatgttgactaaccgatcgcatgtataaaaggatatgaataaatgatgagtattaatcaacaccataagtgtcatatactcaaatatatgctcaaatgtaaagatcccaattaaataaaagtgaataacttggatcagatacatgcataactaaggtataggatttgctccccctaaatgtatgcatacaaaatgtttgtgtgaagcaagagcatgcataacaagatatgaaacatggagagcttatcctatacaagaatagaaggcatttctcaaatatagacattaaaataaaaacatacattcatcatctccatgttctcaatgtaaatagactaaataagaaataagactcaaacaaaacattagtctcacatgcatatgtcaatcacatggaaatattatatatgaacatatcaatatgtacatggagagaaagagtgatacatatatcttgatctccatgcattt

SEQ ID NO: 38125 - DNA, 11464 bp, Oryza sativa
agggaaacataattatagtacaaatcatattgtctaatgattgctaaagatacttcaacttagtttgagtaagcatagtaaaagatacataatataggacatgtgttgcttggttccttgcaggttgtacacaacaacacagattgttagcatagtagaaaaaaccggaccggtgcttgacccggtggagtgttgggttcaccggtctatcggttcaaccgttgggtcactggttgaaccgcggtttatttcctaagtatattttgtgttgtcttccagtcacagcaacttacttagcctagtggtcggcaaggttcacaccgggtcgattgcgtgaacgatcctttgagggaaccgagccggtcagggagctggttccggttttttccggttgaaccgctagtccggttttttctactatgattgttagtgacgtatataaagctatggatgttaatgaagcataaaggaagacggtgtggtggctccgagggtgatccaccttcaacagcttcatgatctgagtcaatctaataggataccaatcaaaatgcttttatgattgctagtcgaggaacctcttcattgttttggtttccagtcttttcattattgtagtcaaataacttttctatgtgaatcttatatacctatatagttcatccacgcctggtgtagttaataggaatcctttgccttgtggttaagccacgtcagcaacaaaatgacagttgttcgatttgatttgaatggctgatgtgcaaggcaaattggttgcacacgggaaaggcccgaaaatctaaaagcccaatttataatgttgatggtcctaaggggacagatgctaccatggtccatgaaggtggtggatgctatatggactcagttgccaagaataagagatatatatgtttgttatactgctcttaaaatgtagccttgatttgctgccatataagattttttttggcttggcacctaattagtttgggagtgccaattcgggatcgctttaagttgtgttcgttatagagagttggaaactaacccttcaagcacataaagcagagtggtaaattagtgcataattaattaagtattagacaaaaaaagattgaaaaatggatcaatatgattttctaaagtaactttcctatagattttttttttaaaaaaacacaccgtttagcagtttgggaagcgtgcgtataaaagatgagaggatagaaattggaagatgggggtaaagaacacaaccttaggacgtcgtaccattttaacaatcatgatatagcagttacatttttagtggtgtttagttcatgggcgattgaggatatggttgtcacccatagcatattccatctatatattggatggcaaaatccgatcaaaacaactagatgaagccattcatatattgtatgtgatgatgtggcatgctcttgtaggttgggtggcttcacctttttttagcatggttaaagtaaaatgtttctacctaaactatatatttgatttgtgatctgataaatgtcccaaaaaacaagtgaaggcattgtattcgatagggaacaaatgtagtttagcaacaccaaaggaaaattataggaaccttagttttcctcaaaaattcccatgaaatggtatattccataggaattccaaaggacggtttctaaggacggagtaggattatttttgtcgacgtttgatagttacgactagggtatttggatggtatggggattattggtaccagagtatatgcgagattgaggtaaaagagatggagacagggatttttatacaggttcgggccccttatcttacaggtaatagccctacatcctgttggccgaagccggtgttgctctttattcatctgtatcacacaaatacaatatttgggataacctatctatctgttgtcgacttagcggctagataaccaactcgtagtcgacaacaggtagtcttcctcctcgaacatgaactcgtcgagatcagagatggcgctagatccctcttgccgatttccgtagacaccggatggggtatggctaggctaatctctgatgtcgagatctggcgatgtgtattggcttgtggttttgtggcgtcgtagattgtggtgggtgtcccctctctcctcctggggggcttgtatttatacccatagatgaccccttgtccaagtagaactagggagataaatatggatacgatccgagtaatccctgtcgtttccatataaaactctttttgtccttccttatccggaactccttttatatacgaggtttgtatccgtataagacatggtatgtggtgggccctgccgagtttagtcaactactattaggtatgtggtatccatggccctgacaattttccataggatttttaatcctctatgtttccttcagttttttttgtatgttttaaaccgttgcatacatgtgagagagaaatagatggaaatctgaatgaagctagggcattcttagtaagccacacaaaattgtattgtggcccttatgattctggaaattatatgggtgttaattatgctatattcttttcagacctaaataaacaaattttatgccaccgatcaacaaataatttagtatggtgctgtaaaagcattctcattatctcattccaaaggaaaagcaaaagctaatcctccattccaaacataaaattccctatcgaatacaatgccttcactttaatccttttaccttgggctatccttttctcattaatggaatgatggatgaatgcacatgctttctgaacttgtgttttctttaaaaacatatgtataaatatatttcttagaaagttatttaaaatttatttttagactaaattttacaacactacaaacacttgaaccaaattatcataaaactacgagatgttgtatcataaaactacagattgaacataagatttatcaagtatcacaaaaataaaactttaatactggagttatcataaaactacaaattttacaatttaaatccctaccactactattatggtgagagttataaatgttgtagtcttgtacttaggttggtgcaaaaccgataatattattattaaatatgcagtggtgatcttccatatatgtaggtttgtgatataccatattaaatttgtagttttgtgatgtcaaaatacatgtaattttataaaatttactcttatttataactttatggagtaacagctactccctccattttatattataagtcatttgactttttttctagctaaacttctttaagtttgatcaagtttatataaaaatacagtagtattttcagcacaaaacaaacatattatcagaatatatgaactaatttaatattttaaatgttactaaatttttctataaacttgattaaacttaacaaagtttgactaggaaaaaattcaaataacttaaaatataaaacagatagagtaattcatttataaccacgggcctgtagcctggtggttacaagagcctcagtagcacctgaggtcctgggttcgactccccatgagagcgaattttccaggatttaacggcgttgtgctttcagtgataggcgaattttccaggatttaacggcgttgtgctttcagtgataggcgacgtacccctcgacagcgaggcgttgcgtgtcccatctcaccctcacaccgtcacacaacaagctcactcgcgcgtatttacgccgcagaagatccgagcgatccctcccccgactcccgaggttaaactcccctcaccacctccgcttccactaccttcactcactccgcccatttccccactcctcctcgcccgcatccggaaccctagctaagcttcgatggcgatggcggcggcctggtccccggcgctcgcggcggttttgctggcggcggccgtggcgtcggcgtccaactcggagggggacgcgctgtacgcgctgcggcgcgcgctggcggacccccggggcgtgctccagagctgggacccgaccctcgtcaacccctgcacctggttccacgtcacctgcgaccgcgccggccgcgtcacccgcctgtgagtccacctcccccccccccaccgccgccgccgcctcgccgactgagctggctactaccggccggttttgctccctccgttgtgtactgcttttgtttgcttcggtgtactgacctctgccgtagtattggaaatgcgagggctttgtgctaggccgctaatgcttaaatacagtttcaaatggatctgtgagttaattgacaccagttggtgaaagggatatggtgatttagttgttcattcggttctggtgagaccgtgatctactggcaaagaacgtgatttgtagattgtcatttaattttttttaaaagattttgttctgcccatgtggaatcatcgttgcaatacagtttgtctgtaatagtaaatgttactagttagtttgtagcaacagtaaagctactcactatataatatctactaattacttgcatgtagtagtttgatatcaatactttgcacgttagctatgtcatcatgtatttgcataattatgctgatgatagctataaatggaaccggggagtactccttgatcctgcatggaaatatcgctgatgcaagctatattctctatgtgcgcaattgatccacgtaaaaccaaaaagcaattatccaatgatgattgtcgcgttacccattggctgcacagttcgcacgtgagttactccgctagcacgccatgcatctcgggaacaatgcatcgcctgctaatggtcagcttaaaaaaagaaaaaaaaagttgtgtatccaatccgcatgtagcgaggatgtgtatgtagccaattaatacagatattatcatggggattaaatggaagtgtcaagatggaatgcgctggtcaaatgtgaacgagggagtacttagcaatcaaccaccctagatagagtcttactgctttcactgtacgactagatttttgtagtcttttatgtactccattgtagggatgcaagcaggctgactcacgagcctgcgtatgggacattttcgtgggctgacccataggttggcctgcaaaaatggcctatatgggggcttgcggaccggtccacttgcatccttccattggtttggacttagggtacctattatatatgtttgcttgctgaaggaaagaaattgattcatcgaagtggtttctttcgatgcagcgttcaccatgatgccattaccatacaagagatatattttgttatggttacctatgttcttggttcaattcattgtctttgtccatcttaacatttttctgatactttctaacaattttgtatcttgtagagacttgggtaactcaaatttgtcaggccatcttgctcctgaactgggacaccttgagcatctccaatatctgtaagtctttctacatattgatgcactttattttctgaagtgttaaaatgtagagttcattcagcaaaggttctctgatggcaatgatcaccgacactgataagctaaaaactcacatgtcctgttaagtttgcattacatatggtcagcattcagcaacactgccaactgcttgtcatgtagaagttacagctggaatactatgttagacctagcttcctttctttcatcacttcttttttgaactcataaagcttcagcgctggatttgtaaagtcatttaaacagctaggcttcatgaattaaactgcaaatatcatggcaaatggtgaaaaaactgggggaaaaatggaaactctcacattaccagaaatctagaacacaatttgtggttttcaacagttccttgtggcacgtaattattgacttactgttttgatcttctcacttcctgttatgtgattgcagcttccgtttcctagtggagtgaaactagagcattttcggagtgttattttaatgagcaagagagatgattctttttaagtaaaatgatgaactaaatctaaatgctgggaatctcagctatatcagaacatatgaatctgatatgagctgttcatatgcaaaataaacaccagcattgaacatggtccactataagacaatatattgtacagtttttccaacgaactgtttgttttcagtctcgtgatttgtgccaagactgcatcattaagtcttgtatccatttgatttataaaatatgctttggtcatccttaatttccgatgctattttactgcaattgagcttgacattcatgttagtgctctaactagtttttgaaaaattgttacagagagctgtacaaaaacaatattcagggcactatcccagctgagctcgggagtctgaagaaccttattagcttggatctgtataacaacaacattactggaaccataccgaaagaacttggcaagctgagttccttagtattcttgtgagtaactatacttattcttgtgattagctgtacttattcttttaagcaactatactttagttaacatatatccacttttgcaccattttgccacatatgcaagcatcactttctttttaattctttttatgctatggtacactggtacttttacgctatgttaatccttttatttttgtttctttaggcggcttaatgacaacagtttaaacggtccaatcccgagggatctggcaaaaatatctagtctcaaagtgatgtaagtgctcagttaacaatgctgtttcacataatttttatgttctgtacatattaatgatgatcttttatttgtctatctattcttgcttccagagatgtctcgaacaatgatctttgcggcacgattcctactagcgggccttttgagcatatacccctgaacaagtaagatctaaaagccttgttaccaatttattttacaattatgttgacttgttttttgcttttgcacatccaatgttgtgcttctgtataaatgagaggacttgagacattagccacactattccatcagccaaaaaccaaaacacccgaagtcataaaattgattactagtgaacctcggctaagtttttctgatttgacagtgcagctcatcttttgccataatactaatttggttgttatgtagcacatatctatgtaccagataaaaagagtgctctactcattttcttgaattctttatcttctaagagctactcatttttctgtggtatgccatagatccagagtttatttttttatttcttttccatatacgctaattgctgaatcagaattaatcgacacaacaaatgactcactaagtgccatattttgttttctatgtattgtggacttccattaattgtcgtcacttggcatatgcagaactcatcgccccagtttgcattgtttctaagccattgtttttctctctgcagctttgacaaaaatccaaggttggaggggcccgagttgcaagggcttgcaacatatgacacaaactgctgaacgtgccaatcagtccctgtcgctcgtgtgatatagatcaatagcaaattagctttatcggagtacctggtaaatgtgcaagcttggttgctttgcttgtacgagatactgcaagtaaagactaggctgcagctcaacccttgtagtgtagataatatttatcgcaagcctgaggccctcttgactgataatacctggtaatgtatggttgctttgatgaactaagtcttgatatttattgccagttttgatttagttgccctattataagggactggttcaaaagttctctttacttttgcattgttgactgttgagatgccatgttgttatggtccaaaatgatatgccgaaatatgtttttaaaataaataataagcagcgctggtactactgattattctattcgtttatgcttaaattgttcacttgtagccatgcctcaattcctctttggcgcttttctttcttctgacatgcgttgcctaatataattatacaaatattgaccatagttggaaaactatacttaggaacacatgtcacacaaagtgtagatgaaaccatgcccatcaaatgccaagggccatatctcaaacagttaaattcacaagaatcaggtaagattgccgaattcctaaacttgttaactacaaactttacagaaatacgatgttcaagaaaattgtgtaacaagtcaaaaataataggggtgtacggtggatggtggattcttcatctaagctgtacagaaatacctatacttacagagtcctaaaaaactggctgttggtaattgctcaactcaaacctcttgcacatgcttcatttgcaaaattgtgcgaagatcctgaatcatgtgaaaaattcgaacacttgaaacttcttctgccaagaattgcatgtctaacgctgcgcggaaaagtttgcagtctgtagttctgtttctgcaaagagttgagcttcacatggaatggatgttgatcgaatgcaattctcatctcaccagttactgaaccgtatgtactttccattttgaactgtaagcaggctatatacaagcatcaatcgataattttttcaccggtcgagaataggttccagaccaaagtcccaaccagatacagcacaacagatactttgaagacatcatcccaagaacctgcgtttattaaacagagcaacaaaaaatcatgtaaaagattgtaaaattgatgtgcattatgtcactagggagatggggatttcaggccaaaccatgctgcaagatgtatcctgttgccgctgtgccaaacacaccagctaaaaccccagccgtgttagaaagaccaagcagtacaccctgcaagacaacatgtgagttcacctgaagctataatgtttcagacagaactccgaaaatgcgtcatttgaagaaatgttttgtgctaaagagagttgattacagcgtatcgaggaccgatatcttggtgatttgagtatagaccggactgtgagaatgcatcagttccctgagaataagaaatgcaacatgttatgctggaaatactgagatagatctcaaaatggccattcagatacaaatcacagttgttctaaaaagaggtacataatatatggctgttctatgacagaataaaggaaaatgacaagaagccaaactgccatttacctggctacaagccatgcacaacactgccattgctggtgaatcgatatggctcagttgagtcagaaaaaatgcgggccctaagaatccaattgactgcatgatctgcacgaagtagatagaaagtcatgcacaatgaattaggtttagctcttcattctcacttctaagcattatgttgattaattatgccgcacacaaattcacatattcaagcatggtttgccaatggtagaacaatgattcatattgaatattccgttggagtttgatagcacctcattgcatgggtaaatttcacgactgaagggattaatttaccttccgaactgttgtcactgataatcctctactgacaagcgtatctgctatccaaccaccaaaatttgcagaaactgccattgttaaccaggggagaacacagaaaaggccggattctgtgaggttgaatttcagaacctgtttttaaatattattatacacaagggattgcggttcaagatcctcaggtagaaaactatgatgctgatcatacctggttgtagtatgttggcatccatgtgagcaagatgaaagttccccagttatggcagaaatgagacactataagagcccaaacagggggtttcgataatattagtccccatggaatttctttaacaggctctcctcctgtggtttgactggttataagcttcttctcttcagcactaattcctggatcctcaagtggactactatacgcctttatagaagcagatcacaaatttaagagataactaaaaaaaaattagaaaagtaatacagtaattcaccaattccgagtgaaatggtgaacagaacaccgagaaataccttgctcgcccatgtcgaaaaccaaaatacacccagagacccaaaggagtagaagaccgatggccagccaaagttatgtatcagcaatggggaaaatgcaagccctgtcactgacccaaggtacattccactatacacgagagccaatgatctgctcctctctgatacaggaacccatttcgaaagaatattattcatcgcaggcatggcaactccctggggaaagattttatatgtttaccgtatcaataagaggtgcatagaaaatatcaaataccaccaaaacaaccatgactaagaatgcataaaaaaaagttaatattctttttgtgaattacaagcgaagtgatttagtcaggcatgttctgctaccccttgtattacaaatgaaatccactctttgaaacactgaagaagtctgaacaacagaaatgatgaaaggtgcaatactgtggaaacgatcaaagggaattttagggcaccccagatttttcaacttcaacataaattcattttttttctcttaaaatgttctgtcacttgactatagttcaatagaagctagacatcatctgataagggctctacattagcatttgcacaaaacttgtatgacataacaaatgaatataatatgaattagaaatgctcacctcaccaactcccatgaaagcacgggtcacaaggaggaatggtaaccccagcttcgccgcaaaaggcgtaagagctgtggctatcgaccaccaaatgacgccgaagccaaggacagtcttccctccaactgtatctgcccagattcctcctgctatctgcaatggcaatacatcagaatcatggggtaccaaatgaactcaaactgctcttgcatgaatcctagttacagatttccctggattagtactgcacacagacctgagttagcaggtagccccagaagaaagatgactgaatgaggccaacagtttgtgggttccatccgaattctgcagacattggcagaatggcaatgctcatgtttacctgcaaaatgttgaaagcatgaatctcccaagaaagaattgaagcttttaacatatactactaccaatcatcattaggaatcggcatttgacaagtttatgtttttggatccgatcaagaaactgcatctttggttcatttgggcattagtgcattttacaatatcaacgaaatggaattattgaggaggggggggggggggaatctagggttcatcagggcgttagagaagggaggaggaatttttacgcggtccatgttgcagaggaggaatgcggagaagcagaggaagacgatggcccatcgcttggggaactgaccctgctcgtcctcctccgcctccccctccgccgcgtcgtcctgcgccgacccggagagcagcagcctcctcaccgacgccagcagcgcccc

SEQ ID NO: 38126 - DNA, 6304 bp, Oryza sativa
cccaactccccgccgccgccggggtcgaggaagcgccgcgagcgcggcgccggcggcgagccggggacccggcaggagacggagagcggcagcaggtagagcatcgcctcgcctcgcctccgcccgtcagcgcgcgcgcgcgcagcgcaggtcttcttgctcggttgcttgcttgcttgcgtgcgcgggtgcgctggccgagcacggaagcgagctcagctcagctcggcctcggcctcggctccacagaggacaagacgggggggcgcgaagatcttttctcctcctcctcgcgctctcccccccgcgcgcgcgcgtgacaggtcagtcagtgcgaacgcgggcggaggcgtggcgtggcgcggcgcggcgaggcccggggacgaatggctgtggtgagcggggagaagatatatgcgcgcgcgcgcatctggacgcgacgcgagcgtggcagctcggcgtgccatggaatggccggaagtcatcggcccaaagctctctcgatcgaaacggcgggaattggaagttcccgggcctaaccgtatggtggtaggaggccctttatcaatgtgctacggcccggtgcccaatgacaatctaacattactttttttttaacactccctccgtcccaaaataaatcaactcctagagtttaaaatttgtcccaaaataaaccaactccttccaccaatccgcaaatccagaaagtttattacttcaatacacatcaaccaatacaattttggcaaactttgctacatgacataaaaaaagtgtaattagctaggagacaccgtaagaatgcgtatttgttgtaaggcatcgaaaaaaagataattagctgctggccccgtgatattactttattattttcgaaggaataggagagagaaataatcatttaaaaccagtttttccttggcttaaattagtccaacgtgggccccacactgagcaggtcctcatctcgctctagcagtggcacgccatcgtggtcgcggatgcggcgggcgagcttaggaggagcggtggcagcgggcgagtctgggaggagcaacaagcgatgggcgaacgaagcggcggctacactgccctggcagccgccgccaccttctcacctgcgatgcagcactgcctcgttgagctcgtgcagggactttgtcctagtggtcggatcgcgcaccgaacgatgcgcgcaccacggagacggagcagaaggagagcataccttgcagagtcctcctgctctggcgctacctccgccgcgtagcaccgcaccgacccgcacgccgttgccggcgctctccctcttcctcgggcttggttgaagaaagagaagaaaagaaagagagaaagaatgaaagagggagaaaagaataaggaagaataaagaaaaaggaaaaaattaaagggtagaatcatacttacacatctgtttctctctccaattcgtccggatataataaaataatcccgcgggtattcaacagctaattactagttttttgcaatgccctacagcaaatacgcgttcttacggtgtcccctaactaattacactttttttcgatgtcctgaagcaaattttgcctacaatttttgcattagttaagggttatttgatcttttgtttctttccttaatagcttcttggatgctaaggtttgattttattagggacggagggagtatagatctagatgccccgctcattctgatcccttctgcgacgtgacaacgtcacagatatatgacgatttcgaccaacgtcttttaccatatgatagacaacttccgactatctaccgtctgcacggggcttaccatttttttcaatttcatatgaatttcaaaaaagatatgatccaatcccaaatttcaatgcccttatgagttttttctatagcaatacgatcatttaatttttttctaatcaaaggggctaaaatattggggtcgtaagttgcacacgtttgcttctcttcaaatacgtatttttcaagtgcaactgtgcaagtacgttgttgagttttggatttttggttgattcagttggttaattagggaaaataaaactaaccacggtccgtaggtggtgttggggacgcgatgcacatagcacgagaggtatgcaacaccggccggtgaagggggctttttgtgttgcacggcggcacggcgccgcgttgtcttgactgatctcagagctatatatcacaagctagcttattatacattttatatatctcatgtttgcgagaaaatcaacgatttgccaattgattcactgaaaccctctatattgcaattgattaccatctatttgactatttctttgtcacctcgatgattcatcacctttatagactgttttgcagttgttgaaaccctctattatattgcaattgaccattttgcctctgtccgcggatctctctctctctctctcccctgtacgagatcgttgagagtgcgtgacacgcgccactaatggtcaattggattaaaacactgcgattacgtacgtccgaatccaatataatggcgtagttagcacgattaggaaggcatgagccatgaggttctcgatgtatcaccgggcgcattacattcatcaagataagattttccctcgttttcaatatcacgttttttaaactactaaacaatgtattttatacgaaaactttctatgcggtagttgctttaaaacatcatattaatctatttttcaagtttgtaataattaaaatttagggcctatttagcacagctccagctccacccctcctggagctggaactcagccaaacagtttcagctccacaaaaaatgggagtggagctggatggagctctctcacaaaatgaactagagttgtggagctaggtttaggcagctccacaactccactccagactcaactcctggagctaaatttaagagttggagctgtaccaaacaggcccttaattaatcaagtattaatgacttttttgtttgacatgtctgcttttaatcttcatccttagcagattcgaatggggctaggcgtggtcagatataatcactcagactcagttgtttaaaggtaagttttataatagagatggtggtcaccttcaattttatccacatcatccatctataaaattaaaactaacttatataaatgaattgcatttaatacactagtactaatgcacttgccaccaatcaacctcttttattttctcttgatttttaaagtttgtgtggaggttacccgttgcataagaggtggatcttcctctctcttctcttctcttctctcctccacatcattatttaaacatacacataacactttggagtttatacttataaccttaagagcaggtacaatagatgactataaatcagctataaacatatgttgagaagataaaaaaagagaaaaaagagcagcttcagcatggacttcaagacacaatgtgttgacagatgggactagatattaatagtatactatatgtttataggtaactattgtatgaattagttattaaattgactataaatgatttgaagctaatagttatctatacattatattaaacttggtcttatatagtaaaaagacagtaatgatagctagccctggcatttgcaaagctcggagactgtgtgagtacgttatacgtactgtacatctcacgggatcatcggaacgtgcaaactaatcgaacgtgccacacacctaataagcacgcggccccagcaggtccatcctcccagcacgtgcgacctaccaatttcctcacggacctcaccgctccgtacgtttgtgtttgacgacgtctagggctgtaaaagaaaaaaaaagctgggcactcagtagccactcacaagctgctcaatcgccacgagaggtgcagtagtaagtggctaatccataaactcacttatatattaaaataaaacaagtttataaataagtttcactagttaatcaattacacctttaaccgactcatcgtaggcttaatagttctagcttggctcgagcttctgacaagtcaagtccgagcctataccaaaatctcgtgagctttgtcgagctgagctcaagctattatcgagcctgacaatatatgtattttattttttactttacaaattagtagatcaaagtatatattatattatttatatataagtattcaacacaacgaagtagtttgtatcggtgccacatatttatattgttttgttttctccttatttatgtatgtatatgattaaatagaaattagttgcttttatttattgagagattcgatccttaaaatatatgtatagtggtactccctccattccagaatataaagatttttagggttgaatgtgagtactaagaaaatatttagaattaaatggaagaaaatgatgattggtcgagaaatagagttaggcgagaaaattgaatggtgaagtgttgtgattttggctgagaaaagaatgttatgaagaaattatcatattttgaacaaaatacaacaacatcttactctctcagggatactttacaacagaggtgacttcttcatgagttatgagccagctcggctgaagcttatatcgagctcgaacctgcacaggtgagctccgctcgttgacagccctagcgacagtccccgtgggcgccatcgccaataaaacgcgcgcgcgccatatatagccaagctcctgtactccgtgtagctgctcctgtacagtacacctctttcctcctctctgctcgccggagacagactagctaagctagctagtaggagatcgaggagggattgaccgattgagctagtaataatggccgccggagacaaggccggcggcgacgacgctgcggcggcggcgccattgctggtaccggcggcggcggggaggcggcggcggtgccccgggtgccggacgaaggagaggtgcgaggcccaccccggcatcccttacctcaacttcttctacatctggatcgtctgcatatgcgcctgtaagagctacagctatagctaattaattaagctacctcttctttcctttttgttttccttttattaaatttgtttttcatccattttgccatgcgtacgatcagatacgctcttaattatttactccttaatcttctgttgttatatttcaataacctttttagtctactcttgcgttttcttattttttttctctattattagttcttggagagcacgtacgttcaaagtggtaccttataggtgcacgcgccttctcccgaggtttcccatagctaagggcatctttagttggtgaaatgaaaatctttgggtgtcatatcggacgtttgaccggatgtcgaaagggatttttggacacgattaaaaaaaactgatttcacagctcgcctggaaaccgcgagacgaatcttttgagcctaattaattcgtcattagcacatgtgggttactgtagcacttaattatgactaattatggcctaattagactcaaaagattcgtctcgcgatttacatccaaactgtgcaattagtttttctttttatccatatttaatgcttcatatatatgtccaaagattcgatgtgatgtttttgggaaaagtttttgggaactaaacatggcctaagctgatattatctccatttcaacataagtaagaaataaattaaaatactttaattttatcaaatatcgatataattatttttctactttatctacattcaacacatttatcttttactttcataatcgatcttcaatataattttgtaaaagtaaatttattttgtgataaacaacagaagacaattaaataaatttattcagaggcggagggagtaatacaccccttgctatcttcatttgggaaatatcaagtactagtactttccattagtataacttcctgatgttctccctcacattgggtttttaactatttgcctatcttacggagtggcactattgagatgtcacttttctaaaattttttacacaaacaccgtatgagactgagagagatattttttactgagaaatttgaaatgacatttttactcctattttaaaaaatatgagagattatatataaacatattttttgaaatgacatttttacgaatccccgccaccgccactcactgttcacgcatccgggtgagtggggcccgccaggtcccctacgggggttgggcgggtgacatttttcacctggttgtgtctgtggggccgagggagaggccggggggagaatgtgggga

SEQ ID NO: 38127 - DNA, 33798 bp, Oryza sativa
ctatccaacccggccccgccccgccctgttgccatccctaatcaaaactcttatgaatgcaaactcttatgaccagtttgcagttgaccgctactacgtacctcctgcagccgctgtgaaccgcgtcgaagccacggaggtcatgccaacgagcacatccgttagttgaagtttactaccgtagatgttggtatattattttaatataaactcgaccaaaatgtgagaagtttatatacagaagatttttcccggcgaggacccatgtagattgcagacggaccgtaaaggcaggcctcttaacatgttcgcttgtgaaaataagactattttcacatgcgggcctcttaaataatccgcatacgaaaatattcatctgttcccactctttttttatttctcacctcctttctcccttcactaaggcccgttcgatccctaccaatgttgtcaggacacccgaaaatcatattgtccagtgtttattgtgatcaccacataatttcgggagagtgggatccatacatgtataatagccactcaagcctcaatgtgcccgatgatcacaattaaacaccattcaatataatctgcagagtgtcgaatattgaacaaaagagagactgctgggacttagcgtgccagtcaacttcagcatgagatatgtccgtcaaaccacacgaaggcggtgaccggatgtttacacatcccagaagacttgacaaattgctaagctctacagcatctcgtttgttcaacactcatactcatgtctagctagtcctcaacaaaagactaactaaacactttcattaaagcattggcatagagtaataaggcactcaaaagattaactttagattacaactaaaattggatatacgtaggccaaccggctaaataaatagtggtttgcacggaagcttatctacccaaaacccttaagcaatccgactaagggtagactcttattgaaccatcctgagaagaacaacggaactcgtggcacacaactaatcctgcaaaacaacacgcgaaacaagaaaaatcattagtacatgattaattaaggattaactagtataaaattgaaaaatagaattatttgattctttaaacaacttttacataaaaactttttaccaaaaatatatcatttagcagtttgaaaagcgtgctaacgaaaaacgaggaagttgaagtttgaagttgagaaaaggaactaggcctaagtcctcatctcccctctcctccctcgctctcccggtccccactgctctcccatctcctctactcctctgccctctcctccgacggcgggttttggcgacgggggtagcggcgaagggtggaagcgttaggcgagggctcgggcgacggtggtggagcatgagggcagcgggcgtggactctggcagtggcggacgagtgggacggcgacgacgggtgagggccacggcggggcgagcgtgggcgacagcagtgacgatggccctcccccgcacgggatctgtcagtcgccgccctccttcatcctcatccggcggaagccgcccttcccacccctatccggtggcggcagcacctcccgcgtggacccgtcggcggtggcaatggcgatggtaggacgacactgacggcgacggcggcggcggttggagaacgaggaggatggcagcggtgactggaggacgaggatgacagtggcggcggcgacaagatgattctagggatagggtttcagttattcaatttttgaaatttttatttttttcgtgttattttcttcacatgcggttgcgctagctaaatataaaaatctgattttcgtatacctttggatgcatgtgagccacctgtccgtatgtaaaattcgcttttaaccatatggaaaaattgaatctgtatatatatgtgctaggtagtactctctacattccaaattaatctacatatattttttttatgttatttctaattgatttacatatctgtgttcatcattaagtctattcgttatttgtgcattggagtaaatggatattgatgcatgcatccatgcacacaagtatttatacccatatgcaatatcttgatttgctattggctactccctccggttttattttaattgacgctttggacaatgacacgctttactagatatacctttgaccttatttctctattataatatatacaataaataaataaatgtatgtttacttttattatagtgttttgaaagacaaatctataaatttttttatagtttctttaaactaaatacttttaaagttatcgatggtcaaggttataaaagtttaacgtcaaccttgtccaaaacgtcaattaatatagacccagagggagtaggaaatagtagggatgatgcatgcatcgagtttattgctagagtaaatatagtatgagagagttattagttttttttagtcttggtgtacatatgaaatatgtaaattaatttggaatggagggagtagtactgtacccgttcgtctcatagaaattcaatcctaaccatgaaacttcacaatacatctacgggatcatcggaaggcagccatgggcatagtgacacgtggagcacatccagtggcatatatggcacatccagtacgtacttcgcgtcagcaaactaagagaataatagtataactcacttcctactattagcttattttaaagccaacatatataatagattagttatatggttggctataattttcatcttctctctgtatctctcacttatacatttaatgtatttgtcttagattttgtgataagctagctcttacatgagaaccaacacccttgatttttcactacctctctcctccacctaagtttatagtaggcttatagctcactattagagcaaggataatagtagagctcacttcttactattagcccatcttaaagccaacatatataatggattagctataaggttggctataattttctcctcctctctctatctctcacctatataattaatgtatttacctaggagcttgtgttaagctagctcttgcgtgagaactaatatccttgattttttttgttatctctctcctccatataagcttatagtaagcttatagctcactattatagttgctcttatacttgctctaatcgaacgtggggcccaccaccatgccacacacctaacatgcggcctagtaggcccatactcccagcacgtgtaaccggccaatctcctcacggacctcaccgttgcactttctccggacaaaaaaaaacctaataagagatgatatctccaaatacaacaaatctaaataattctttattttttacgacctttctaagttaagttttttttaacggaatgagtatgtttgtgttggacgatgtctagggctgtaaagaaaaatataaataattaagctcgagacttgcaatctgcttgagctcaactcgtcataggcttaattcgaacttagctcgagcctatatcaaaactcgcgagtttttattaaggtgagctcctatcaaacctaatagtatatattttttattacttattttataaattagtagatcaaatatactatttatatgtatcatgcacaaaatagctcgcattagggtcatataatcttactagaaaaaatacccgtgcgttgcaacaggtaaaggctattttagtcttattattgttatacgtacggtttagctagggtgaaatttactctggaaattcgctttaatttttttttagaaaaccatgggctgcaattaggagtccgattttcgtctcaagttagcatgagagttttttaaaagatatttcttatatgactccttttctatttccaaaaacaaacaaacataaaaactgactcaaacacgaatctatatttccaaaagtgaacgaaattaaaaactgacaaacagggatgacgtaccaaaataccggcaaaaacatcttcgatttttataatagtagagatatagaaaaaatgcctatgcgttgcaacggatgaatattattttaatattattattattattgttattattattaggtttagttaaggtggaattcattgtaggaattcgcttggatttttttttcataaaatcatgagttgtatttaggagtccgatcatttcaagttagcatgcaagtttttttaaagagattttttatatgatttcttctatatttttaaaaacgaacgaacttaaaacccgactcaaatacatatacatatttccaaaagcgaacgaaaattaaaaaccgactcatatacgaatgacgtaccaaaataccagaaaattaaaacaccttcaatttttatagtagttgatatttcattttctcatttattaatatgattaaatagaaattagttactctctttgtcccaaaatatatgaatctaggacaggatggaatattttttttacgaatctggatagttagctcgtccagattcgtggtagtagaaaatgttccatctgattataaattattatattttgggacggatagagtattttaattgggagattatattcttaaaatgttagtatactatttatgagtcagctcgagcatgtgtcaacctcgtcggcacaccctaacaaacgtccctggtgcatgcgcgccatcgctctatataagccaagctcctgtactagttcatcagtgtagttcagtcagttccacacctctccttcctttaatttctctctgctcgccggagacagactagcttagctagtaggagagggaggaactaatggccgccggagacaaggccggcggcgacgacgctgcggcggcggcggcggcgccattgctggtgtcggcggcggggaggcggcggcggtgccccgggtgcctgacggaggagaggtgcaaggccgacgccggcatcccctacctcaacttcttctacatctgggtcgtctgcctctgctcctgtaagaacccaagcttgagctagctactatacctcttctttctttttttattttttttgtcatggtttcatccattttgccatgcatacgatcagacacaactcttaattactccttaatccgctcttattatcttttgaaaaaaacattttgattaatttacttgcgttttgttttagatctattagttgttggagagtacgtacgttcaaagtggcaccttctaggcgcacgctcacttggccttcgatagggttcaatttttacccacatctcatatgtaatcaatacaaaatcaaaatctaaaatacttagactttatcaaatcctaaatttccttttttttacattttcaatatatttatcttatatttttataaacttcaatgtaatggttgtttaaagtaaatttactttaaggtaaataggatgagtcaaagttaaacttacttggagactccacgtgctatcttcacttggactaaaatatcaagtatactagtactttccactagtataactacctgatcttattcccttcactttgcctggctaaagcatctgtttattagtctcttgttcttcttctttcatgctgatgcaccatgcatccagaacgagcagttgaaaagtcatttaactggaggactaatttcttaagttaatcgcccaatttactgtgcagtaaaaacgtgccattgctttaaccatgggggttcaaagaagttaaagcagacgtaactacccagacgctcagtgaataaattaagtaattaaccgtggttaatcaggtcacaagaaaacgtactactagtagtagtgccactggccggaaaggaatcattttcacttgtcacggttccagacaacggggctcattttttcgcttatgttcctacttattagccaaaatttaaaattttaaccttaaatttagaattgattttagggttttttttaatcgaagtttatttttcaacctttatttttatttttagatcgctaagaacacgtatataaagttttattcacaaattattttttatttgcaaatataccgaaatgatgggtctatctaatgggccccatggtcagtacagtatacagtactccctctgtaagaaaaacccaatctaaagttgtgatctaaatctagataaatgctagcttatctagatttattattctaaaatatatctttaattttttttctggacgaagagaatagtcctaaaggacatgagaagagtatttattgcacggagatgtttcagcagatgtagaatgtcagcatgtgagggcagcaggtgcggtgttgagagtccattcaaacttaagccaccaaagcgtatgcatccaattcccgctccaaattaaggcaaagttctttccagacgataagagagagaatatcggcttttgtgaaaatatttgaagagtacagacgaatgataaattagttattctaaatttaaaaggtaatttaaactattaaaaacgttaattgaatatatatgaaaaaaatatagaaaattgcatggtttagaatcttgtgagatgcatatatacgtgataatctataatctgtaagagaaaaaatacagagatttggcttgtttgtttcataggaaatatggaagaaaaaccattcctacaggaaaaatcactgtttatccattcgttttgtaggattatagcaaaggaaaagcataggaagaattcctttgtatgtgattcctatggaattttgtaggaaaattaacatccacttggacctcttttttctattcctacgcataggatcaaggcaaatcactcgtttcattatgtatttgaatctaagttacacaaattagagtattcaaatcttggttgtggtaacttaatacaaagattcctgtatttttctatctaagagttattcctatgattttcctatcctaagttttgcacatacattcctatgttattcctacgtttttccttttcctgtgatttgaaaatatgaaccgaataggcccttaataagtccaccatgggaatggaacagttccacttggtcgctcattctcccacccttttccttggaccatggttgcgatgctagcataaaggttgaaagaaacacatctatatcaatatcagattgacgtgacattttgatatgatcagtttgctctactactctgtcgaaactctcttatgaccgtaaatccagtgttaaatttttagtgatattgcatctacttattttgcatcggtcatataataaacactacggagtatatgctagatacaaacacatcttttccatttgtaaaaatggaaaaaaaattgagtgccaaaactcaggcattgtacggaaatttgctagagcaatagagcatcactaaaaaaaaacagaaatatgctgctcttgggaagggggaaataacagaattttacacagtgctgtatatgtgctgcacaacacaaatacacaaattctatgcaagttgagataaggtgattccagtcgagggaaatgcaaagcattgcacctcatccacacgtgaatacgtacgttttctgggagctatatctggcacacagcagggctaagctttccctaccgtgcgaagcttcctggaagtttacctgcctgtggccctggcagtccctcgtcgctaccgccctgcaaaaaagatctgcgatttttcagtgaaagcgatggctcatggccatcgacggtagtactatttcgttgcatactcaacacccccccccctctctctctctctctcttaaaaaaaccaacctataacctaaaaccaagtatgacacattctattactacgaatctagacatacctctgtccagattcatcgtactagaatatgtcatattcggttctaaatttgttttttcgggatggagggagtttgcatgaaattctcgtaccagataacttgactacttgaggtctattccctcccttaaaaaaaacatattctgatatttctaacaatacatctgaaagcatagtacaccatgtcacatcgaacgtttgaataattacatgaagtattaaatatagtttaaaaaaataactatttgcacatattacgactaagttacgagacgaatcttttcaacctaattgctccataatttgaaaatgtggtgctacaataaacatgtgctaatgacgaattaattaggcttcgtcacgcggtttactgacggattctgtaattagttttttattagtgcccgaacactctatgcgacaccttatataatatccgatgtgatacgccaaaactttacacccctgaatctaaacaccccctaatttagaatggaatatgatgttttctaatataataaattgttagaaaacgtcacgtctcattttatgggatggatgcagtgtgttcagattaatcggcaggattgtattttttaatgacataatgtgtaatgtgtagatatctactttcaaaacacggtattttcattttatttgcatggggaattaattaaaccattggataccgtttgtaaaagccttgtgaaatttccctgttttttaactaagttttctgtgatgaaccatataatttctcacattttaggataaattttaaatacaatatataggttgttccatcctccagattgataacacttgtttttttagaaggatacgatctctaaaaataattttgatcactatttttttttattataatacatatacaaatatcaataaatatatgattttattgaagtacttttagactaatctatatatacacatggcctccatatttctaagacaaatattttaaacattattcataatcatatatttcaaaacttaacattagcgttgcacaaaaccacaagtaatattaaactggatgaagtatatttagtacggagcgtgcctcggatttaacatagacccacgtagttgctaactccgtcggtaaaggtccattactagtctattaggcaagagaaggcaagggaattgagagtttggacaagggaattggtggaagaattggtcacccaagttttttttttactctgtctcttgtttgatagtaaagatgatagttatgtgagtacggatgggaattgaattttaactaataatgtacaccttagatttatctgtcgtgcctagaagaaaattccccttccgattatcacttatccttattcagatactagtaatcgtgcacgtgcaatgcatgtttccaacatataaaaacactcaaaatttattgcattttcctgcaatatatgtcacccaaaacacacaaacatactaaaagtttaagaactatttctactataatgtaatttgacatactacgttaaacatccatttaaacacaaaaaatgcaaagcagctaacaatacaaaatatataatttgtcataccttaataaacacttgaaaaatatcaaagcaagatatttatctttatggcattgaaatgaactccaccatctacaatatggctatatgggatattgtttgaccatttttttttactccttgcctcttgtttggtagtaaagatgacagttatgtgagtattgatgggaattgaattttaagcaataatgtacatcttagatttatctgtcatacctagaagaaaattgccctttccgattatcacttatccttatttagatattgaaaatgtaaaagtttgctcctaaactcctctttccgaattccgatcctttttaaaactttcacgtctaccaactaaacaatatattttaacagccctatctctctttaacaatttccccaattaaacgtgcctttgattcaaaatacgttttacataaacggacacgtattcagcaagtacggtttttaattagcgagatcacgggaccaggtgcttgcagaaagtcccacaagtagacgtggctgtcagtgtgtcacccatgcggaggtccatggggtccctactccccaaggatggctcactgggctttaattaagagtgctcctagtcctatagcacattcgacacattatatggaaaaagaaattcactctaactacaatgcttgtaatgtaaatacaattacagtataagtatggtgtaaatttgttttgatatcaaaacttgtgctacctcagtggtccaaaaattgttttttttcttccaaaggctatattgtaagttttctagcaattccattaattaatagtagaatgaaataatatagctattagaaaatgtattatgtcccaaaaaccattataagttttctagcaattccattaatcaatggtactatatactatataattagaaaatatattgtggatgatatatggtatgttgaggggtgcgtctcacaatatgatggagacttgacctcagagtttacaatacgtaccgttctgttgttgtggtaaccacctgaggtaatcttcttagttttttaaaacatcagtttttaaactgttgtaaccataatattagggcccatttgatttggatgaaaaatatagaaattttagaggattttaatcctacaggaaaaattcctatgaatgcctttaaatcaaaggattgaatcctatccaatcctttaaaacttctatcgaatggacaatcctatagagattttagaggaaacttagcaaaagctcaaagctcttggaaaatttcctttgagtctatctctctcatcttattcctatgtttttcctacggtccaatcaaatggtcattcctgtgtttttgcagtcctctattttacacttccatcccttattagaatctggtgtttttcatatttctttattttctttttcattcatgcgattcaaaagagacttattggacaacgataacctcaccgaaacggtaagaaaaaccacgcatactatgagcggaggaagtaattgtctacagacatctatggctctaggcccacatgcacattactgtctgtgcagtacagctgcaggtgacagtcccgtccatcaacaggtcccgaacttctaaggccatgtacaacgcgtgaccttggcatgtggtttcaaacctccacgtcggacgcccgcacccatggcagtggggaccgtggctctgcaggccgaatccgcgcttgcagaggaaccactcgaagcgccgcgcctgggctcgggagccgcgaagccacaacccgaggccacgcgttggcggagccagagccccatgcgtcgcctcgtctggtcggtcaccgtggtagtcgtcgccgctcaccgtcgccaccgtcgccaccgccgctccccgtcaccgccagatgcgaagaggagcaccgccgacgccaccgttgctcctcgcttcctccccgccgccagatgcgaagaggagcaccgccaccggatccggcgagcccgtgcccggatctggcgaccttgggcgtggggcggcggtggaagaagtgggatgcggcggaggagggtgtgggcgtggcggaggaggaggagaggatggcgcggggaagagcgcggcagttgagaggaggaggaggcggcgttgtcgtggcgcacaagaggaggagcggcgcacgagaggaggagcggcgctgcggcggctttgagaggaggagcggaggcgacgagagaggaggcgttagagaggaagaggataaggcagagccggttggtagaagagaaaataaaggggagaggattggagagactgacggtgggtccatatatagattaggggtatctatacatttctttttgttgttagaaggactaaaatagttaattttataataacaaatattatagggactaacacatgaatagataggggctgaaacacaaaatatactctacagtggtctccattgtagacattgtggtttttgtgtggccttatcctatgtggcaacctgagaccacagttgcttgtggctaccattgtacatgccctaaggtgtctgcatccagcatcctatgtgatcttatttctttctcattatgctctcatgaaatgacattcattacgaagcgtgatatttgaccttagtgcccctttaaatcacaagactaagaaaacatagaaatagaaaaaaaaaatgtaaaattttgatataaatgtaagtgtaaaacagaggattgcaaaacacaggaaaaacacaggaaaaactgtttgattagaccgcaggaaaaatacaggcattaaaggagagataaagactcagcagaaagtttccatgaggtagatcatcatggtttacctccaaaccttgcatggcattagacatttcatagtaattgagacgttttctaatactactaatttggacatgctgcctgtctagattcgtagtactgggaaacgtctcatccagttctagattcttatatattgagatggagggagtaataaattaggccgaaaaaaataccgcaatgaccggctattttctttcttttttttagtccaaagtcgaaaacaaatcagagtcgaattggcagtcgtttaaatagcctaacggttcgtacataatttcacaaactacaaatatattgatcaaactaccttaaaactacatatttaaggtgatgtatcacaaaactacaaatttaacactaaatttttatagtgttcctcagccaattgttggtgttttttatttttaatatcattattaccatgtatgccacaagctagaataatcaagaataatatttttctctctttacgttcttaatataactataattgtgtgtgtgagagagagagagagaggagcaatatgcacacttgtacttggcagagaagccgtttcaaaggagagatttaagccgaccctctaatgccactgcctaaacttagccggacaaaattaattaagacaaaacacccaaaaaaagtgatctcaacgctttagcagatcaatgcttgcaattaaacccccattgcttacttcttggcgaaagagaggagaatgcccggacattctcacaaaccaagcatcatcttgatgtggattcagacaactaaacctgcaaggagaagaggagcaaacgtccttgcccgccattgcggcgatgaccggaggcggcgatgccgatcgcaatgcgccgttgctcgccggcggcaggaaggtgtaccatgaacgctgccccgggtgcaggcagcagaggaaggtgcaggccaatgacaggcttccctacctgggtttcctctacacttggatcgcttgcttgtgtgccggtatggtatgcaccatctttgagaggatagatgtttggttaggatgcaggtgttgatctgattttcatcttgtggatcagctatttggttgtcacttgtcacaagttgtggaatgtagaaatggcctttgcaattgttaagattgtgatagtggtgttttgatgatttatataatatttaggagtagacgatgaatcgatgatcttcatgatattgcgtgtttcgacaaactggtagatcttatcagattcagtagtctcattcttttgtcaaaaatagacatacttttatttgtttcggttcagttgtatcaaatattattttatctctattcctgaaaaaagaaatcccattttagctatagttgactaataccatggtcttttgcctttccagcgttgccaattcagtcgttgtttccgtatctgtacttcatggtaagaagatatgctttgaagttgaactattatcatgataaacatatagagagatcaaatatgtgaatttccatgtagtacatggtgattgacatgtattcaattttgttatgatgccacagatcagggacttgaaagtcgcaaaggaagagcaagatattgggttctatgccggttttgtcggtgagcactgtctcctctcatggttttgacaacaccactgagaacattatatgggcaagagttgaaccagatgtcttgtgttgattaatctaccattatcatagaatacttaatagttttggtgttcatttttagtccactatgattattgtggattacttgttaccgactaaacggtaatttctctgtttaaggggctacttatttccttggaagaactatcagtgcagtgccatggggcatttttgctgacaaatatgggaggaagccctgcattgtgatcagtatcctctcagtgtatgaaacactcagttagactatttaaatcatacttgatcccattcgactggactgaagtaaatcttgttttaccatttccaggattgtgtttaacacactctttggcctcagcacgacttactggatggcaattgttaccaggggattacttggattactctgtggtatactaggaccaatcaaggtaaatttacagtttgatggctgatgctaagaacatgacactggattgttgcgtactcatgttcagcatcatgtattgtccaggcctatgcttcagaggtctgcaggaaggagcaccaagctcttggaatttcccttgtaagaagagttatactcttgttttgcatttcaagcttcttgtttatctctataggatgaggatttaaaatttttactgattatattttagtactggctacttattggtcgtattatatgttataggtcacatcctcgcgagcaatagctctggttgttggaccagctattggaggatttctttcgcaggtgagcttaagtacactttgatgatgaaaccaagttaaactttgtatagttactaaaatgccgttcgccatgccttacttcatcagagctgacttcttgtgcgagtggaagagaaaaagaaacataaatctgacaatttttttcctaaaaactatttagtttcatccttttaatgaaaacagtgctaatggaatcaagtttaactaaattcgcaacctatgaagattgctctgaatctgttggctaatattgtgcattttctatcttgtatcagcctgcaaagaaatacccaaatcttttctctgaagaatcggtatttgggaggtaaattattaatcatcattcattctgttcctcagaaataaatctttgtttatatacttgaagaacagaagataagcctatccaatgtacttctaatttcaggtttccctactttctcccttgcttcgtcatatcggtactagcagcaggagcatgtgttgcgtgtatttggcttccggtacgccactctctccccctaccattctttctttgaaatgctgaaatgcatgtaaaaaaatatactacctcctttctcaaaaggtcgacatcctagaaagtgtgcaataaaatctcaaactcttaaatcactaatatattaaaaaaatattaagatttgatccgtgaaaatggcattaagatttggcattaaaaatatggttatatttttttaataatttttataagtttataattagaaaaaacaataatgaggcatgtgtattggagattatgttgatgaccaaaacgacaagtaaaaacaatagaggtagtattaataaagtatctactgtaatatgtggagaaaagttacttaacattagccccttgttcttaggaaaccctgcacatgcaccatgatgacaaagaagtcattgatgcactagaggcacaagatgcgacttcagacttaggagaaacaactaaagaatcaggatcagggagaatgggccatacaaagagtttgctgaagaactggcagctgatgtcagcaattaccctctactgtgtcttctctctccatgatacagcttatcttgaggtaatccctatattctgaattatagattatcgcagtaataagaagggcgaaggtaggaagtaaaatgagtggaggtcagggtgctaggcaaggccccaactcaataatactctagattcacccctgggttaatacattgagaaacagtctagtttgttaagatgttgatatgccattgtattcctcctatagagaagttacattagcacaaacagcgaacttaggatgttaatgtactatgtaacttatattttcagatattttcactctgggctgtgagcagcagaaaataccggggcctgagttttacatcccaggatgttggtatcgtgctagctatttccggtatgtgatgttttttcaagtttttatgcatgatcaatacatacaagaaaccatatctcaaaaacattttttttaaagtaatcttcaaaataaattaaatcagcagcatacttagtatacctgtttaccactaatgtgtagctatcattgccttcaaaattcctttagctaatgacaatttcgtctgaatttgcaggttttggtgttttggtgtaccaacttgcgatttatccgcttcttgctaaatatgttgggccaatcaagccattccgttatgcagcggtagggagatgcatgttttgtcttaagatgattcttctgaaaattgaatctttttttttagtaccaatgcatgtttgatttgcaggtcttgtctatacttctcctttcaacatatccattcatggctaacctgtatggtctggagctcaaagtactcatcaacattgcttcgcttttgaaaaatatgttcgctgtaagcaattcctctttgcgatatatatcctgccctataatagggaaaattgcatttttatttgtaccaacataaaaatccatgtttttgattcaagcttcccaaattcagtgatgttgggcttgtttagtttgcaaccataccaaaatattggtaacgccaaatcatgggcgagtttttgctaatgccaacattttaacattgccaaaattactattcaaaatgtcaatattttggtatggcaagttttggcttcaaaccaaaccagcatgttgttccttttttttttttgcctcctacagagaaaaggattacaaattaaaaagttaattgtattcttagataaaacgagcttaatcgttttacaggaatttatcgtttaaagatttgtaatgcttgttttgaatggtacaggctacaattactattgcatgcaacatcctgcaaaacactgcagtggtatgtatcagaatcaataggacatttcttttttacttcaatgcatttcctcgttgtcataatcatgttgttatgctcttttttcttaactgttggaacatgcaaagacgcaagaacaaagaggggttgcaaatggaatctctgtcactctgatgtcaatcttcaaagccgtagctccagcagcagctggaattttgtaagttccttttgtggttagaagttcatgtttcttctctctttttttttccctcttccaagaataaaaaggagatgaccaatcaatcaatctctttgcttgatgcaggttttcatgggcgcaaaagcacattactgggttgttcttaccaggtaaaacaacaaggctcttccaagccatgataatttgcattactgttgatatagtgtcatcatatcactctctctgtcctagaaaaaaccaacttctagatatgaatctgaacatagatagaaaaatcaactttttactagacgttggttttttctgggatggagtacatattatcaggtgtgattagttacctgactcataatggtcatgatacatccaggtgagcagatcctgttcctgatgctgaacatggtgtcagtgattgggttcatcctgacattcaagccatttttcgccttgccggatatgcgatgatgtgtagttaggtaacaaaaaggccagaatttatcagacttcagcctggattctaacctgcaagaggaattcatgtactgtaccgcgtgtaatgttcagttgtgtaatcagtttggtggtatctttgatttctgtctgaactccgaaccattggatggtcgaggcatatgataaacagctaacgggatcttgtttcatctaattacctagctagcagaatcgttgttacattaatcgactgaagcaatatgactgccaaattaaacatgctcaaattccttccaagacttacggaatcaagaacattgtatttcatatatagtgacagtaaaatatgtaagaacatatttaaagatcatgaccaaaactcggggatactgatgagctcacagtaagacgagagaatcaagtgttcatcacattgtcaatatgagaatatgatcgtatatcacccaaattaatattggtagaatgaatatagcacaagcatggatggttttgattaacaacagaatggctacacccttgaaaagttgaaacaaacatagagtaattgaataaacaaaatcacaaagatcagagccatttttcacaaacagaaaaatcacaaacaaacagaaagcattgtctacagcataggatgtctctgaatatcaagaatttcggtttggaacatatctatccccacaaaattacatctgaacataaaattaataaagataattttagcctctgacagtatggctactggaactccccctgtgttgatccaaatgatgcttcaacttacttggccatcatgactttaacgaattcatcgtagttgatctgcccatcaccatcaacatcggcctcacggatcatctcttcaacctcctcatctgtcagcttctcaccaaggttagtcatgacgtgacgcaattcagcagcagagataaaaccattttggtccttgtcgaacacacggaacgcctccttgagctcttcctcagaatcagtatctttcatcttgcgggccatcaggttgagaaattcagggaaatcgattgttccattgccgtcagcatccacctcattgatcatgtcttgtagttctgcctcagttgggttctgccccagcgaacgcatgacagttcccaactccttagtagtaatacaacctggaagaaaataactttatctatgtcactcaaagtctaaaaatcgttcaactcgaggtgtcagtgtatcactacatagtattcacagtactgctttagatcatcaaggcttgtcgctgtttacaaactgataaaagaaagagaaacaagaccaaaagctgagcactacttgaaatgaacagaatcgaagtgttatctaaaattgcttaattattactccctgatcatatatgtaaagattatcgaaaacagtagtagctcatgttagtgctaattgtaaacttcttatcctctaccaccacagatcttctgtagaaaatccaagaaaaacaccaggacagtgtcgtcgtattatcatacgagatgactaacccaaattactacactattgcaatgggaatgaaaacgaggactcgtgagaattatcccatctaaacctaatcaagcacgaatcattacgaacaggcactagccagtgccccaaatctcaaaaaggccagaaaattcgctggatcacgcgattgaccgaccagcatctactcccaaaccgacgagcaacgcctatattatcaaaagatccggagatttcagagcagctaaacgcatcccaaccggatccctacagcaaaccaagaatcgggacacggagacgacggatcagggcgttcgatttaattaacccccaagaaaaagatcgccgatctcgcttcggacagcctatcgatctggttcccgcaacaaaattacgagagggagggagggaggtgaggcaggggttaccgtcgccgtccttgtcgaagaggctgaaggcctccttgaactcggcgatctggtcgtcggtgagctggtccgccattggcgacgcaggcgcgcgcgagcgagagagagaggaaggagaggggagtcgtgggggaggagagcttgcccgagttggagacttgcagtgtgggtaggcttacctccttttttattgcagagataactcacgatttctactgttttttctaagactagtgctaggttaggcttccaacttggcacgttcttccaatggtttaggttgagggaattgcctgtaggaggaacggttcggtactaccttctattctatagttatcgatccaagttatatagaaaaaataatgcttaaaaaaattactgtaatacctatatttaaggggtaggatagagaaaattttgaattgatgtgataaaaggtacttctaaactcctttttttttgaaaactttttaatccaaaagcggcctctattttggaatgggaatggacagagtacatgcactagctaggtctcaaatactatgtattatgtgtatgtggtctcaagtaggatcctaaacaatcatagtaaatccaaaacgaaaatgatctggtgtcccaaacataatagtatatcacaataaaactatctagtacttgacatatcaagcaatttatatttaatagtgatttgtagggtttgttattgtagagctaaatgttgccttagcaaaagtttggtagtacatgtttatcaagcttcaagcattcatcctccaaactctaccatttgtttatcaattgctttcaaatgaattgtcaaattagaaaccctatgttttgggggaaaactgattaaatgaaatccctaattaagaaactgagataaagatagctattataaataaattgaaactacattcaatttgaatgcttgaaacttgtttctctgcataagaaatagctagatgttgtcgtcgacataaaatatagtgtaaactgggtggccaaggtgggaggagggtgctaggggtctataggatccttcgctgagattgatcacgttgtcacttaaagtggtgtgttctctttgcaaattgagagcttgctggtcagtggtgtaggaaagaaaaggagactccttgccttcatcttcttgcctagacgaagaagaagagaactcgatcgagcaggcatcttttgttctttagtgcgtgtctggccattctaggctacttgatgggctttttcattctgcagtctgatagcacacgatttgctctaactattgggctagggggtgacgtcatttctcctatatgggctttagtaattaaaaacaaaattagcatgtgtcatgtgcatcagacgaggtcaacaagtccatgtacacattgtctagagcaacttagggcaagaacaatgcaagatatgctttagctagacctcaacaagatgtagggccaatacactgatcgaacagacatatactccataatgtatgtggtctcaagtagggtccatgcacaagctacatagcaacttaaaacgagcagtgcaaagacatgctctagccaaacctcaagtgtcatgcaggagcaagacattaaatagacacatactccacagtccacactacatgtggtcttagatagggtccatacataggattcaaagcgaatcccacctaatgatctgccccgggtgagccatgaaacgtgtaggctccatagagatacacgactcctcactgagtgcgaacataggggtggaagtccaccctagcaccgcggggatgttaggaaaaaagcccactgtgtatagccttaagaagaaattctacttttgattctaaacattgtcatcggcaaacatagattttataggacagatatcatggcccgagaagggaagatattgtttagatctaaaatcatgattttttttcttagacaaagttttgaagtttgaccaagtttgtagaaaaatatactaatatttttaatacaaaataaatatactatcaaaatatatttaatgttaaatttgatgaaactaatttggtgttcaaaatgttactaattttctctataaacttgatcacacctaaaaaattgactaagaaaaaaaatcaaacaacttaaatatgaaatgaagggagtaattcagaagctttcccccgattcatctgaaaattcatgtgtccgattaatcggacaacgagggagcagcatagacaagcagcagtagtttagtttgatttgaaagtgattggttggcaacactatcagaactcggcaacggcacaatattagcagtatgtcttgtacctggtgcatattttacacggaaccaaacattctctctaccataccaaaatttgctagtgcggcaatgccaacaaaaccaaaagtttcgagccattgacgctagtatagtttcagaggggttggaatttgcagatagattcagttcaggacaaaatcccagcatcttcacatggcgcgcaaaagagtaccatgtttaatacacgagactgtttttttctttacctatccaagagcctatctcaaatgtaatgcacgcaccaaacactcgctgcatttacccaccacaacaaaacgtgcaagcaggtgccaagcgcagtgcagcccaggcatcctgctatctctctcacccaactctgttggacaccgtttggtagatgttcttcagctgagtattccacttgtctatggcttggtatttcctcattcccttcgacctgcgaaatgcgaatcggatcaccttcagaaaagcaatcgcatagatagaacaatgtgatggaaaaagcagggggaatacgcacctgtcaccacgttctagtaacttgttcacctgatctatgtggccctggattcggttatccagaatgagtgagaccaagagctgctcgacatccttttctgggaaatttagctcctacatgcaaaacattgacagaacaatcgatgacaaggcatcttgtacactgtacgaaagcaaatttcacaaaaaactagacctccgtgaggaacagcatagggtctgcacgattaagcgcacatgatttcaattgaactggaatcacctagtttgggcacacgacagaaaaagatcaagcttcaaactatatttcttgcaacttcctaaaatagcacgagtatataccaaagttccatgttactaataattttcatgcaccatttgttatcacaagatattgtcatattcttctggtattgagcaaatgcacattatctggtgttggacaaagaacagattatctagacaaaatactaatctttagctcacatcaatttctgtcagcaaagattatcatgaacatttaagagagcgagtattcacctgtgaaatgaatggaatcctgattctagtatatggcttaataagcttgagcagaacttgagttctgatgttcttcaataggtcctcaatataattacggatgaaaggatcgtccattattgttcttctgttgctctgaattttgtttgtaacaatcacatcagaaatccagaatcaattaacagaataactagcttagaattgctgcagaaaatagcaagatggataatgttcaataacactgacctttagaatcttttcaaattccatgatgtcattcttctgatatgctgcaatcaagtttgtcatggcgaggatctcaggatcatttttgtacctgaaagcatcaaggagttacagggtggcatgaaattaagatacaagatttatgagggaatcatcaaatgtcttacggcttagcctcttgcccatcaaagggattcacttcagattccatcaacatatttgcaagaacaagatatctaatatgcagtacaataaaaaaggatgaggaagttctaaatttatcaatatacgaaattaaaatggaaaagaaatgcagatgatttgattacttcaggcattgaattctccgcggattgccagcttcatcatagtttttgaatgcttcaaagaaatcagttgcagcatctgcccattgcctctcagccatgtgcatctttccaccacattcacgaattatacccatgattcttggatgaggtatcgctgatttgatggaaagagcttttgtatatagttcctgcagcagaggttcacttcagaaagtgcatttcatgctaactgcctaaggcaggagaaaggtttgaacccaatatgggtcaacatagtactataaatgaaataggctaaatatagtcaatgctcttataaacatattgtccaaaataggtacaaaagacaggcatcagctttgtaggttttattttataaagctgtagaaaatcaataatttagcaaggaagttgtgtgctcactataccacctgatttcaggcaagcatattatgcaaatgtataattgtatactcagtggcaaatatcctggtatcagtaacatatcaacctatacaaattattgtcaaaggaataaaccggcaaaacagcagaaggatgaaaagttatctttatatctgcgttctggctgcagtcaactgtgttttttaacaaatatacagctagagtactgcaatattgaacaagaaactgacacaaaatcttgaacagtagtaacctgtaatccaaaataatcacgtgtaaaaagactgacaatatgtcttaccttcaattttttgttgttctttgtttcagtgtacatttggatctcaatagcatagacttccaaaagttgtgtgcctttcttctgatcatcagaaccatcttctctttgacaagatttatgcagctccttcagtatctacaggaagaagttacgagcaaaataattagagtaatgactgcagaatatgtaaagaaaaccaattgactagagaaacttgtataagcaccttgctcatccggccatactcccccatgtcaaaccaaattttgcaaagcttcaggtttgtcttaaaccataatctctgcgcagcaaagaatagcaaggtataaagaacaatcttttggtacataaaattctaatttggataaggcaagaaactgaacctcattctttgcctcttcaagtgctttcagtgttgtctggtagaactcttgcagaagagagaagttttgactagctgatccggagacaaaatccataatgttgtttatacatttctcactgtagttacgtgtcacagcagatttgatgtatgtcaacatctccctataggcatccatcatttctttgtacttcccaagcttataatacagcttcactgtttgtttcagagctttgaaacccctataaagaaaagagttacagaactgacgtcagatctctaaaatatgagtggctgttggatacagatacacttgatttcactgacaacttataacacattaccattgaaaaaaaaggatgtccatcaaaatatgcagccctccaaaaaggccactaatacttcagttagaattctatttgtggctcaagcatatcctatattgggaatctggggggattcctggtcaacataatatgacctgaggttttaagatcttaggtctgaactttgagaaggctcgagctgatggtttgtgataaacaattttcatacatctttactgcacaaagagtaggtgctagtgatgtcatgttatatcttaaattgttaatcttctgtggatggatctacgtaaacaagaatttgttgtttgtaattttttttctaatactgcaccatgcacacattcattcaaatatataaaagaccggttcatgaaaccttatttatttttaaatttttagggcaattatcttggcatttgtaggatcagaatacagactatatctaattgaaagtcttaacagcatacaggcactgtgctaccataaaaaacatacaagtacatgaaggtatggagtccctgaagcttaacgataacaagtagctcatatgggcatgttgacagtcgaatgccaatagaatttagagttcatatgtccaggaactttatattgtagatggacctatacagcaactaaaatcgacatcattatagatacaattgatccccagtaaatgtagttcttactaaatctatcttacatggtgaaagccatatcacccctcttattctctacctttgaatgagtactcagtggcacagatggataggtaggcgaaccacttaagctttgccttagactgacggaacaaagctaagaagtaggcagaatggaaaaaggaaagggacaagggcggtcgtcgcttggcgcgaaggctgctggtttggtacggtactaaaggtcctcgggtgtttgattcattctgctgagcccaacactttaggcaagcccacaagacaataaaatccaacatcttttgtgaaccgcacagaaggcaaggttttaatgtctaaccaataggatgcatacagacgttcaagaatgaaatattaaatgtgaaagttaaaaatacggcatcaccagaagaatgttttcaattatatattttatttcattttgcaaccatagaatttgttcaaaatgacaccttccttaccacatgcgtaataagatatttcagcagggtatcaactagtaaaatgttatataaggcttaccattcagccttttcaggctccatacgtactacttgatcgaagccagcaagtgcaccctcagggtctgtctcaaccatacctgtaataagatatttgagcaatgtcatatcataaagcagcatatacatgaagtagcatttgtaattgtgtggtaacaaaagacaaacacaatttatgcaagaatccccatgctcccacctcacagaccatatgaactagctttccatttcagaaacaagaaataggagtagccataattcatctacctctgttggctttttagggcatattttattttgaaaaaaaaaaacttcaagattaaactttgactattcatttcacataataaaatataatcataatagccataaaactaactttttaaaaatattttgactaattgttgaccaaaatctacgaaattttacttctcgaaagcgggcatatgcctaataaaaatcaatagagggagtttttttttttctgccagataacactatttgtgatcaatttgattccaaggtcgtcatgggacaaaccgacagccacagcacttgaggatgcaacggcgtccaagcggccaccttggcatccccaatgcaaggtaaggtgagctttagtagaggagaatacatgagcaaagctgagcagaaagaagaaaatcaagcttagcaggttagcagagcaaatgagaagcagcaatggataattggagacagtgacagcattgctgcgccaacaacaccagtacaccacaccttcccttcttcggttattccttctcttaaccttcttttctctatacctactccaccataggccatgcacactcgttaacgccccctccctcacacagtcacgtgacactgccagctgaccccacccagatgctcgccatggacagctagcatatcctggatgaccacatatatggccaaggcaaggtaagcctctgccagcatcctcctcaggcctcctactctcctagatgccactgctatgacttttgataagtgagacccgtctttctaaaaaagaaggggcactcatggagtaaggtaagtgaatcatcggttttgggcataggcagccctctattatagatcccaattgccatctcagatacactactttacaagaatgaatcatcactattgcacttaatacatatccatggaaaagaaggatatcatagaaatttttgttttccttttttggatccccatgcattccattattcacgtaactatggattaattgtccctgcctatccaaatggtagttgtctaagagcgcaattactagagaaactctattttccgtattggtaaattggaacatagtgtgactcttcaatgttgcgagaactagtccttgggcctcctcttcagtttttcccttccctgatccaaaagatgggtgcaccacctaactggcactgtataggcatcggtaagatgtgcaggccagactctggacctaggttcttaactaccggagtgaagaaaaggccagatcaagaaaagggcattgtctaggcgatgccacaacaaccatgattgggtttgtacaaacatatcggcttttttccttcttttttttttttgaggaaagacactgcataattagtagtccgcctgttaagattatgtgcacaaatttgtaaagcccttatgtttataacaactggtggcattaatttaacctcctttataaggctagaaaattctacgttgatctttagaagcaaatgatgaattccaagaaattatcgatcctcaaattaatttagtcatgtaaaattatagcagtgaagattatctttcataaaagtagaaagtgaatcattaaaaaaaaatctttccaaatgttccatacacagaaaggtaaaggcagttcaatcagatgtattcaaagaaaacaatgcacatgcccaactaagtctttgtattttaatagtggcatgatttataagctcatgaagcaacaactatcaggtattcagttttcatacaaactaaatgtccctttttagttgggaagtgtttttttttcgcagaaccaaaatgttagttcttaattacaagggacacaataggactaaccacacagtcggtggaaataagcaagtagtactttcactttattaagattctgatggtgtaggatattcatggtcaggtttaaaaaaaaacgtcctaagaaattcaagaaaaatatacatacatgcccatcaacaaagtcacagttaaaccggcaattacacgcaaaagcaaagcaacatacatacatgcatcatagaagggaaccctaagagaacagctaaaaatcagggatttggctggcacacaatcatggtggcctctcctcgaatactacactaccacactacatacacagggtccgagaaaacgcaccgccgaggaaacacaagaatgaaagagattggaagcgaacctttggagttgtagtactggttctcgatgtcaacatcctgctcctccggctcgtcgtcggagtactcgaacccgtaatcctccatgtccgcatctggaaaaggaaccgatcacggggatgagagaagggggtgcggaaacgacaatcgagcgagggcgcgaatcgggatatcggggattaccggagcccatgtcagcggcggcggtggcggcggagaggaggaggcgacccgcgcggcgacgggcggagagggaggggagggggcgagagctagggtttccgagaccgcagcggtttgcagttgcggaggcggatgcggagagagaagagaggagaggacgaagggagggggcgacttttgcgtataagcccctgggaagttagggattttaagacggagacggaatacacctgaataataggatgctctctctctcccttttttttcacgaaaaaacaggcaaatgtttggatttctcaggggatttttcatgttgtgtttttttaggttgattgatttttcatgttgggttaataaagcagaaattgatgattttgatttaaaagcgagtaacgattgtagtagagaagagtggttgcgttggggttatgttaaaaatagggcatgcacactctcccggtatttatcactctaatttattgctttcaccatatgcatgtccatgcctcttcaccgatgcaggcgatgattaaggttattatttgttctaattgcgtagtatactccagcatttcattcctttcacagctcccaagtggctaactgttaacaataaaattcggtacagttctttagtgggcgcgtttgctttgtggacactctttctcgtctctccgttttccacctcgcacaccaccgtcgtcatcgttgacgcgttgcttgccatcactggccaccatgttagctcggtcaccgaccacctccggcgtgcccacgtgtccctaccgcctagcatcaaggcactccaagcaccttcccccaaccctccgcccgccgtgtggatcttcgtggacagcgtcatttccttggctcatctccgccaccatagaccttcattgtatcctccgccagctacaccgtcaagcctagttccaatggccccaccatcggccaatattctattcaagttgatgcaagcattgcatcgttgcttagagtcgtgtcggcttagttaggactttctcggttagatttgatattctaactaagtggtatatttctaatcataatgttgttttagattgatcgatatatccattacgtttgtgtagatctatcggctaaataggtttttcttattgtcttcaatcttatattgtctcgttaggtccgatctattagattgttgctataataagttaaattctagtaagctgatatgtttcatgcaaaatttcattggagttctaaccaatgagttattattattatgagctccaatgaaacattgcatgaaaacatacctgacgatgtatgctttaaccatcggacctgcatcttccacactatatcagtatcggttaattggttcatttctttctatcatccttgttagttgcaggatcaaaactaactaacacgctctgagccctaaatttaggacctgcactggagtaaaacacatttcccaggccttcatgcgtcacgacgtattttgcatcaacactaaaatacgctgtggtgatgccgttcttgctacaaactcttcaacatccgcaaagatttgtttgaattgctcagagtatcttttcaacttgttgaggcttcatagcaaaaactcatgaaagctactaatattacatcgaaactccctgcaattgcttgaaaaaatagtttgtctatcacttgaacgtgctatcacgtcaggaatgttcccggcaccatatcgcactgtaacggcattcttctccggtcgtgatagtaaagattaatactcttttcctttccgacaaaaatagagattgcggctcacgaactatggcaacaataggtgggtgcgtgtcatgttagatccaacatttacaacatcttccaacacttgcattgtccaggttttcagtagttggcgtcactattcaccttcaccaagaccaaacattatgccataatgcagagcacagctaagagatacttaggatgctaaggaacttaagtatgaagtatcaacaaccccaaaacatcatataattacccttctgttggaaaactgtaacccccactgtgatgcagttcactgccacttaaatggagatcataacaaaacctttgccaaatggtacattgttgaagtctcaatactttacaaaggaacacacgaggtgcagattctgctaaccacccatcatctcaccgttcgaagcccctcaggcagaaaatatcagcattcctttttgaaggaaaaaaaagctggagatggtcttcctacagaatcagtagacaagctggggctcgaattcagcgaaatcaacagagccagactcgattgggggcatgaggtacgcagcaatgatctcagacaccagagcggcaacgtgaggaatcctcttcaggttcttcaccagggggatatcgtcagactcgcctatggcaatgatctttttgttgatctccaccatcctgtctaacttcctcttgaattcagggttctcgacgtcaagaacagcggggaaaatccttgctgttgtgcggttggtctgccaaaaaaatgcacagattgtatcatcagtgtggtcatttcagtatacaaaaattaaaaacattctcctaagcatataagtaaagcataaaatggtctgcacccattgcataatgaaattgttttaatattcagcaattcttctgaaacagtctggactacagtaaagtagggcacataattaattttgtaaacaagaaaaggaagttgattttcttacctcaattatcacatgcatgtcgaattctttggtgtccagaccaatcccttcatagaatgtagtacgttggcaatcatttaggtacatggtcacatacacctgcaaaggatcacacacaaaaactgttagaagaggagcacagtaacaatcttcagtgtgaactgttggtccatgcaaacaacggaatagctcggagattaccgagaggcagaagaaccgtgaccagagcttggccttccagtcgttgaggaactgcggctgcgccttgagcagcgcggagaagaaatcaccgtgacggttctcatcctggcaccagttctcaaagtacttgaagatggggtacacctggtactccgggttcgccttgaggtgcctgaagatggtgatgtacctccagtacccaatcttctccgacaggtaggtcgcgtagaagatgaacttgggcttgaagaaggtgtacttcctagccttggtcaagaacccgaggtccagtgccaagttgaaatcagacagccccttgttcaagaacctgaacagcataaatcatgcagacaattcagttgaattgcttactcaattgagttgaaatggacgccctaaaactgaagcttaaatattttctctagtcatggtacagttcaatttgagttgtaatggctgcttgcaatcacattgtgtcattgtgcaaggaaataatttagagtgtgttactactacttacccagcgtgccgggcctcatccctggacatgagcgagaagatctcagccaccactgggtttgttttctgcaaaaaaaaaaaaaaagaaaaaaaaaggagcattagcaagcgcccaccaggtgctcggtgaaatgcaaagcaagaagctagactgcaactacgaaccttgagcctgcggccgagctccttgtagaggaggaacccggagaactccgcggtgcaggagcgctcgaggaactcgacgaagatctgcctgagaggcccctccatcttgtcggcggcggccttgaactccgggttgcggacgaagtgggtctggttatagtccgtcttgaactcctgcagcagcgcgtcgaactcctcctggttgagctgcttgttgatctcggcgttgaacagccgctccatctcgtcgaagtccgtggtgtagaaccgcggcgtcagcagcgtctcctggatctccgtcttcccgcgcttcttgggcgtcccgggcttcgccgcgggcggcgccgcggctgacgacgccacgcggaaccgcacgatgcgcctggaagacacgacgcggggcttggcggcggagaggccgcgcattgccgccgggttgaggagggagagctccatggcggaggaggccatttcgtcaaacacctggccggggcgggagggggaagaagagttttgggggaggggaggtggtgggcgggtatatacatggtgggacggatggatgagataaggtggcgagagatgaggtgtaatctacggctatctaatgggggctcgccatgtgtaacagagtgcaatctaaccgctagctcatctccttcccttttcattattattattgcctccatttaaaatattatttcttttggtttcttttacaagttggaatagtgtttattgtttttctgggcaaaacaagttgttgtgtttgctggtttttttgagaatgctctttttgccccttttttttctttgtttaggagaaaatcttactgttttctttttgagcatatagcaattggatagcaattcttcaaagctcatctatggagagactatgggcccgatcgagagtgagggtgggggaataacccctctggcacggaaaacggagcaggccattagcacgtgattaattaagtattatctaattttttaagcaacttttatatataaacttttaacaaaaaaacacaccgtttaacagcttgggaagcgtgcgcgtgaaaaacgaggtggtgggggcgtttgtccgtgggaacgagcgcaccctatatcaaaatcttgagaagttggcaagttgcgcaaacagcatatactaggactgttcgctgcgctgcatccatgtaacttgttcaagtgtgggtgtcttcaaggaatttggctaactgtggcacacttg

SEQ ID NO: 38128 - DNA, 6390 bp, Oryza sativa
cagattgggagccagctacagcacagactctaagacgcaatgtgtgtatgataaatgggaccagatattaaaagtgtagtatatgtttatagataactattgtataaattgactataattgactatagatgatccggagctagtagttggctatactattaaacttgctcttacatggaaacctaattacatgtgatattcgtaaacctatgatttaaatcctaggttgtgttctttctcccacctttcccaactcacctctattattttccacgcacacgcttcccaaactactccacgatgcatattttgtaaaaaaaaaatctatagtaaagttgctttaaaaatcatattaatctatttttaacttattttagctaatacttaataaatcatacactaactattactccgttttacgtgttgggagcgagagggtccccaattaatccttactcccgaactcaacactaatagatgaagttatgcacccatgccacataggatttaagtaacacgaaccggtaaaaccctttctagaattcctttaaactcacaatgtgatacaccctgtgagcaataaaactaaccaaactgcctggtttgtagtttagtgaaaaggactaagatgtgatgtcgaaaatgagagaaacaagaggcgcacaagcttcctatgtgctaatgttcacaggctgcgctttctatgtgcacgaacaacgaatctcttttgtttttcctcgcaaaaataattgaaaaaacggagcaagattttggcagatatgtccaacgggtttcttcaaggttcaagtactggctaggacggagccacgtgtctggccaggaatataacatgtcgtggcaagagaaaatggggagaaaacctatatatctagtggatgacatatcacaggcatagtctaaaatgaaatatgtgcatgcatgatggaccacatttttgtaacttgtaaaatatcactggagtcagccaaaaaatctcttcggacttggcaaacgaggtgctataatccattggcaaaattggttatgagaagatcaaaagttcagttttataacatcatacaaagttacaggttagctttgtcggaaaaaaaacttaatatatatagcgattgtttatgtttttgctgcaaatcatttccatcaccttaatggccctgttcggtgcagcttgctgctgcagccgttgcaactacaccaacatagttattgtagcggctgcacagccatgcaaaaaagttgcagtgaatagggccaatattaaggatggattcggtcaagataggtcaaaaacaggaaaaatatgttagccgccacgacgaaaacacaaaataaaaaactataggtagaattttaggtgctaacaaatttaatccatatctttcaggtaaatataccatgtacacttaagtttcacatgcacactccgtacacacgaactaacaaatatcatcgaaaaatctaaaaaaaatttgtgcatatagtttcaatagttttatacctacatataaaatcttaacctcaaatttattatattttagctataaaaatattactattttatactacaagtctgttagaattttatcttttttgttgttctccgtgtacgatgaatttaaaaatgggactttacttgtagaagcaatactattgaaagcacatggataatttttttgataatcactagctcatatgtaccgtgtgtacatgtgagaacttgtgtaatacgttcccatcttttagagctataaatcgaaaatcatagacttggcttgcttgattcagtcatattttgcttatttaccaacaattacttaacatgtaggtgctcaaaatctttgcacaccttagtaagtctacgtgaattttaccatactttttgagccattgacgtgtggaatctaatttattgaaagaaaatcttaccataaccgcgacggcaacaaaacaaccttaatgttaacaaatcaaccattttccccgcgatgttcacgcattggtattcttccgtgcaaacaaaggaacaatctcaggtattcaagataaccatcagaaatgtgtacccaatttacacctacaatttttctgatttctccaacttgctttagagccaaaacgcccaaaaagaataatttaaatttgcaacaactagaggcatctggggacgtcataatcgttctgaatttacatggtggctcaccgccgtcggagtactctcacagtcctcgttgtgccaccggccggccatgaatgggtccggcgctgccggtgccgctccccgatccttgatatgcacgctgacatcgttcttctccatctcgtcgtagtccagcccccgcaagatcgccgggatgatgccgccgttgcggcccatctccaggtccaccttctccttcacgccgccggtgagatcggccccgttcctcggcggaagctgcccgctgacgtcgtccggctcctccagcggcggcggcgccacccatgaccggaagttgttcatcgacggcgggatcccagcgcagaacacctctgctatgttcgatatagcacccctgttatacgggttctccttcttgtcgtacctatatctgaagttctcgtacgttgtctgcagtagagaagcatcacatcagtgatcacaaatatttttttcagaacaaattttgtatcgatttcaagtaaatcaatcctagatcaggatttacttgaaatcaaaatgtgcaatttatgttcattaaaatctcgatcctagatcggaatcggaagtttcttttaaaaaatatattaaaaatggtaaataatcatagttctaggtaaggttacaatcataaaatcgtaaataatcatagattcaggccttcgatcgtaaagtcataaatggtacgatagaatcgagaatttgacaacctggtcactaagtagtgatgagcatgataattttgtcgcgaaattggacatctttgtgacaattcttgcgtgcattttcttcaggaaagaactcaacaaacaatttaacaacatggcttgatgcggcctacctggtttgtgctcatgaggtagaggtggaacacggtgaggccgccgacaaaccacaccgagacgaaggtgtacacgatcagcacgacggacaacggctcaccggccatggatttcagcagcgagccgtcgttgccgtccttatgcgccacgatgttcagccaggacaccacgaagacgtagacgcagaggagggtcgacgtcgagatgaacaggaagaagaaccggtaattccgctgcacaaaatgcgaaaacaatcctccgtctcatcaaatatatcatcattggtattttatcgagtggattatctacttggttgtagggattaatcaaatatttagaaaaataaatttaacaaatagtttaaaacaacgcagtagaagaagtttttttaagaaaacttatttttttcacgaacatgaaaaaagattacacatcaatatatcaaaagaaaaaagagtttagttacacaacacaaaacggctatattgccattattggagaataaagaaagaaaaaaccgaaaaaggagaagactgatactaaggaaaaaggctacttaaaaaggaaaaaaaatagcaaggaagggcagaggcagaggagcccactgtactttcagcaaacccccaaacttattttttaatgcttgaagtaaataattcgtttaagtaatccggtgaaatagctggaaacttgtttttcgaagcatgaagtaaataatttgtttcagtaattcaatatatcagcttaataatgtacagtactacatcagtaacagtatggtgctcaccagaccgatgcactggccgacccaggggcagtggtggtcgaacttgcggacgcagttgttgcagatggagcagtgggaggcacgtggcggcctgtacagcaggcacgtgtcgcagtacttcaccttcacgacgcacccgttcacgaccacgtccttgctgcgcggcagccggaggtgagggctcgccgccgtcacccactccgccgacggcgtcgtcacgtctccggcgaccccctcctcgtcgccgccgccgcacgactccggtggccgcgcgttcctcggcacgatccccgggtccctgctcgatgtcatcagcaggaatgccaaatcctgaactcgaaattgatccatgaaaggggaagaaaaaaacatgagctgttgtgttacaattattcagacaaaaaaaaagcatgagcagttgtgacagattattcagacaagaaaaaacacgagcagttgtgacagattattcagacaaataaacagctgtagttagtggtgatgattgctgaatttcagaatttgtgacttactgctaggccaagaacgatggtggcaatgaggacagggaggccaagaacttgtttctctgaactgatcgagttcatctttgtgatgcattggcagcataggcctaccagaggagccactatgagcacggtggacaggaacagagaacccgcatccggaccgaaaatcaggcgtccgccgcagagaaatttctgaaaaagaaaaaaatggagaaagcaaagctgtctgtcatctcaaagtgtaaacaaaaaaaatattgatctgaatttcacaaggattatcacaacaaaaattgcaggttgcaagaagattttcaaagagaagtaatggaaggaagagagaggcgagatgatcgtatcgtgtcgtacgttgcttccctgccagacttggtacaacctcctctggtttggctcccccatgaacaatctatctttctctcccttgaatcctgatcaacaccagcagtcgatcgccgccgccgccgcagcgcgcgtagcttcgtcccgtcctccggccgccggcgccgtcacaacgcggccatgaccgacgaagaggcaggtcagcttcctatctctttctcatcgccttcctgccatggccatggcttctccagctctctcgtgctctgttttttcttttttttttctttccgcgggaaagtgttggaaacgagacgaagctaggcttaacgaccgggctggctacctgccggctacacacccaacgtgcccgcctgcactggcgctgcgacagggtggatccatttggccggcgcgggtagattgtggcccacctgtcggtcggtgcactagcccgccttcacgttcaaatattctctcccacctagccaatcactcatcagagcttattatttcgccaaaaaaaaatctgattagagaaaattaacgagtttattaattttgtttcacagagaaaaactgcaatctcctttctgttttcaggaaatgtgatatcgtttactatgataatactatctttttttctttgctctgatccaaatcagacaattttagagagggctcggaaaaattaaattcgtcaaatattgcaaatgttgggagagcaggtcatggtctgcacgtacgtgacttagtctacaaaaataatcgaaacaaaattgaagcagagcccacggtagtacgtgccaacaactaacgtttaatcttttccattttttggagatcatgatcttgattttgatattggattgatgctttgggcagtactatctttgcccaattaatcctacaatttgcgggacttgcaggaccagatctaatttaaatatttaaacccttcacaaaattagtagtcgctcatatgtaaatgtttggtttccatgcttttagcccatgtgatttgagcttaatttggacacgggtggtgggcaattaggctgaagacaaacggccctagttttgatcgaagagatcaactgcaactaattaatcctctgtgggcaaaactttttgggataaattcaatcagtagcctccacttgtaatcttgtatagctcctgttgattacccaatcacctggcaagtggcaacaactggatgattctgtcgacatgattcgatataatgggtttcaagtttgttgatttttatctggtaggtttagagggttgtgcacttgtgctctaagattggtggaggttattatattagccttaggttgtccaaacttatgatagcagctactagcaattgtgaatggttaattaaaaatctgtaaatacactcaaaatctgaattattccttgcttttccaaaaaaaggaaggacactcaacaccatacttcgagatccaagactgaccctaaaaccatacactcacaaaaggcaagaaaaaaaatggaattcagcaatcaaaaataaaatgaaaatgaaaaaaaaaagagagagatagagagagagagagagagagagagagagacaccaatcagatgacattaaccgcgaacggcgtccggacggagtgcgcgccg

SEQ ID NO: 38129 - DNA, 1700 bp, Oryza sativa
gcggacgagctgctccttgtagccgtagtagcagaggaagttgaggtagtcgcgcgtggtggtgtcgaacaccagcccggggctgagcgcccgcagcgggctgatctccccggcgcccatgtcgtgccccgtcgccgccgcgcccgtgctgctcgccaccgcctgcccgaggttgttcctcgtcgtcgctgccaaaatcaaaaccgatcgatcgatcaatcaatcggacacgcctctgctctcgtcgcgttcttgattcgatcggctacgtaccagtggtcatgagagctgatctgatcatggacggcgaccagcctgggtgcgccgacttgacgaaggcggcggcgccggcgacgtgcgggcaggccatcgacgtgccggacttgatggcgaacggcgacgggttcttgccggcgggcacgtcctccttgtcggcggtgggtatcgtcgcggcgaggatgctcacccccggcgccatcagatcaggctaaccaaaaaccaacacgcagtcaaaatggaagttaccgccatttatccttctagaattttaccaggtgatcattcatcctaattcaaaaagtactatcgacgaactcaacttccttaaaaataccgtcgtacaagtgtctttatccaaacatactatcatcgttaggttttcgttagcaaactccgtttaaatgctactataagaaagccattttacctcttacgcattgttgtacgctgacggaaagagcgagaatttcaatcagctttcaacgaattgtagggggtaaaatgttttttttttaccccaacgataccttgaggatggcttcggtgaggccgccggggccgcgcgccgagaagctggccaccaccggcgccggcttgtcgtccttggcgtcctcggttgggaggatcacagccgtcggattcctgcaccgggggcaacatcagccgtcggatcacgtaacaaaacatggttagttgatgacggcgactcacttggtggagttgatgtactcgaggatctgcgcgccggcgtcggtggcgacctgggagaaggggaagccgccggcgacgaaggggacggccttctcggcgtcgtcgatgagcaccaacccgctagcgccggcgccctcggcgaccagcttcttcacccgccgcgacaccatcgggtccgtgcccacgcacaccacgatcttccccgccgccttctgcgcgtccagcgacccggggtagcagttgctgcacagtgcatggtgtgatgagcgacgcagctcaactgctcggcgatttgcctccatgggaaagaaggttgctagtatagtctactactactaaccttgcctccgacaccggcgtgtaccggccggccacctgtggcccgaacaccagcgggtactggcctccggtgatgctctggttggagaagttgatggcaattccctgccattgacgaggagaagggattgaggtctcattcatggccaagaagtgaggcatggcgatggtatgattaccttgacgagggtgccgttgccgaggacgatggtggagtggaaggagcggtcgatgctggaggcggcgacggtgaggatccagggggcggagttgacgacggtgtaggggttggggccgtcgttgccgccggagcagacgacgaggacgcccctctggtgggcgtggaaggcgccgagcgcgatggggtcggc

SEQ ID NO: 38130 - DNA, 7906 bp, Oryza sativa
ggcgccggcgccgccgccgccgccgcccatgtagacgacatacgactgcaacaaattccatccaacattgattggtcacaataaccactatgataaattgataactcatgcaaattatgcaattaacaatctgctccaactcttgcaggtgcaatctaatggtgatcaactgatcatggtcaaaatctacctctctggtctggtctggctcggctgagagaggtaccaggaggcggtaaacgaggacgaggatgacgaaatgtgcgcggttcaccatggatggaacttctcaaagatcactgagcttcagtgaagcaggttgcagtaaggacacacacaccacactagctagcttcccttcctactaatatatatatatggctaaatattttgctcgtgcaaaattcctctgaagtgcaagttctaagtaggagatgatatgatatgaaactcttcagaatggggcccaatttgtagctggaattctgccttgcttttctgatggctgcagaatcagattcatctgaactctgactggcctctttatgtacccttctatctcttttgatgattctttagtagctcctctctttccatgggagcatggcagatagaaacttctcatggtgatccgctagtcgccgttgttgtcgtcgtcgccgtcacctgaccagccacatggctggttgagatcaaaattaattctgcccaaatgattgttttctgacgagattgcttggctgcgaggaatggaatatgtgcggtctgacactgtctctacttggtggagatgaagccttgctttgctttgcttgcctttgccttttttttttcctcttgcacttaaattaggcttatcatttcattgatctcattctgaagctttagttagtgagcaattagcagtctgcatttggtgtcctacaattgcattgtttcttggttaatgatctgaatatctccaggtggttgctgatctgaaaggcaactagatgttagtactgaataaattactacaaggaaagtgatggatgatcacaaagttagttaagagtgtgtgctgtgttgttacctgttttaaccacacaaaattcttgtcaatagattgggaatcagagctaatcatgtcggtgcgttatgacaattgttgacaaagctgaggcaggctgtttttggtcacctggctgtcttcttttgagtgaagaattccatggagcacatatatcagcttgcctttagttagtgtcagtcgttttctggtagttgagctctcatctcaactctcaggcatcaccagaacacatttttttgcaacagatttgcttctttcttcttctgatcagtgccccttttctctctatctttctttcgttctttcatattgaatgcgattgtaatatccaaataacccaatagtgggatcgatcatcgacaaccgatgattgctttttaatggggctgaagatccaaggtgatgatcagatcatactgatcgtgatcaaagatgctaggagtaaagtgagaaagtaaacaagagatgtgagttatactgaccatcagtaccggcacatgagaaaaaagtgtcttcacagcacacaccgactgcttttgctccttcagaaggcagcgtgccaacggagtgttcttgcttgatatctatatttgctaccgatcaggccatgatcccggtgatcttgcaaagaagaaagcccgaattgtttgtcggtgcaaacggttgcagttcattcatccagacagaaaatctggctctcttccatccaaaattcagaccagctgttacctgaacaaatttgaaccatgagtcattcaagtccattttgtactaccatcttctttatagttctttcagcagaaaacatcaaaatatttataacaaaaactaaaaatggttagttactcttacacacacaccaaaaaaaaaactaataactgaaaaggagttttgtgaggttatgtggtgattgttccttccttgggcatcgaagcatcaagggccctaaagagagaagcgtgggggcagtagaacacatgcaggcaacaacaccatgtagccaagcaaggcaagcaaacaaagattctttccagcaacttaggaaactaggaatccatcttatgagactgtcagactgatgctgaaaaaggtcaaaaacatagtcagctacggccatgttcagttcctacgatagagagattacaaattttgtttccacaaaaaacatcgtggttaacatttcaagaacttgtgacggtacaccatcaagtcacaaagatggctcaagaaggctaaatttcagataaattttacaaccacatcaacaggaagggcatcagaaaaaaaatcgaaaatggcactcttcagattgttcacatcgtgcctgacaaagtggcaaacaacaaacaaacccgaatttgctccagttatttccttgtccaggttgatcctttgtgctttaatcaacatcaggtcagacgaaagagttgtgagaggccctaacaaaacacatcatggaagtgtatatacaggcaaatacctcacaaatatagagtgcagcacagcaaggcttcttgaaatttgctatgattttgagtttttgacaaacacagaaggcatcaaggtgcatatgatatttccactatgggaacacacattagatttagtggtacttctgtaggacagctaaagcctaaaggagaaaaaggagggacatgttagaagaaaatttgttcagtactgggctttgtgtgtttttaacggtgaccggtttatccattatctaaaaaatacaagatgaaatttcatcgggaaagaaataatcacattttgcaaacattgtgtttcatattttgaacagcaaaattcgctgggcatcagcttaggaaatacagagacggatgaacagaacatagaggtgtacagaagaacagcgaccgacatcactgctggttagacgttcttgagcttcttcatcttggatggtggccatctacctttcttcctcagccgcctcttctggacaagcctcctgcgccgctgcctcagcttcttggccagcttcatcttcgccctctgctccatgatcatcttctgcttagtttcgagcggcattgtctcaatcgaaaccgtgggttttggctcctctggttgatctgtgccagcttcttctgcgccagcctctgccgaggcatggacagaaactagcctcttcttggtgaaagaagcattcagagggctctgcgaggagagattcttgcactggagccttggggctgtagcatcagaaaggacaaatggcaagcctcaatgtgcatcattttagatatagaattcagagtacatgcatgctactttcaaaattttgatagaatctccgtcatataagaaacttgaaagctaataagtctagctcatgtgtgccacttcatggatagtatatagtacaataactagtaacaatcctagtgttctcaattacatattatgatgaatcttagcagagcacagatatgtaaaatctactcatctattaacaatcaggccccaaatgtagggtgtactacgaatgtcaccctttgccagtgaccggtgcttacatagcatctgatattatcatttaagcacgaaagaaccaaagcttcgagaatctgcagagttcactgagatgaattatacctagctttgtacagagatgataaatgcacggaatctcccacgaattactgcatctgcacacgacgtgtttgaagaaattccctaacgagccaaccgcatcccagagaatcagaaacgccacgaatcaccaacgtcaaatatctagaccaatcctcccaccgaattacaaatcacacctcacaacaatggatagcctcgtacccactcagcataatccaatccaagaaccaacaccccacaacccgagtaacttatgcgcaaaagtcccggtacggagaaggcgttcacggaggttaccggggatggtggaggcgacattggcggaggcggggagagctctggcgcgaggcggggaggcggaggaggaggcgaggaaggagacggtcggggagaggagcagcgccatggccacgggcagtgtgggattcggcttcttggcccgtcgtcagcctatccacccatcagcccggagggaggagataagcctgtgctgctgtgagcgctccgccgtccgatggagaatcaacggccagatttaatctccgtcaagtaaggctgcttggcagttggcccacatgtcataggtggagagaaattttgattttgattttctttttctcctctcgccgcctccgccgccgccgcgggtggcggcgacaatccgcatcggcggcgtcccctccgcccggccgcgctcgccgtcgcgtcctacgccgccgccggccgccacatcctgcgttcgacgtggatagcaagaggtgggggagctcgccgacgacaagaacctcccgttcgacggccaagcgggtgcccatcggtgatgagaagagcagctagcgacaacctcttcgactcccactccaagccgaagcacgcgccggcgccggcgtgtaccgcatcaagaatgtctcctcctcgtcgtcgccgtcgccgtcgccgtcgccggcgtagagcagtttcagcatcgaggacgaggaggtgtctgtacaggagctgctgccaatggttgatccgggtcgtcagctctcgtgcgccattggggatggaagcttctgctccttcagctcgcggacacccatcaagattatggagcgtgcagagatcctccagccgagcgtagcttcgacatggacatcaatgctgccggagaggaggatgaggatgatgcacgagccatcgttgtatcagtgtcagagaagatttacagaatctacgacaagtctcgcaggctggctcgcagggttcaaatttccggttcgaccaaagttttttttattcttttgtgtgaatttagtaatatttattcaaatttgaccaaattttgttcgaaaattcaaataattctggaccaaatttcggtatatcagcaccccaatacaaatactgaaaacgaaaaattgaaccatgggctcgccaagcgccactgattgctacattgtttatctaagaaagctttgagtggggtcggagacgccttgcgacaacattggcaaactcctctttgtgggaacgacgacgacagttggagatggtacaaaagcgaaattctgggactttgcttggttgcaagggagaaggcttaaggaagttggcccctctggtctaagcgactttctggaagaaaaacagaactctacagtaggccaccaaatctggccaatggctactcgacatcaacctatcggcgattgcaactaggatgaccaaactaatcagtcagctcgtcactgtctggaatgcagtccaagaagtgcatctcgtagagggcgaggaagacacgaccacttggaagctaaccaaccatggtgagtatatggtggcatcagcctacaaagcgcaactcctaggcacaacaaagtcagaatttgataccctcatttggaagccatgggccccatgaaagagcaagattttgcatggttggtgatctataatagagtttggacatcgaatagattggtaacacgtgttggtaaaacatctacatatgccccctatgtcgttggacacaggagacgaccctccaccacttgacagaacgtagatatacaaagagaatttggagaaccatgttagggtggacgtcctgcgacaagctaatactcgtcttgtgggaaccaaccacgacgatgcagaaatggtggaaggcaatcgctaacacaaggggagtgccaaggcaggcgagcaccttggtgttgctagtctcctgggagatatagcaataaaggaaccaaaggatatttcaacacaaagaactatctgcaccggatatttcaacacaaagaactatttgcaccaagcctagtcagcaagattaaggaggaggccacaacatgggccgagaaggggctaggaattaagcttgttgtgtggctgccttagccatagcagaccttaagggccaaacatgtacttttacacatttttcttgttgtatagttttttttttctgctcaattcaatcaaatttagggatgaaaacgaagcggatacgaacagataatgctcataccatattcgttttcatattttttaccggacacgaaaacgaatacggatagctcgaatacagaaacaaatacggattatctcgaatacaaataagaatcgaatatgatcagacacgaatacagaaacaattttttctcggaacacgaaaaccaactcaacttctaatagaaacaaatatcaacatatataattagctcattttatataaaatgaagtataatttataaatattttttaagaaataaataatattaatagtatggactagtgttaagagataaactacaattaaaatctatttgaaggttatagagttagaaagaaatgcggtatgtctcatggcttctgtggatatccgaatagtactgttcaccggatatccgaattattatcagtatccgactgaaaccctgataccatagcgttattcgtatccgtatccgaactatccgatccgaaaggtatccgtatccgtttttgtccatagcggacggaaattatccgctccgttttcatccctaatcaaattgtcgctcttcaattcattaaaaaaaaggaactacaatatgcaatttatgaatatataaattgattgtttgttgccttatttggtactaacattatacgcctctatgcaattgcttctcattcttcaagtaccaatcaaatagttatagaaaaatcaacaaaaaaaattgatgacgtttatataatatatagactaacttgaaaaatttcaagtacaaattcatgcagtgagtcaaaataattaaattcaattatggatagtactaacacggctcatagccaaatttctttatgtttctttcttcttgttttttttttgcaagatgtgtatatttgaatttagtgtttcatgttggtgaagtgacataggccattgttgcaatccatgcatattaatgttcttttttaaaaaatatattccaacatgaatgagtttatttggtttctctttgattggatttatatttagcattaatgtagatacacctattatgtaaattcttttaactatatgattaatgtttaagtagtgaaaagttgagtcgctaaattgagctcctgatttcttttacctcgaaaggatatcttcttgtttcttatgtgccactcaaatagttcatagattgaggactgcgctacgcgcaggtggcaggagcctgtggcttgctccttgccggccagcgttcgactcccagactcgatgctcgtccctcatttttgggactcacttcggttggtcccaagtagataatagggtacacacatgcgtgcgtgttcagtgggtctgtgcgggaaacacacatgtgaggatttgtgcgggaaacgcacatgtgaggatttaggtcctcaaagtctacatttgcgtgtgttgaacgcgcacgtgtgtgtgtgtgcatgtagtgttgcgttgtgtgagtgtggagtgagttcgtgtgtgcatcctcgttgtactctctcaaaaaaaaatagttcatagattcgtagacgcgcttagggctgtaagtgggtcagccgcgaatccacttatagttcaaaataagcgggttcgcggtttattttagcctataagtgggtttcgcgggttagccacttacacccctagacgcgctctccactcgtcttgttacccgaccgcctcgcaatgctagcttaatgattttgccccgctttggcaag

SEQ ID NO: 38131 - DNA, 4451 bp, Oryza sativa
gtgacagctctacgttgagaatggccggccgtgcagccgcgccggagcatctcgatccatgtctgtcttgcgatgatgccactgtgatttgcgttgccggtgtagtcacgctcatgcagctgtgtgttgctccccaccgtcatctgcctcactccaccgtagaagcctctaagcacacaccactggctattagtgcagatacaatagtagactataaaccagctattaacacatttttaagaagataaaataggagagagaaaagcagtgggctatggatttatagccagctatagcaccgattataagatgcatgtgtgtatgacaggtgggaccaactatgaattatatagtatacgttcatagataactattgtatgaaccggctattaaattgactatagatgatttagagctgatagttggctatactattaaacttgctcttagtgccagccgccacaccaactcaatcgtctcgttcgtcggaagtcgatttgtctattcccttatagttaacgacattaagtgtactactgaaagatgaattctctcgatattgcggttggacaggtgtaatacgagggacaaagtccttcctataagcctaggacggaagacgtcctagtacaaaattttcgttcgttccaactgttggaaatcgcctaatggttatgacctattgtcggaaactgtcggagcaagttagtgatgccccactagttgggcccatggttttgagaagataaatagttggggaatgcctgtttaagagaataatatccttgtctctataacattgttaggcataaacatgcaactatttcagaaattttccaaatcagtcctctaagcttttcttggcgcagggaccttactggctctaagttagtggcgtggaatcaccttctctcacgcatcgctaatattatattatctcacgaccaagatgagtttaaatggaatctaaccactgatgacagattctcggttaaatctctttatcttgcgttggtgcagaccgatgttcccaatataaacaaaagaatctggaagattaaagccccccctaaagattaagatcttcttatgatacttacgttgtggagtagtcttaacaaaagataatcttattaaaagaaattggagaggaaacaagtcttgttatttctgccacaaagatgaaactattaatcatttgttctttgattgtcgttttgcccgcgcagtttggtctttaatccagtttgcttcgaatattagtttacctaataatacaactcatatgtttgggcattggataagaagacaaccacacaatttgagatctttggtcttattaggggcaactaccactatttggtctatttggttttgcagaaatgatgtggtttttgaaaggaaaaacatatcttctcctttgcaggttatctttttgattacacattggctccggtcatgggctatctttcagaaggtcaatttgtggggtactatcattgcggcttgttaacaattggagctagtggccatggagttttctaccccggcggatgggtggtgttctaggctacggttagagggcgcctgaagttctttttgtccctgctattgggatgatgagtttatcttttgtttctttcttgttggctgtgtgcattctttgggtgcagaagccggaggtgctctcagaataattgtatcacttgatagagttttactgagattaataaaacttccattatctaaaaaaaggttgggcccatggtgtttcgaacttggttccggtctatgtggaggttagtgtacaattttactcatctatatatcctactccctccatcccataatataagacagtcaaactcgacacgatttctaaaactaatcttttttcttataatttctcatattctataaggtttgtagcaataccatatgaaaaataaaattcaatgtcaatccaatgatattattttcaacaaataaaattcaatgcatattatactaattgttggtcaagtgttgcaagagctggatctaaaaaaacgtgcacatcttatactccctccatcccgattttgagtttttgcttgcactgtttgaccactcgtcttattcaaaaaaatttgaaattattatttattttttttgacttactttattatccaaagtactttaggcataactttttgtttttatatttgcacaaattttttgaataagacgagtggtcaaacagtgtaagtaaaaactcaaaatcccttatattatgggacgaagagagtattattggatggatggagtatatagttgctatatagttacaaccaataacttcataagtattgagccacatcatttagaaagaagagccattacatcatttccattcttaatcacaaccattcattttgtagctactattccacattaattagttagtatataaattagcattgagtgattcacttagtgtaaaatgttattgccataaagaagttacaccatcaccatctttgacaccattggataacacctttatagttcatatcagcatatatataatctttctcatatctatattttgaaattttgcagttgtattgcacacgccaatatctcgttgcaccatctgcatttcatttcaatgttgcgccatctaaatgcattgacgaatcatttctcagtctccaacatcgtctatcactttttgtttgctgaagtgtgttcctttgttgtgctttcatcgttggatgcatcagattcctttcttttacgtgttgccacttgccagctgaacgtgcaaatcagaaggtgatggcttgtcgcagggcctagcttcttgtttatggttgtgctcgtataagtatgttaccaaccatgtgttgggatcatcgttgttaggctcaacaatcttccttgccacgcaccccgtggactgcttctggttgcatctgtaccatgatctgaaatgttgccgtaaaatccagcttaactattgagtcttataacgtgaccatagaattctttgctagatgacatgcttataagatacaactctttgtttatctaataattattttattataaattaatttaataattttatttgatgaaaacactatcattagattaacatttgggtttacttttatatgatgatttgttgctataaacattatagaatataagaaatttaaagtcaaagattagttttagagggattgtgccaagtttgaccacgtcttattcagtgggctggagggagtataacatcaaccttatcaaaattttgtaacacattttggagataccaaattttggtaatattgtaggtgtttagtttgacgccattccataatttggtactacctctgtttcatattaagttgttttgacttttttctaaataaaatttcttcaggtttgagcaagtttttttttaaaaaatatagtaatatttttaacacaaaacaaagaaactataaaaaaaatatgttcaatgctagatgtaatgaaactaatttgatgctataaatgtttctatttttgtttataaacttggttaaactttcaataagtttgactttaaaaaatcaaaacgacttataatatgaaacgaagggagtagtgtttttttaagagtaaacttatgaaaatactaaagtttggtatgattgtattggtgagatcatgtttagtttgtatcataccagattttggtgagttgaaaatggcaataaagtgaacaagtatctgatcacaaaagcatgtttgttaggatgtgggcagttaacccaagttaacttttatcataatcctgttcagaacatagaataagaaaatgatgtaccatagctttattttacgcaaaataattaagttgttaagttatgtcttgctaaattttgaaagtccaaaaaaaactctcctttctgactgggcagtacatatacatttagagatatatgcatgttctcaccttttgtacttggagccaagtaaatccttttcactatactttctccaattccagccatcatctgtcgtagtcttcttaaggagatattttactgtgtatttgtccctgtatattaggaaaattaaaacaaagaacaataagaatccatatgcatcttttataggcacaattacaaataacaataagaatccatatgcatcttttatgccccaaacatggatggtacttgtagattcgccccagggttgattgcaattgtaaaaatgatgtgtcatgtatatctttctactccctccatcccaaaatataagaatctagtactgaatgtgacgtttcctagtataacgtatccaaacagactctctgtctagatacattatactagaaaatgtcctatttagttctagattcttatattttggaacagatatatagtattttgcaccaagaccaagggacactttta

SEQ ID NO: 38132 - DNA, 1596 bp, Oryza sativa
tactgccataagtccctccctcccatagggacttatgtttttgagagtggggctaaaatttagccccactttagtccctccaaccaaacaccacataacaagggtattttcgataactatttcatttgaaaattagaaactctcgtcattatttttgccttgccctttgaccgatgttcgcgcgctgtggcttctcggattgggtgatgcgacgtcgggatgtcatcccgcacggcagtgatatgccaccggcgttcgccccgatggctcgtcctctcatgtgcaggcagataattacaaacatggaatgcaagcaaacaccagaaccaaacctgctattgttaattggaagccctaacatgtagtattgttcaatcctttatatgttgaatcgaaatcatcaactatgtagaagtatcaattatcaaatcacggattaaaaatagtcaacagaaaaactacgacaatgcttccttctgagcaaccgattccaactagaaaaatcggacgcccgcagcacatacagatttttgtccccccaccctctccttttagttgcacatgtcatcacatcaatagtcaacatgcatacaacacatccccccacctctctcgtcaatctcactcttcgtaatttaacttaatagcaaagctttaaatattttttttatctaaactatgtatctgatatatgatccgattataccgttgtattcattgcaattaaatcttcgtaataagatctcatgattatattttgataaaaaaatatttttaaggtttttttgttctaatgctttttctaaatattgcaataagtagtttactatgtttcactaggtcatttagaatgttgcgtgtagtgctatttgattgtttcagcagttattttgtgatgatttaaatgatgtttcattaggtcatttggagtgttgcatgcagtgctctttgaatatttcagtaggtatatgtgtgatgttacaacaaatattttgttatgtttcagttgttattgtgtgatgtttcaacagttataactgttaaatttatttgcaataaaaatataatcatgtgatatttgtttaaagatttaatcacgacgaatttaacggtgcaatcaattcgcaaattggataactaatttgtgataaaaaatgatttacatattgaccgtcagtcatcagatgaaaacaaatgaatggttaatattcattatagggcactgtaaaattcccaatttacaagtaccatccaactttatggcacgtgagcaagtgtccataatgttcaggcttgtatgttcatattttgcatggagcgaataaaaattactgacaatttttttctggtctcatcattttgttactaggctacccttgataagtcgaccaaatatttatactgaatttaaaatatgcaaaattatatttctttacctttgaagcttttcccacatgagacagctttccagtgaactgcttccaaaacgaagtttggggcacctgacaacttttaaatttgaaatagacaacaaaggatcatctactgataataactcttttcaatcactgatttccagtttctgtaacattggca

SEQ ID NO: 38133 - DNA, 9894 bp, Oryza sativa
catgttttccttcagtagtcaaagggttacttctttgtccaaagctttctacagcatacattttatgtatgaggagatatttaagaaaaggcaggtcaccaagatgtgggatctcattacagtcttggcagtcatcgatagtaatcgagacaagcatggaaagtgaagaatcctgaatccagttggggaataaattcccagaataatttcgaatggagagctcctgcaggttagtgtttggctgaagattatgaaggacctgattagcaatttctttgtcactgtcatcttccatgtcctgactgctccaacaccattccagtgtcaaagctcctaggaattgcttacctactagatttgcttctttggcatcatcacttgcagtaatattctgaagacctgttatatgaacatgtccccttagtccactgagattcttcaggtccccaattgaacaatgtgataaatcatcccccgtattaaatactgttaatgtttgcagatcagttagttgcccgatcccatgaggcatgctaacatgaacatttcctggttccttttggacatcaaggtgccgcagctttgtcaaattcattgtgctttccggtaactcaatgagacagcaacaatacttgagttctaatgtctgaagggtttgtaactgacctatttcagctgggagactttggatctttgtattgttcagagccaagaattgcaagtgtttcatcttcataatagaactggggagctctcgtattgttgtacagctcaaattcaacgctcttaaaaatctacatttcatgagaagatcattcagacccagtattttcaaaagtggcacaaatgaacctgggtactctgatgcagatctcttgacaaccatcagggactgcagatgtctttgtactttagtcagcacaactgacttggaatctggaagaacaactgaaaggtggcaaatattttctggaaggctgcaaaatgcttcccctgaactgaagcattcatcctttgagacggagcacgccaaatcatgaaataactcatgcataacaaacttatccttatgatcatcatcgcgagagggaccgttttgaaaaaatgatctgcagaacaactcattaaaatactgcagaccagtgtcttctggttgactgtcttcttcagggttgataaaaccttgagaaatccataactggacgaggtgatgcttgacaaaaacatagtttcttggaaataaggaacaaaatttgatgcactgtttcagacgtgatggcaaaagatcataacaaagtcttagtgctggtaagataccaccaccaacaccaagggaattgatttcaaacaaaagggaactgatttcaaacaaaccagtttctgaatgacataataacctagagctaattccctaattgataaatgcaattaataattggaattggcattgtgggatttttcttgggttccacatgtcacaattgattaataggatttttagtggaattttcagagccctataaataattttaacccatcaaaattcataaaccgcaatatttaaatcctagggaaattcctttttccttttctttttctttcccttctttttctttgttgggccgtcggcccaacctccctcccgcgcgccctctttgttgggccggcccgctcctcccttccccttcccgaagtcctccctccctccctctctccttcgggcgccgacaggtggggcccacctgtcggtcgtctcccacctccagccgttggagctggggctccaaccgccgccgccgaaaccgccgctcccacgtcgccgtccgcgtcgaccgcgcccactccacgtacacgcgccgcgcccacgtcgtcgcccgccgctcctccgcctttcccgctcgcgcgcgcgcccgcaaatcggcgggattcgatttgaatctcgtcccctctctctctctccactctcccacgtctccggccaaataggggccatcaccggccgtttccgcccctcccgtgtcctataaatcactcccccgagtcccctctccctttttccgcgctcgccgctctctcccgtgcctcatatcgtcgtcgcgctgctctcccgagctccgccgctcgccgccgtatttcagccgcgcaccgccgccgctagagccgttgctgcgcctagccgccgccgccgctagcttcgtcgtcacgtgggtcatctcgaccaccgcctcgcgttgccggaatcccaccggaaccctatctccctcgcgagcaggtgagatatccatccccctccgtctccggtcaacaatggtggccgccgtggtcacttaccccacccctaacccatctctgctccctcctagggtgccaccgccgcccgtccgcgcctccgcatcgccggttgtcgccgccgccttcttccttcgcgccggccgccgttctcgccagtgaggaatcccgctctcctccttcctttcctctttctctcccatgagcaccgctgtgatccgcgcgtgcgtcgtcgtcttcggccgtgcgccgccgcttttgcgccggttgccgccgcctcccgcggcgccgcttgccgtcgccggcggccgctcgccgccgccgctccccaaggccggccggtcggttttgtgccgagccgagccatgccaagccaccgcccgcgccgtccgatcggcctcccggccgatctggacagtcggtcccgtggaccggcggtggaccacccgcgtggtcccggtccatggtggaccagccgcctcgtgccgctgacaggcggggcccgcttgccggcgccgcgccccctcccttgatgacgtcagccctggggttttattgcgcaataattaattaaggccttttctttagtagtaaaaacacagattatcttctaaaattcatatctaattcatcggagctccgtgtaagtccattcaagtctcagtaaattcataaaaatccctagaatccattaaaaatggttttgtttcctgtttcagtagtcttatagcatgttttgcttgtgtgctttgtttgtcacatagatctcggccgtttcgtcgatccgcggtttctcgaagacgttgctgaggtctcatcagtgcgagagcaaggcaagttatgcattacaattgatcatattgtacccaatttacaaatatcccgcatttctattaaatgttgcattcttttacaatgtcatgtgggatgggtcctatcactcagccatttattgtttgccttatgccattgataacttgggtatcaaaatgattagatgttggttttggaaatgcttagccatgcttagttcaactagtacacaaatggggatcacattattacatagactttgactattagcatagctttggactagtgccaccgcaatggtgttagttaattaaaatacactgaatggtgggctatgggtgcatggttttgctggtcgcacccatggcaattaaggaccggttcacgggaaaccctgggagacttaccgtgcttaccacaagtgggagtgggtaactgcttgatctgaagtatagctcgaccctttcctaggcaccggtggcgagggtgggcatgatggagttgggtcggccggggtgtccggttgtccagttgccggattcaccacggcacaagaggggaccgcccactgcctttttaggggtgggggtgaaaccttagcatggtgtggatggttaggggagggttatgcggagggtcttgtcacgatttccccctttgcagtattatggtgatacttcggggcatgtcgacatgtgtggaatcgtatcttgtgggtacagttgtacacctctggccagagtaaaactattcgaatagccgtgcccgcggttatgggcgatcacccagattcaccgtgattagtcttacccctagtttagcttaatgaactggtgtagttcaggtggttggttgggcctgttgcaacgtggtgtagcgttggacagtgattggttaatattgattaattactacaactgttttactgctttcaacttctgcttttaaatgctagctttgtgcaaatgaacccctagcctcctttggttatatcctacatcatacctcctcttccggtaagtcttgctgagtacagtgggtagtactcagccttgctctcttttcccccacaccagagttgaagttctttccagttggagctgtatcgaagaagttgatctcatcgctgccgtcaagggatgcctgtggagtggagtcgccccgctgcagaagtcaagcgtccaagtctagctcgttttatctttccgctgcatttgtaatcttttctatttttgtaagacgtggatctatatgtcaacaactgtcgtttgtgtaccctggctggtcctggacagggatttgatgcacattcagcttagaaattctggttcgtgaatttctgggcgtgacaagttggtatcagagccgaccttgaccgtagaacaagccaactggaaacctaagagccctctgaaccccttttcatctgcatatgctctttgtacttggatttgtttcgggaaaatttggggttttgcctctttggtttgcgggaaaaatcttggtcgttcattcggatcggatctttaaaattagctcagtctagggttttagaaaaaaatatttggagtttattcgacaatcagtcgggaatctattgggtgatatgcattaggtcgtgtctatgtttgatggggcatttttatgcgcatcattttccatgcatctgttttatgcattaagttattgtttagtcagttgcattagtgtcgttatctgggttcatgaaaaatgttctatgcataaaaatcagtcatgctcggttatttatttgagtcatttgttgctttgtttaatttggatttgagcatgaattggttcctatcccttgtccatctttagatgtcagacctgttcctcgatcgcaagcgccgctccaagcttcagagtcgccgcccttagctttatcgtcttcttagtgtgtttgcttgctagtttccgtgtttaggtttgttgcttgtgggttagtcggcggtcgatatcatgtgtcagtggtatgtctgccttaattaggagttgtttgcctctttttcagtgttttaatcaagattaagataattgcacgtaaatttataagaaagattagtttctaagccccctgttttcttccttttctcatatttctacctatccccctccagatggtgaagacaaggaatggttcccgtgaatccaacaacgccagtggcagcgaagagcatatcagtggagcatgtgccagcgatgcatctgacaacagtccatctccaccgcccgagaacccaacgatcgcttaggtgttggacaatcagactcagatgatgacgatgatgatgtaacagatgcaacaacagtaccatcaggtgttgcagcaggtgcagcagcaagcacaacagcagcagcagcagaacctgcagttttgtcttccaccactccagtctaagatgttagagtttctccgtgtcaagacaccgactttctcaagcaccaccaacccaatcgaggccaacgactagcttcatgctattgagaagaagctgaaccttttgcaatgcaacgaccaagagaatgttgcttttgctacacaccagctggaaggtcccgcttctgtttggcgggacaactatatggtgacccgtccagctgggacagaggttacctggtcagagttttgtcagagtttcaataaagcacaagttcctgagggaatcgtggcacaaaagaagagagagttccgttctccgcaacaaggaaccagagcagttatagagtatttgcatgagttcaaccgtctcgcgcgttatgcccctgaggacgtgcgcactgatgccgagaggcaggagaagtttttgtctggtcttgatgacgaattgaccaaccagttgatctgcagagattatgaggactttgagaagctggtggacaaagctatccgtcaggaagagcagtgcaacaaaatgaaccgtaagaggaaggcagctcagctcagaacttcccaggggatcagtcagaagccttgcttcacgatgggacatcagggtggaccttccacaatgattatccggcagcaccgtccctaccacccgggtagcttcaacaagaactacaacagtgagcagcacagcctcaaccctactccaagtcttctaatgattccagctcagtcatttcagccagctctgcctgctcagccagaacagcccaagaagtttggagaaaagcccgaactctgcttcaattgtaacgagtcaggatacatggtacgtacgtgcccgaagccaagacgtgccggactcaagttcgtttaggcctgtgtcaatcatgcatctgcagaggaggcgcagtcagcaccagagattatattgggtacattccccgtcaactcgacaccggcagtaatattgtttgattctggtgcaactcattccttcatttccaagcgttttgctggtgcacatgggttatctttagtgaagcttaagatacctatgcgagttcatactcctggaggtggcatgaccacaactcactattgcccatctgtgacagttgaaatccaagggttgatttttccagccaacctcattcttctcgagtccaaggaccttgatgttattcttggaatggattggttgacaaggcacagaggagtgattcattgcgttagccgcaccatcaagttgaccaatgcgaaaggagaagtggtaaccttccagtctccagtaccgcagaagccaggaatcagtctgaaccaggccactggtgaggtagcagtggagaaaacctctaagaagttggaggatattcccatagttagagagtatccagaggtttttccggatgatctgacaacaatgccaccaaaaagggatatcgagttctggattgacttggcacttggaactgcaccgatccacaagaggccttacagaatgggagccaacgagttggcggaagtcaagaagcaagttgatgagcagttacagaagggatacatccgcccgagcacgtcgccttggggtgctccggtaatctttgtggaaaagaaagacaaaactaagaggatgtgtgttgactaccgcgcactcaatgaggtcactattaagaacaagtatccgttgccaagaattgatgatctgtttgatcagttgaaaggagctactatgttctctaagatagacctacgatcaggctatcaccagttgagaatccgagaggaggacattccaaagacagcattcatcattcattatgggttgttcgaatgcacggttatgtctttcggactcactaacgcacctgccttcttcatgaatttgatgaacaaggtgtttatggaatttctggacaagtttgttatggttttcatcgatgacatactgatctactccaagtccaaggaagaacatgagcagcatcttcggctggtacttgaaaagttaaaggagcaccagctatatgccaagttcagcaagtgtgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgtcggttcattgagaacttctctaaaattgccaagccaatgacccagctattgaagaaggaagaaaagtttatctggtctgctgaatgtaataggagttttgaagaactcaaacgacggttggtgtctgcacccgttttaattttgccagatcagacgaaagacttccaggtctattgtgatgcatctcgccaagggttagggtgtgtggtgatgcaagatggcaaagtggttgcttatgcttcacgtcagttgcgtcctcatgaaggcaactacccgacccacgatctgaaattggccgcagttgttcatgctttaaagatctggcggcactatctcatcggtaaccgttgtgaggtatatacagatcacaaaagtctaaagtacatcttcacccaagctgatctgaatctccgacagcgaagatggttggagctaattaaagattatgatatgggaatacactattatcccggcaaggctaatgtggtagcagatgccttgagcaggaagagctactgcaacgtcgcatgggtagaggaactatgctgtgaggttcaacgtgatttggaacatctgaaccttggtatagttgagcacggatttgtggctgccctagtggcacagcccacactggtggagtaggttcgcatagctcaggcaagcgatcctgagatagcagaactcaaaaagaacatgagggttggaaaagcccgaggttttgttgaggatgaacaaggaacaatctgaatgggagaaagattgtgtgtacctgaaaacaaggagttaaaagacctgatagtgacagaagctcatcaaacccaatattcaatccatccctgcagtaccaaaatgtaccaagacctcaaagaaaaattctggtgggtcagcatgagaagggaaatagctgaattcgtcgcactctgtgatgtctgtcagcgagtaaaggcagaacaccaaaggccagcaggtttgctatagccccttcagattccataatggaagtgggaagaaattggaatggactttatcaccggtttgcctaggacgtcatcggggcacgattctatttgggtagtcgttgatcgagtcaccaaagtggctcacttcattccggtgcatactacctactcagggaagaagttagcagagctttatctggcaagaatcatgtgcttacatggtgtatctaagaagatcgtgtctgatcgaggaagccaattcacttcaaagttctggcagaaattgcaataagaattgggaacctgtctgaacttctgcacagcctaccatccgcaaactgatggccagactgagcgagttaatcaaatattggaggatatgttgagagcctgtgcgcttgactttggtggagcatgggacaaaagcttgccgtatgctgagttctcctacaacaacagttaccaggctagtctgcaaatggcactgtttgaagcattgtatggacggaggtgtcgtactctgctcttctgggatcagaccggggaacaccagttgtttggtacagaagttttaaatgaggcagaagagaaagtcagagctgtcagggaaagattgagaatcgcacaatctcgacagaatagctatgcagacaaccgccgaagggagctcgctttcgaagcaggggattatgtgtatctccgtgtcactccgctcaggggagtacaccactttcaaaccaaaggaaagttggcaccacgctttgtgggaccatatcggattttggaacgcaggggtgaagtttcttaccagcttgagccttccctccaacatgcttggcattcataatgtgtttcacgtctctcagttgaagaaatgtttgagagttcctgaggaacagacaagtccggatcacatcgaaattcaggaagatctgacctatgtggagaagccagtccgcatccttgagaccagcgagagaaggaccagaaacaaggtaatcagattctacaaagttcaatggagccaccactcagaagaagaggccacttgggaaagagaagatgagttgaaggccgcctatccgcacctcttcgccagctcttccgaatctcggggtcgagattccgtttaaggggggtaggttcgtcacgccctgaagtttccccctttttcttactttaaaaatttgttaaataaatcgtccggagaaattgttcta

SEQ ID NO: 38134 - DNA, 1024 bp, Oryza sativa
tctcccatgcctactattgtcgccgcgccgctctcccgagctccgccgctcgccgccgcatttcagccacgcaccaccgccgctagagccgccgccgccgctagcttcgtcgtcacgtgggtcatctcggccaccgcctcacgttgccggaaccccaccggaaccctatctccctcatgagccggtgagatatccatcctcctccgtctccggtcaacaatagtggccgctgtggtcacttaccccacccctaacccatctctgctccctcctagggtgccgccgccgcccgtccgcacctccgcatcgccggtcgtcaccgccgccttcttccttcgcgccgtccgccgtgctcgccggtgaggaatccccctctcctccttcctttcctctctctctcccatgagcgccgccgccctccgcgcgtgcgtcgtcgtcttcggccgtgcgccgccgctttcgcgccggtcgccgccgcctcccgcgccgccgcttgccgtcgctggcgaccgctcgctgccgccgctccccatggccggctggccggttttgtgccgagcagagccgtgccaagccgccgcccgcgccgtccgatcggcctcccggccgatctggacagtcggtctagtggaccggcggtggaccacccgcgtggtcccggtccacggtggaccagccgcctcgtgccgctgacaggcgaggcccgcttgccggcgccgcgccccctcccttgatgacgtcagccctggggatttattgcgcaataattaattaaggccttttctttattagtaaaaacacagattatcttctaaaattcatatctaattcatcggaactccgtgtaagtccattcaagtctcagtaaattcataaaaatccctaaaatccattaaaaatggttttgtttcctgtttcagtagtcttatagcatgttttgcttgtgtgctttgtttgtcgcatagatctcggccgtttcgtcgatccgcggtttctcgaagacgttgctgaggtctcatcaatg

SEQ ID NO: 38135 - DNA, 17884 bp, Oryza sativa
  unsure (1)..(17884): unsure at all n locations
catgatggagttgggtcggtcggggtgtccggttgtccagctgccggattcaccacggtgcaagaggggaccgcccactgcctttttaggggtgggggtgaaaccttagcgtggtgtggatggttaagggagggttatgcggagggtcttgtcacgatttccccctttgcagtatcatggtgatacttcggggcatggcgacatgtgtggaatcgtgtcttgtgggtacagttgtacacctctggccagagtaaaactatttgaatagccgtgcccgcggttatgggcgatcaaccagattcaccgtgattagtctcaccctctagtttagcttaatgaactggtgtagttcaggtggttggttgagcctgttgcaacgtggtgtagcgttggacagtaattggttaatattgattaattactacaacagttttactgctttcaacttctgcttttaaatgctagctttgtgcaaatgaacccctagccttctttggttatatcctgcatcatacctcctcttccggtaagacttgctgagtacagtgggtagtactcagccatgctctcttttcccccacaccagagttgaagttcttcccagttggagctatctcgaagaagttggtctcgtcgctgccgtcaagggatgcctgtggagtggagtcggccgctgcagaagtcaagtgtccaagtctagctcgttttatctttccgctgcatttgtaatcttttctatttttgtaagacgtggatctgtatgtcaacaattgtcgtttgtgtaccctggctggtcctggacagggatttaatgcacatttagcttagaaattctggttcgtgagtttctgggcgtgacaatgatcttgtgctatattagttcatatgcatgtgggtgcatttggtgggcttgtctagccaagtgtggtgagttttctcaagtcccaaacaaagagagaagtgggcacatcttataggtttgggtagcctcatgtggttttgtccggtggagtatcctttggagtgtgagcccttttctcccttataaaagttgtgtttcttggatggattgttcatgtgttggataaccctttgactaagcttcccatagagtccaagaacgtcaaattccaagacctgagtcaagagatatcgccgttttactaacggtcggttgagctgaaaagtgacctgcggtctgactgcagcccttatagcggcctgaccgaggtatgctgtccggtctgactgcagcccccatggcggtctgactgttcatcctgatttagaaggaggcctcgtcttggcgatccagagccgccagagccgcaaccggtcataccgagcccctagcagtctgaccgggccgtggatggtctgaccggccactacactgcggtcagaccggccaggttgagtgggctcaatgattgccctgtaatggctagttaactagccattacaaagtagttcggcctgaccggccacactatggcggtctgaccagcggagcacagagttggggatttcgactccaacggctagttttggtggttcggggtatatatacccactccccagcagcaagggcaaagttttggcactccattgcattatcttgaacccttgcaagagctctcaaacccttgggcacttagtttatctagttaggtgttagagagtgagttaagccaatccaagtgcattgcttcattgttagagctagcatggcacttgatcatcctcggcaagcatcctagacttattacttttggaggttgccacctcctagacggcttgtggaggtgttgcttggtgacctctccgaggagattgtggaggaggcccggcaccggtgtgagtggtttggagttcaccaccttcggaacgaaggaagaattaccctagtgattgaggcttgggtagtcctctccgtgggccaactcccaccttgcccaccccttgacgaagggggcgtgcggtggcttcgtggttgagcggtggagttgggctcgcctgaagcatctaggcccccgttgttaattttggtaattaatgacaagcgctaattgtggactaaccgttgctattgagatatatattaagttaggttcacattatgtatgcgcatggatgtctactgatggattaaaattgacggcgcaaagcaaaaggaagagaagacggtaaactagtgttttcattttaaattgatcggggcgttgggcgatcaaaattgtgctagtttatttatagctttgttgtactattaagaggagtaatgacctagcaaagagatgattttaattgccacattaggtcattgcattttcacttgtgctcactttttcacaacatacacaacaccttgcattcactgagttcggcctgaccagggggcggtcagaccgaccacatagtggcggtctgaccggcgtgccctggccggtctaaccggccccaagcggacggtctgaccagcgcacaaggtcggtctgaccggcggcttatgggcggtctgaccagccccttggaggccgggatggtgttgctcggggtggctgatatagagccgacggagtcgtattcggtcagaccgagctgatggcggtctgaccgagccatggccggtttgaccggccactcaacgttggtctgaccggccaggccgatggggccctctgacagggctacaacggctagttttctagccgttgcagagtagcacggtctgaccgacaacatacctccggtcagaccggcagagcatagagttgggggatttcgcccccaacggctagttttggttggtgggagtataaatactccccctccagcagcaagggggctctcttggcacccaattcaattgcatacacccattgcacctctctcacacacctttgagcttagtgttcatccattgtagtgttgagggttgattagccaagagtcaagtgcattgcttcattgtagagctagtgtggcacttgatcatctccacaccgggtcatcgcttgttactcttgtaggttgccgcctcctagacggcttgtggagaagttgcccagtgacctctccgagaagattatggaggaggcccggcgccggttgtgagtgggttggagttcagcaccttcggagtgaaggaagaaccaccccgagtgatcgaggcttgggtagtcctctccatgggccggctcctgccttgcccaccccttgacgaagagggcgtgcggtggcttcgtggttgagcggtggaattgagctcacctcaacggggagtaggaaaccggcgagtttctgaacctcggtgaaaaatctcttgtctccttgtatcatttgattgtcgcatttacatttgtgcaatttacatttctaaagacatacttgagatcatatcaccctaggattgctaaacattgacataggagtgtgatttacttttctagagatataattgagccactatcaccctaggtttgcaaaacataacttagttgcttcgttagagttgaccatcaccgagcctagcaacttaggttggttttgattaggtgtaatttagttttaaatcgcctattcacccccctagtcgatatctcgatcctacatcgcctcaacggggattaggaaaccggcgagtttctgaatctcggtgaaaaattccttttctcttgtctcatttatttgttgcatttacatttgtgcaatttacattcatagagatatatttgagcttatatcaccgtaggtctgtaaaacttaacttaattgcttagttaaccttatatctcacattgcctagcaatttaggttagttttgtttaagtgccatttagttttaaattgcctattcaccccctctagtcgacatctcgatcctacacatccaaagcaaacgttgtttctactttttcagattgaccaaagcgcaggagcagagttttacatccctcttgcaatgctatacacacacaaaaaagaaacacagttcgctatcgttaattctttttttttctttgattgatgtgcccatcctacatcctgatatcagaaagggataatggatgtaatttcatttcctcatgaaatgcttcccgttataaaaaaaaccatctgatcaactatatgacatttatttacgatataatatctcaaatgcttagttaaagatatggtatgcgtacatttatcttggaaggtgctaccataatactatttccgtttcacaatgtaagactttctagtattgtccacattcatatagatgctaataaataaataaataaataaataaataaataaattaattaatatatatatatatatatatatatatatatatatatataatgtctagattcattaagatctatatgaatgtgggcaatgctaaaagtcttatattgtgaaacgtttcacaatgagctcattcaaataatagtataaaattaacgattaaaattctaaaattttcgatcatttattcaagatggaattcggttacgctgaacgttaaatattcgtggtcgaaaagggcgcgtacaaatccgagatcggtcacgcggcccagtatccacactgttaggaaacctccggcccacgaaggcccggcccggttacccactaattgggcccatcactaatatggaaagagagcatggcattgccctataaatagagggttggaggagagggttggaggagaggtctcgtacacttgagaatgcaatggatgaatgagaaaggatgtcacacccttatatcttgtgtctctacttgtgtagaattacgagatcctcttggactacttcgtgtagcaggagagttgcgtaatacgttatcagcacgacgttctaccggagaccgagaaggaaggagggtaagatctaatcgcgaaaacgaagtcctctcccacttctcatccatttttgcttttcccggagaaatccgcaacgccgacttgaagtcgccggtgaaaaccgttttgggatttttcggaattgttggccaagccgtgctcatttttcactgcgccacaccggccacggacgtcgcatcgcgctgaaacggcaagccggcgatcgcacgcgaagcctgagccaccgacgcacgaaccgccgtgcaccgacggcaccctgcaaggcgttgtagtacggcatactacgccactgtgccagggaggcgttggcaggagaggaagaaaaacaagaaaaatgaagaagaacaagaaaatgaaaaacgaagaagaggccatcgatggagacgacgtgccgtgctgggtttttcgagccgccgccgtgcgccgaccgcagcacggccacgcagccaggcaggaaggggaatagaaggaaagagagaagaaaaggaaagagaaggaggaaaaggaaagaagaaggaaaaatggaaagaattggtgattttgcacaaatgtccccgtgttttctgaaaatcatgcacatactcctctgcattggaaggtttgcattttaaacactgtattttccagaaaatacacaattaaccctcagcattgggctatttgtttgaatggccttcataatttgcaaatatctccaaaaatcatattttcgcacaaaagggaccacaggactctggacttcgaccctcaactttgcattccaggtacctttattactgacttatgtgattatgaaatttatttatcgcatttacgattattgattatttatgatgtttttattacttataattaatatcgttgcggtaaaattgtatagaatagcatagaatatattggaactatttgcgggaattttgtgtaccattatattgcaacacttgtgcattttaccagcgtttaatttgcgcatattgaataatggaagatgactggcatcgcgaattaaaaattcgctaaatctagaatatctctgacatatgcactcaatgtcgaaattatagtggaccttgcagctccattacataattaaacctagcgctttatttactgattcgacgagattgatcaagcacttcaatctctcgttggtgcctccaagctactctaggaatgagtatgctaaatggataagcgtgttggtactcttttgactgcacggaagaagcaacttacaagattatggcgcaaaccctatctctcgtagagcaaggactatgaacaagagtgggtatatttcgactatggttcactgagtagatgacccagagagtacggtaatacggtgcaccgaatttgcaccgaatactgcggaaactcttgatgttctacccgaacgcgacaaaagtcacacgcatgcatcactggtgcccatacgagaagtatgcctaactagttgataatagaattgcgtatcattcggcatagtgttcgtcagaagaacattgtcttcccaaatcacctagcacagttgataataaatttaacacgagcatctagcccggtgcacttacctcaatgaaagaagaggacaagggggagtagaacacatgtcaaggtgaacaatctaggaacatgaaaaggacaatcctaatagcacactcatcatgaattgagggggagaactcctagcctatttgcatggctatgaccgtagaatctcctatgctagataggatcggccgtaagatttatgccagaatagtaaagcattgccataggtgttgagcaagaaattcgctatgaagtaaattgaatccgatgtaccggaatacttcgttgaatcaatatacttcgtcatcacgtgttgcaattttttgaattgaacattgcatcaaagaaatggtccttgcccaagtagagcacacattttctctgcaataaagaattatttttagtataaaatagcatatttaaggcatttactattttatcactcctttctggcacatagttataatgctttcaattttgtgtagcgtccaaacataaaagaaaaatgaattgtggtccgcataaccacaaataacactttaagagaaagaggtatttccagacccatagaactggaaatattatgaccgttgctaacagcaacaactgaatttgtcgacctagaaagtgccatggtcatattacctatggaacaaatgatgcactttatagaagcatctattgttcgtcaaccccgttgaactttctaaaagtgtgatgatttgggctacaccttttagcaacggattttcaaccattccggtcttagaattataagaataaatattacaactcatatggtcatagcacatatatgcataattttcctaaatcatgaagatttgtgtgctagtatgcaccgataggagattaatgcataaacagcgtatagttctagcatccctgaactggattgcgaagaatatatgtggctcccatttggtactgtatggataaatgcgcttccgaagcagcaaacatccagtgtctcttagacaccgtgtctttgccaagactgattcaacaagatcacgtgaactccaatagaactcactaaatcatcttcagaagtccgcgaggacaatgctagcattgcatttgatgattggtgaattggtagcacgaagtaccaaatatccgcataagccgactaagtataagctatgaattgcaatatttactatatcattgttgtaatagccgcagtagaaaaggacatgtagtcttgaaagcagcggactctgaaagaaaactcagatcatcggcatgaacatccatcctgcgactagtgctattgcatctgtttggtttatgtgcatatctcactatcataatgcattgcaaaatgctctctccgaaagtcggaaaccttttacggagatagttatgaagcctaaattccttgacaaataagaattatttccagtcatttagggggagagaatgaacccctagataggaaatgtcaggaaatatgatagtagaaagggactaatgcatgttacaccgcactagtgaatgcagtttgcacaaagaattaaaactgccaaatcactttgtaaatacttttgtgactttgaagagtttgactaagttgcatgaatgcaccggaggagggtgaaataccgaagaaagtaaaggtatccctcatcttgtccagaggcctcgaacaaaaacaattggacaagaaacttcggctcctcacacccctaaagtaaccggagatgtctagtgaaaacagggcaagagggactatcatactcaaagtcacggaaagtaccccaccgaatagaggggagctagctgttggagtgcacactaacgctggtacatgcccatatcaagaagcattaagcaagaagaagaagaagaagaagaagaagaagaagaagaagaagaagcatatgaaaaatgcatctccttgtatatccatggatactcgcataaagaaattggcaatgagacctatcatcggcaatgtctcttttagacaacaaaactcattggcagtcaaccaggagttgaatggaattaatgaactagaagttgaaaagaactcaacctgaatattgataagcattgaagatagaatcaatggatgcatttcaggagcttggatcggacacttgcataatagtacatgaagaagtactaggttccgaaccaacatcaaaagaatagaataaatcataaaagaattgaagaaaagaaacttaatcgttttgaatttgagtttgatttgaaatatttggccgaatccaaatcatgcttacgcttgcaggtaaaggcatgcgacagatggaagtctagtacatcagtccaactgcacttagaaatgttcatggtgcatggcttttgaatagtcaattatcgtcaaaatgggatggaattcccaaacacaagtgtgtcatagcagcacatgaatatttggctaattgaactaaaccgaactaagcatcgttgaactgttcaaagcctcgatatggttttgagagatggttacccgcaacagcaatcgcgatttgaaaactatctcaacccccaccatttatgaaattaaagcagcatatatcacacatatgcaaatgagttatgtgagtagcaaactcactaagcatatgaacccccaagctcttctatgtacatgaattgcatagaagcgatgaactaagtcatgtgaaagtcttgcagattcatccgctaactcattattgacatcttcattgaataggtgtgtccgagaaatcggaataatgagacttagagaaatgcaaaatttagggggagaatttcgccgactcatttcagaatcttgatatagaaaatcaagtacccaaaatcaatctagaaagattgaacaaagaattgggtggattgtactctttttcccttgaataagttttcccagcagtttcttattaaggtttttaacgaggcaattcgtgcgacattgcaagtgtatgctatgtactctttctccaaatttttcccactgggtttttgtggagttttgatgaggcataggcatcacgcagcgagagcccaagggggagtgttaggaaaccgccggcccatgaaggcccggcccggttacccactaattgggcccatcactaatatggaaagtgggcaaggcattgctctataaatagagggttggaggagaggttttgtacacttgagaatgcaatggataaatgagaaaggatgccacaccctcatatcttgtgtctccacttgcgtagaattacgggaccctcttggactacttcatgtagcaggagggttgcgtaatacgttatcagcacgagagaaatactagtatgacttacattgtgaaacggaggaagtagattttataagctcattcaaatagtagtataaaattaacgattaaaattctaaaattttcgatcatttattcaagatggaattcggttacgctgaacgttaaatattcgtggtcggaaagggcgcgtacagttcctagatcggtcgcacggcccagtatccgcactacaaaggacaccagtgatccgaagtgtagcccacgaccacgatccaatgactactttagtgctctctacgctgccgccccaactctcagtgcatcccaccggcgaccacgtggaagtgaggaagagagatgcggcgagccaaggcgaaacaagaggatcttccatctgggtgacgatgcttccgacggcggcgacgaggaggacagctcgaacctgtgcttctacttccccgtgcaccactactccgacagcatcccccttcaccctatactgtacaaggtggatccccccatccctcgacaacgacgacgaccacgccgccgctactctttccaccgggtcgctgggctccttgatcgttggagttggatactgttccgatggttccggaggcgacgagaccatactgttcaacaccctagaccgagggagaaaattgcaattataggactccaaacaatgcgcttcgcagttataggaccccaatcgtcgacttcgctaaaacgacccttgaaacgttggcactttattttacatgacatttggtccttttaatcacttttctcaactaagatacatgtattttgccctaaagtgaccgtattgcccttctgccttctgtatacttgatcgatggtatcttttcatctcatccgactccgccgttgttcctccttccctccccacgccgccgttcctcctttcctcaccacgccgccgttcccttcccatcctcggctcccatggatagagtgtcgccgcccgaagatggagatggacgcccgatcgccatggaaggccaagcagtcgaagacctggcggcctctgccctagccgctcggggtctggtcacggcgcctggtggcctgggcgcgccggctgatgccttggctgtggcagccaatggccatgtatagtagaacgccaacgctagtgctgtagccgctgctagaacattgctgcccaatgctcctcttccagcaatggagttcaaccttcctgttcttcaagtgcaaatgtattggttgcactagatttctgttttttttaccacgatagtagtaggcagtagtaaaacttgatttcacttgtttaggtcccaagtagatcatgtggaaaatatggaaagagttgattggataacatacacatggtcgagacacatgatgatgaaggtcgtattgcacttatgagtcacagatttgtgagcttttaggtgtgatagaggaggacacaacaaatatacctgcacagggctttgattgtcgaatgtatgaacatgggcatgatagtgagcttgggcaaaataatgatggtgctgccattcctactagtgatgaggtaccgggtgagatgctcatttcatatgataagaacaacccatccatggctttaggaacaatgtacccaacaatggaggagttcaagttggcagtgcggcaatttgccattaaggaggagtttgatttaggagtagagaagtcatgtaagatgagatatagggcttattgcaagtccggtgatgaagattgcccttgcacttggaggataaatggcaccaaacaaaaaggccaaagcactgtggaggtaaataaatttattttttctttcattaattctactttttatgtaaattaacatgaatctctttgattttttgttttgcatgtaactgtcgtagtcgatgagcatacatgtgtgtctagcatgaggcagatagctacaactccaactctgaagtgggtagctagcaaggctgtgagtatccttagagatgatccaaatattggtgctaagagattgcaaaacaggttgcagacagatcacaagtgtgaaatttcatatgacactgtatggcggggtaaagaaagagctcttgaagaggtttatggcaaatgggaagagagtgttgagttgttgtttaggtggaaggccgaggtaatgaagcggtgccccgagagtgtcgtttaggtggatggtcaagtatatttccaccgttttttctgtgctcttaaaccatgcattgatggtttcttagaaggttgtaggcctcatttgagcatagatgctacaacacttaatggagggtggaatggtcacttggccgcagctgtagcagttgatggtcacaattggatgtatccactcgcttatggcttcatagcttctgaaacaacagacaactggcttccataagaaatattgcatacaggctacctgaaggcaggatacttccagctataatgcatcagctaaaggcaaatactagaggcttggggcatttgaaaattgtaccatgttctaattggagtgcagaggtgtgggacaagagcagcaacgttgagaggcatattgtcaagttacaccaaaggacctgtacatgtcttgaatggcagcacactggtaagccatgtcaacatgtattggcctatgtaacccgccaacggggagttaaccttgaacagtttgtgcataactactactcggtgaatagattcagggctgcttatggaagagagattgagccgatgacagtcaaaactcaatggccacaagttgacctaccatttttagttggtgcgcctcttgctaaattacctgttggaagacgaaggaaactaagaaggaagggatggatggaaggtggccacaagaaaaatggttccaaagatggtccatttaccaatgagagtgaaggtgagaagggaggtgacaatgatactgctccaacaaatggaaagggaaagaagatgatcagaggacctatgacttgccaaaaatgcggagaaaaaggccacaggcaagctagtgccaagtgcccactcaataggacagcaaaaaagaggtaaggactgattttatttatcaaaaaacttaaatgaaaatgccaatattaatttatttgattacttgtaggaagcgtaggcaacctaggaagaatgttacaaaagctgtggcagcagaacctaacactccacggaagccgactagagaagaaatcctacgggatagtcagaaatattaacatatttactgtatattaattttttccaaacatctaattgtcatatcctatttatgtgtagcaagcttgcgatgttactaggagaaggtatatcgtcacaaaccaacaccactagtcccgtgaggatacctaccgcggcggcaccaaaaaagatgactccaaagagaaagctatacattggttgaataattttagttgtgatgagatgtaaactcatactttatttcatatgacttagatttcgtttggaactaaattatggtcttctgagatgaacttgtttatgctagaatctcggttttatgagacaagcttgtttgtgcaaaattcatggttttatctattacttgtaattgagatctcgttgtaattgcgtatggatcatctttgatcatctttcatttattcattgggttagtgttgcaatttttgtgcatgattgaccatgtacagtacaattttggggcatatgcagctggcagctgcagcaagtcaagagcggctagcagcttacagccatcccagcgagccaggctctagccatggacaggcggcggccggccagccatcccagtcccaggctgcggctagccagccagatgaccggctagcagcgtgggagcacgccaattgaaggctgaggaacatacggtcacatcaagctgaaatacatgtattttagtagggaaaagtgattaaaagggccaaatgtcatggcccnaaagcgctcatattttaagggtcgttttagcgaagtcgtcaatggggtcctgtaactacgaagcttattgtttggagtcctataattgcaattttctcagaccgaggagctcatccgcgggctgacacactatgtcccattccgtccctgatttgaataggcaacatttaggctgtgtttagttcagcgcaaagtttagattttggttaaaattggagatgatgtgactgaaaagttgtgtgtgtatgacaggttaatgtgatggaaaagaactgaagtttggatccaaactttatatctaaacacagccttagtactctacaaacttgggaatcatccctttttctctgcgaagagagcagagcacagacatgtatttgaaagtaatctatgaaatttgggaaatgatcgatcacagacgcacaagcacaacacaagtatcatgccgccaaaacttggctgcatcacccaggatttagcagccacaaacttttgcaatacagatcacgagccacacagacatcacacaagaccacaacctggccacatcctgaaacagaactgagcaagatcagataaacaacaccagcagcggttcaagtcacctataaagatcaacagcagttcaagtaatggagaggtcaataattagcggtggcgccatggaacttccttgtttcagcgatgacgtcggtcatcaataatttgggcgacccgctgttgtatgatgtcgtgtttttttttttttggaacgggatgtgcaaaatgcagagggatgtaacacaggtcaccgggccggacaaattgtgtgggtcagacctaattataacatgcatgcacgtagatgaactgcacctctaaggctcttaacaccttccaatagtatctcgtctgaccttatagctagggatcggtgtaggccacctgtatagccaaagaaatgggttgaatgtaaaggagaacaaaattttatcaacaacaaacaaaatactcctacgtctacaggagtaaagaaaaaggaagtcacctgttatagttaaactcttctatcaaaccagcagatatagttttctctatagtgcttccatcattttctcgctttataacaatctagtagaaatttccataattgtgaaaacaagtttactgattattaacaagcacaacatatgacagataattctaacatgtagaacaatatgacatcatgagctacctcaactgttatccttttcgctgaaaaatcaccattggtttcttggtcatactcttccatagtttccttgcatttatccatcaacattgcaccgaactggtgccattacaaatatggttataaacaaaagcatgattctaatcaaaagttcacaacatatataaacaaaaaaagcagtagctgactctggaaattattaaaacaaattgtcacctcaggggcagtagagaggaatttcccaccacatttcatgagaatatcaccctgacatattccagcaatatcagcgggtgatccctcagccacctaattgtcatttttttattcagttcatctcgtatatacattgagcagagaaacattaagatggcaactatagctaaaagaataacactgctataaacattctgaagaccataaaatttagataatgttaaaagtaataattaggagaaaaagttgacgaattagcagcatgtattaaaaaatgcacttgaatataagctagaatggatatgtaaagttgtatacagttactacattgaaaaaaatagcagacacaacatgttaagaagcttgttaaaaatctaagtttttggtacccaaagtataaacaaatgttatagagttctcatccaaatgttaatgagcctctaaacataatttacaaggaatgacaatatataaattttaaatacctattctggaagtccacaaatctagggcaaagtatcgcaaaaataaacataggatagaggaggttcacacatttgaaatatataggccattatcaacatccgagaattttctgtatatgtgctctagatgactaagcggaaccatttgaatagaggtgaaccagaatccaatccaaggtcgaattattcttctgtaaaaagtaaagaagaatattactataatgcagcagtaaacataaactaggcaattgtataataatgtatagaaattaacaatcaagtttttgaccttcacaggtaataaagtaaaaataatatcaggataaaatattcatcaccaatcaccataaggactggacctacccaaatatctggtgatgttccaagcatttgaaaacaattgccatcgaaagaaatggcgtttggttctcttcaaagaagttaatacctacaacatggccattataatttacaaggggtcccccggtgccagcctagaaaaaaggaatcacaataaattgtcaagatatgtacacgaatagcaagaggtaaaaaagggaaaagtccatgtaaaatgcatcaaagaacatgcaaaaacacgcagagtagaggaggtcaacaaaagaaacattttaaacaaaaatatggattgcacctccacgaaatattaagtgttcacacaatttgctcagttaataaagttgtgttaccctggccctaattatcaactaatctcagtagctgagtttgcttcagtagatcaattcagtattaattcttagtgtccaaagaaaaacaaaacaagctttgacaaagcaacaacaaaattatcctgtctgaatggagaataggtattcaatttgaacaagaggaaaagaacagtacagaaactagatcacactgttggatgatgctcacatggaaaaacactggtgcatccggcaagagtgagattctctagcaagttaactagagaatagtgaattctagctacctttgaaaaaagaaaaacattgcatacagaaacctttgacaaaatgatattcatctatggaacaatctagctataggatgtttggttttttaaaaaaaagatgtcaaaggatccactcaatcctactctctacttaacgagttgtttggtcttggaaatgccatgggtcaatcaccaaacatgcctcaaaaccagatgtgaaaaacaatgaattggtgggttgtcccaccaaaatcatgggatcatcctatgatcaagcaatctcatccaccagcacagaaatgatttgattcctcaaaacaaacatcacactagtaactgctggtaaaatgatcttaagagacacaggtcaatcatgcttagaaactattcacacagattgatgtgatggacgatgcttcaagttccaagtgtttcaactacttaaaagaagacgataattaaacattcacatagaccaacctgctctatgatggacacatcagcaaaaatgaaacctgaattgttcagtactgaaagacacagagaagcatataacatcatctcagtattgacagaatctataaattgagaacaaaaactatttcacagaataaaaccacagaaacagctgacaatttctgtttggctcttctatatgtgattaaattagttcaggtagtttttggatgccctatgcatattctgatgttcattcaagtttgcatacatgagttgtgtgaagattgtgtgtgctttagtagtaaaatctgaacagagaaggaattaaaagagtctcagttaatttgaatcagtagtttgcataaccaactaatgaattaagcaaggaaaaaaaggcatgtatcatatcggcaacaaagagcaaattgtgttcagatattatttaccattgttatctcgcaacttgatactaacagttctgaacactcaaatatgctggctctgttgcttatttctccccttgagcacatcagaagaccaccttcataagaacggccaagggctaaaacatctcccttgtcgataatatatttaaggataacagcctcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38136 - DNA, 11081 bp, Oryza sativa
atcggccttccctctccaccgaatttttcaccccaacctctcagtactctctcacttattaatattattccctcagtcctctcctctctcagtcactttctctctctctctctctcactaaccgagagcggcgcggggtgggcagcggcgacgggcgggactttagttgaaccagccgttcttgggcccattaagtgatgtatgtggcaaccaagtgggttttcaaaaataaacaaaatgaggatgatttgattgtgagaaataaagctagacttgttgctcaaggttttacccatgtgaagctgttgatcaaaaggaatatagaagtatgattggatcattgctgtatctaactgcttctaggccagacatacaatttgctgtgtgtttgtgtgtacgctttcaagcttctcctcgtgcttcacatcgtcaagcggtcaagcgaataatgaggtatttgaatcatacacttgagtttggaatttggtattctacttcatcttctatatgcttaagtggatattccaatgttgattttggtggttgcagaattgataggaaaagtactagtggaacatgtcattttcttggtacatcattgattgcatggtcatctaggaaacaatctagtgttgctcaatcaactgctgaatctgaatatgttgatgctgctagttgttgttcacagattttttggcttttatctactttggaagattatggtcttacttttgagaaagtacctctcttttgtgataatactagtgctatcaatattgctaagaatcttgttcaacactcacgcacaaagcacattgatattcgttttcactttttgacggatcatgttgagaagggagatgttgaattgcagtttttggacacaaagttgcaacttgctgatattttcactaaaccctttggattctaatcgttttgcttttcttcgtggtgagttgggaataattcatccttttggcatggtttgagggggagtttgtacctcatggttttatcaagtaaaaatatgacaatgagaaaaaatgataaaagagagctttgtttatacatatggtattctcttctgcatgctagcaatactttgaaggtttatttgtctatagcatagcttgtatgtattctagccttttcatgagatttagattttgcttttaagggagatgatgcatgacacttaaattctacttaaattaagcaaatatgcaatgttgatcctagcatatggtttgatttttaaatgctctatatatatgctttattgatttgttattccttaaatagctttaattgctcattgtgaaaagagaataaaaaatataaaaaaaaatgaataccgaatccttggaaacagtcttgacgacaaggacgtattcgatgtgagcaaaataatgggtgccgaatctctggaaatagtcttgacgatagggacgtacccggaataaaagaaaacaaatatgagcaaaaagtctcaagaaaaagaaaagggttaaaaaattctcttggttgttttgtgctaaaggttatttgagaaagagtgataaatgcaataggtatatgtgtttagtgtttattcttcaacctatgtgcttgttaagatgttgcattataaatcgtatgaaattatgaattttgattattgattcaagcttaattgtaaaatctttggttcatggttatactttaatgcatgcttgttatattatagacgggttcatcttctttttattgcaacacatgacatgatgtgctatatatatgctaagctcttatacactaatgaacgtaattcctatgcttgatgaaatcattgtcaaaagggggagaagagatgagttttgggagaagcaaagtgaaattttcggagttgttaagaagagtatgtttttttcaattgggaatttctttctttcacaaagggggagaagttttcttttggatttttgaattttcgagtacgatgtgtacgtttgtacgaagtgtgctttttaccacttttgtttttatttttccaaacaccaaaacatttttgatgggtttgccaatgtgttcatcaagggggatattgtaaaatcaaagttgtttttgattattattctgtgatgaacaattggcattggagattattggttttgatatttagaatttattcacgaagtggttttggagatgattggatttcacaggtgatctacaggatactgctggatttgggtccggtcagaccgggcagtgtgcgccggtcagaccggcggtatgcgcgcggtcagaccggccagcccgcggtctgactggccgactctgtgtcggtttcgtttttgggttatttgtttggatatccgtgattatttcatgattatggcttctagatggatactatacgtatgtaatactgttgtttgctactaatgagtcaagttggagatagcttggtctcggaatattgtttctttgtttatttcatgtgtaggtgactcgatgcctcgggagagtatttgcggtgatggaccgggagtcggcttggggataagacgacgtccgtggtggtcagagatcatgcgaaatacttaggctagagttgatgcacgtagttgatggagattccatatggcatacgatggaggtattgtgtgcgtatgggatgcggaatagaatttggaaggagtccaaatttgacatgattggttatgcaaagtttgtttcctgtactagagggtttcctaaggtgtttaggactcttagtatgagtttggttcgtggctttaggctgcctacctcgggtataaataaagggggagtgtgaggcttcctggtatcattttttagagcaattgagttgagttttgagatagggtttcgagtttagtcgaaattttgtaagaagtgctgttggtgcactttgtaaacacatagagaattaataaagtcgtcatctactttaagagttcttcgatttgtgtttcatcgggtttcggcagtctaaccggtgatataccggcggtcagaccggcggcaagcggcggcactgattgttagtaatcttaccgacaccactgcagaatcaacccatccaccctgctcctgcggccacgaacatatcgtgaccaggatcaagtacttagatgcatctgcctgcagctctgcatgcaaacttctgtgatccatattttgcatcaccatgcctaacgctggggaagtctccaacgtcgtatgcatgtgtacatgagatagtcccgccatcccgcctcgtagccgggattattgttgagttccacgtttaattctgcaggtacttgaattaatttcgatctacaaaactatctgtgcagtaatttttcaattttactctcatcgctaatatgcgatatctaattgacgtgcagaaaattatcagattgatttgacgaaaaattacgaaagaaaaagaaaatatcagaattatgagaaaaagaaaaagaaaatacgtctccatgccatgtgtactgtcgattttgggaaaaaaaattcgggaaagaaaaaaattaccgatggcaggtctttcaggtgtggaatctattggagtttaaaatcagcgctgatcaggacaaagggcaactggagcatggctaggtcacgtgtgtttgtagtcaccatattatgagatatacgattggctacgtcgttagttacgtaacgtagattgcacggaatttaaaggtggcccaccgtacattaaacataatcagttagattttaagatctacggttgtgatgatggggtttatttaatcaacggttagatttttctagttaacgtgagagctcgtagaaagtgtccgattagtatagatataaatatagatagatagatagatagatacatagatagatagatacatagatgtttttatttaattatgtatcattataaatttattacaaatgtttagaaaatagatttaaaaagttacataacactggtgtgtggcatgaggcagagaaaactactctcaaattttaaaactagtaaatgatttaaaaaagatcgtacaaaattctctgttgctttgtggattttttatgacctactctttccatttcaaaaatataaacatttttaggattcaaaatttgtacaataatcttaatatttctctgcatactttcttatcaaaacccataacaactatctctcacctaatcacaatcatttgtgacctcaacctttgatttctattaaaactctaaaaaaatgattaacctttggaaaatttggcaagggaaaaaaaagatatagagtaaatttcataaaaccacatatactttaatcaaaccatcacaaaactatagatataaggcgtggtatcataaaactacaaatttagcgccaggtttttttataaaactataaatttagggctatgtatcacaacatacaaattaatatttaagttatcacaaaactatagattttggagtttacatacctagaactattattatgttggagctataaatcgatagttttatgataaatttgatacctaatctatagttttatggttcttcatcttaaatatatatagttttgtgataaatttgatgctaaatatatagttttatcatactacatatttgtaattttgtaatagtttgatcaaattatctgagatatataattggtgtgtgacaaatagaattgaatgcctaagaagccaatttgactatccagtatttatatgtcgaaataatctataatgcaacttgcatttctccataatgtgttctatattttactaaacttttgaaaggggactgacgccaggattaattactcagggctcagtcaagatgtcgattggtggaagaggtcgtcgcgacgctcccataagtcctcaggatatctttactctactttaatgatttttcatgtactaatacctctgttcttttaatttgttctagacatttttaaattattagagcgtttaagacgtgaggttgactttgagtgtgcatgattttatatcaagatatgctaatgaagttgtaatatcatgaaagtatttctaaaaacaaatctattggtacaatttacgtatatgattttttttataatttcaaatgtatgaacggcatagattaattctcggacgccagttaaaactgaacagaggtagtatgtatattgtcggaaccacaccaataactttaatttcattttgttggaggttacttgatacatcaaattacgatcgagctaatctttccaaatatcacattaattacttttttggctgttggattaggcagttcttatcaatatttatagtttttgtccacatattacaaccatatgtgcatgaatcattgtaccaccacatgacaacaacatgctgggtgtacagttatatataacaagctagtctaggtcaaggcaggatttgtctagatcacaaataggaatatcgatcgactccgggcgctaagctatccctatgtgaagatgaagacttgaacaagtccaggtcaaggcaggatttgtaaaaattaaaatcattttagctggagttaaagatcgtttctcctacatctattggaagaagtggccactgctatatatcttacctcagagttacttgctcacaagtaagcaacaaccaaaccaaggcctagaacacaacactgatcattaacctcaaatcgtccatgtctccgtttcacatactttttgttctaccatggctctgcatagcggtattggcaagtgatccgccgcccagctgcgagagaaattgcagcggcatagagatcccttacccgtttggccttgagcttgcctgcgccttgcccggcttcaacctcacatgcaacaccacagagggcaagctgtatgccggcaacgtggagctgctcaacatctcgctgctagaaggttgggttcgcatgaggatgcccatatccaattactgctacaacgacactttacacagcatggatgaaaactatataggttgggggttagatttaagagatacaccatacagattatccaacgttggcaacatgttcacggtcattgggtgccgaacacttgcgtacatcgacaatttggatacagctggcaatttaacaacaaccgggtgcgtggccacatgctggcaaggtaactattcaagcctcaacgacggtgactgcttcgggataggttgttgccaaatgaatatccccaaggggctccagtactaccagatttcgtttgacccacgcttcaacacaacggagatctacaactttagtccttgtagctatgcagcactcgtggagtcatctagattcaaattctccaagaactactctacatcttcagcgttcaatgattattatggcgggcaggctccgctacgcgtggattgggccattgggaacaagacatgtgaggaagcacggcatcaggccaattacagctgcatcagcacatacagcgattgcttcaactcgctcaacggaccaggctacatatgcaactgctccaaaggattctacggaaatccttacctgaagtcagatgatcccgacagctgccaaggtgatgttgcatacaatcccatcctttcatgcacttttgagcaagttaatttgacgtgaaaataatatggttggcaagttattttttgagcaactaattttttcacctatggacacatctgacccaagacccgaaaacctagcgggtgcagcaaggttttttattttgcccatgagcaaccaatacccgacctgcgaatctagtgggcacaacctagcttgcttgatgtttgtgtgaaaaactgcaaaattgatgcacactatttaggatataacaattacttttggatgactgtagtatgtgaagatatactgaatatttttggatcagtgttgcttgattgtgaaaactgcagcgtgaagctagatgatgaaaagttgaactttgataaagttgttaaatcttttgttgattgttggaaacttgaaagttgaactgataattttgctaccttgttaattgtgttactcatgcccttgggatatgggatgggtatttggtttctggatccatgcggggctcgtccaccccccaccgccatgctccatcgttgctgtccgttgccaccgtgctctgtccctgtcacctgccgttgtcgccggatccacgcgaatcttggcggggcacggccgccgcctgccggttccgtacaggggacccgttgtcacccttcttcaacgagcgggggagcttgctgtcggctgtgtcgcccgccacccaccgttggccgcgccacccggtggaggcggatctgaccgccaccaagcacccaagggccgagccacctgctgccgcccgccgctcgctgcccgtctcgtgagagaaaagtgagagaggagaggaggggaaactgttttaaacactcgggtggacgtccacccgtttcttgcatgtcatctaaatgattacgaaaaattttcaaaaaaaaagacatgataggttaatatgtaatatatatcatctcacaaatatgcaagttcaaatttgacttctacaagttataacaaaaataacaaatttgactgtgaatatacgtatactagttagagtttaatttgttatttttgttacaacttttagaagtcgaatttgaacttgcatgtttgtggaatgatatattacatattaacctatcttataattttttttgaatttttttcataattatttaggtggcatgtaagaaacgggtgaacgtacacccgagagattagaatccatctccaggagaggagaagaggtgagagagtggagaggaaataatgagagaaggtgagagagatgagtggataaggatgaaaaattttgaaggattgtaaggaaaatgaggaggtaactcggactttaggtggaactgtaagaggtccgcctgcgaaaatatatttccgcgtgcagcccattaaaaggtacgctagcaaaaatagaattatttttgcatgcggacctttaagagacctgtttatgaaaattaatttttgtgtgcgttactcctaaggagttgtttgcgaaaattgagtacttttttcagacgcgacgagtgatctgtctgcaatccaaagagagcttcgtccagaaaatcatttctgtagtagtaactggcatgacaaaataacagtgtcacagcatgacaacattatttggccatgccaccctcattgtcgtggcaagacaaaatacagcgtggcagttttgtattgccacgctagacacgctggtctatttttaaaattaaaaaaaaagttcagaaaataaaaaattctggtttctgccggtcgatatttgcgggcattggtcaggtgtgtttctactccatccatacctgactcgactaattgccatccattgacatagccatgtcctgcttattactcaatggcaccattcctagttggagttccatataagagcgagtttaatggtatagctaactactagcttcaaatcacctatagtcaacttaatagctaattcatataatagttaaatactacactattaatacttagccccacttatcatacacatactgcgtcttggagttcgtgctatagctgattataaatttgtagcccgctgctcttccctctcctctattatctctttaaaaaatatgtttatagtaggcttatagcctgctattgttcctgctttaagtactactctgtccgtaccaagatataagcacttttggacctcgtcaaagtcttcgggatgctactataacaaacaatatatataaaaataaaatgttttaagtaaaaagagttgtatattataatagtttgattaatgataaatctagtaacatcaattttacatggttgatcttttttattttattgctattaatagtcgaagttaaaaatggttgacttggcactatgctaaaaatgtttatattttgagacggaggaagtaagtaagtcaaaactagtttggttttatgccgaggagtgcaaattaaattatttggaaagttaaaggatgaataatgtatatcgctaaagttaggacgacttttacattattttttaaaaattttatggtgtaaaatgttgttttatttcattttcgttactcagccggctttggattgctaagagttaattataccttaaattatttatattacatcagtcatgtgccttcagcttataagatgtataggaattttcttgtgttctttgtcaatcggctaccatagaggatttaatgcacctgttcttcacatgcccttttgcccaaaactgttggaatcgtttgggtatttacttgggatactaccctttctttagagggtatgtttataagggctaagctgaattatcagggagctgttttatggagaagtttctatatgctgcctggaatatttggaagcaaaagaatagttccatttttgaccaaaaaatttcttctctgtcttcttggaggcaactcgtgaagagtgacctctttcttatattgtttagaatcaatgcgagatatcacgatgtaatcgtaagctggataaacttattgtaatttgcacccttttcctttaataaatatgtcttaacagcggtggcctcccctgctgtgttctcttaaaaaaaagatgtataggaatgtgtcccaagcaaatttttctgaattctcatctatagattgttaaacctgaaaaaaaaagttctagtcagttcatgcgcgcgcgcacaatttgtgcacaagcttgtgcctataccttctggaatttaattcaaacatgtactgctcaaaatataacatgcatgcgtattactgcgggaattataagtgataaatataatgattgctcagtagaatggcgaaaataaataatgtgctttcttgaaagagacaatgtgcttgtccggcaatgaaggcagtattctacgtgttttaatagggaggctttgttgcatacgtggatggctaggatttgtaaatgtggtaaaacaaagtcagatagtaaaaaaattgctcgtaaaaggatgagtaacatgatttagggttaaagaagattgaggtcttttttattttttttaaaaaagtaaattgaacattaagctgaccattttacaggtataagggagttatcttacctgattatgtccacaattttgtatagatgtacatcttccgccaaagataatgtcaactctacatggaacaaaaataggatggtagacataggagcacacaataaataaaaaactaataaatcaattttcaattcaagttcctgtattctttaggaaaccacaaaattaaatcaattgatggggtcatggcgatagagaaatgaagaaggcttacctggacaactgcatgacctatgcaaaaatgagggtcacttggcgctgcagcaagaagctagtaaaaaggtcactggagtctggcaggtgaaaatccaatatgaacgtcaataaatctgcaaaatcagccgcagaaaacagtaaagtctaaaatgtaattcaaataagcagagaatttagagaagcttccatgccttagaaaagtcctatagtgtagtttggattataaggtattcatcggtgattaggtattctaaacaatcagtgtaggataaatcaaattgaacatatggcatagagaatatcaacaaaattcggctcaatgtacaaggaaaatgttacataccagccttatttctgcagattgaaaataagattggagcggaacaacacattcagcaaagaaagctgtagatactgcatcatcaatcacccttctttacatgtgaaagagctggcgagtaagagctttcagaaaactgcaacagtacagaatcaatcaaaagatacaagggattatttgaagtggtacctatgcagcacgaatgcaaatgtagaacctcatacaggtagaagcttgaatggaatgaactaggtagaggatgaccgaggacctgaatttgtttgtattgaagttgcgtctccccggcaataagtgaaaaacggcgatgattttgcca

SEQ ID NO: 38137 - DNA, 3825 bp, Oryza sativa
  unsure (1)..(3825): unsure at all n locations
gcgtcaagcatcagagagaaagccccacagtgggggaagaaaagcggcgtgcggttgcgcttccctggcggcaccacttctttgtcgtggggacggacgaggagaggttaggaggaatgccggatggtatttactagggtgtgtattgggctttttttggccttttcgtgtgtaaccaatggcttgacgaagtgcgctgggcttcacgcgtgtgcgagcgtccagattagatggaacggctaagatttaacaggtgacgtggcttaaccataaattagctttgggttttaactatatggaaagaagggatctgatggaataaaacaaagaaaatcgtccaaataattctatttttttttcttccatgccttcctgtaatactgtctgtattacagagacgggagacatgaaattgatttttgcaatccattaaattgtacagttttctaactaagcaccacaaaattccatttcttaatgtcactggtattttgctgcagatatcgatgagtgcaaggaaccaaataagtatccttgctacggaaaatgcaggaataaacttggaggctataattgtacttgcccgtttggtacaagaggcaatgcctacaatggaccatgcgacggagggctagcaattggtacacagaaaactttcaatcttgcaatatttagatacattcgaacaaatttgaatctcttgttcgtaccagcatagatcaatacatttttttgtgttacttattgattcttttgaacatgtcatgggctaattcctcatgatacatagttgggctgaacgtttttaacatcttcttgccaggaatttgtgccactcttttggttgctttaacgagtttgcttgggatagaatggatcaaatacaaacaacgaattaaaaggcatgacctcatgagaaagaggggtgagtattttaatctacacggaggccaattgttgacagatatgatgaacatagagaacaacatttcatttaagttgtatgaccgagatgaaattgagttggccacaaaaggctttgacaagatgtcaatcatcggtgaaggaggtcagggtactgtttttaaagggtataatctcgatcaagtgaacaaccctgttgcaattaagatgtgcaagggatttgatgagaatagtaggacagaattcacgcaagagttgctcatactttctcgagtcaaccatgaaaacatcgtgaagctaattggctgttgtctgcagtttgaagttccagtgcttgtgtatgaatttgtcccgaataagactttgcactatctaattcacagccaaaatgatccatccatcagaacactagagatccgcctaaaagtcgctgccgaatctgcggaagcattttcatatctacactcactggaccaccctatcttacatggggatgtgaagtcgatgaacatactacttagtaacaattttattgcaaagatttctgattttgggtgctccaaaattagggcagctgatggacacgatgacgtggtgaaaggtaccattggctatctagatccagagtacctgctgaagtttgagctcactgataagagtgatgtgtatagctttggtgtcatccttcttgagcttttaactcgtcgaacaccattatctaagcagaaggtcagcctcgcatcagtatttcaagaggccatgaaggaaggcctatttcttgagctcatagacacggaaatattacatgaggataacatgggattgataggtgatctagcaaggctggcatgccagtgcttagcaatgactagtgagagcagaccaacaatgagcaggattgcagaggaattgcgacgaatagaaaaacaagtacgacaacaccgtggggtacttacaagtattagttcattgtcattgtcagcaagttcatctgcagacacatcagagcatttcacaggtgaaaccaatggttacgacagccttaggagggtggctgcaatgagcatagaatttgctagatgattgcacaagtactatatggttgtcgtttgaatgtgagcgcttctgttatatgctaatattatatttgtcatttgtaactctgttctagatatatagacgataatgatgttgttgttagcatgtccctctaaagaaaacattgtgtatcttggatcatgtgttgtcactagttatgaataattcaggctaaagatatcttcttgtgtttaattttaagattgggaggttaattatctcctcattcatccgaataatctctcttcccttgatttgctagatgtctacaattattgaaaaccgcatcaggttaaatcagatggcgaagaggaataacatgtttgactcaaaaagggcaaaataaaaatcctgaggatgaaatatgaacttcaagaacactaatgctggaagccattgaagaaggttgtcattgagaattttcattcatgggaaggatgccttccaaaagacactcttatgctacagctaaccacagcaatttaagtactatcaagtacaaaatgatggtgaaaagtaaggtgagaaaaggctagcaggttaacgatgacaatgtgctctaagcaacggcatgacagctttgccagattcgcaaataatgggcaaggttttcacaattgacttcatagcagactgatttggcagcaccctgcacgcctttctcagagatcttaggacagccaccaacgaccagagactgtaatttctgtgcatgagccagcttggtcattccaacatcactcacacgcttacaataccggagagtgagattaatcaagcatggaaaatgtgcaatgcagcgcatcccatgatcagttacgtccttgcaatccataagggtgagtgtttccaggaacggtgcagatgagaggccctccatcccgtcaccatcgaagaagagggcgccgttcaggatgagaacacgaatcggacaagattgaacgaacatcacaagtcccctgtgtgaagcctatttcaggtggaagccaatgctcacaacctgtaaatgtcagttcaacatttctgaaggaaaggacagttgagagctagtgccttgagactttcatcagtaaaacccgtcctgaaaattatatcatcaccaacattgtagtgttcgggtttcagccaaagtgagatgcttttaagattcttgcaggtctgggatagtgcaatcatgtcattgtcaataagaccactaacatactctaggcttagcttctctaacgacctgcactttcccaacagaaaacgaagtcctatttctgggcctttcggctctgttacaatatgcaccaacctcaagtccttcaaaccctcgcacaaaagatcatatctataagtgtgagccttgtatgatgggtcacgatctcttctgaaaatactccaaaaactttgttcgttttcaaactcaaatttctgaagcttcatccatcctgggccaaacattaaaaaatgatactgccctattcctttgcaattcttcactactagttcttccaatgatccgttagtgccaagatgctccaaccactcagtgctgctagtaattcccttacaattgttaaggtggagagaagatagagtcttgcaaccaacagctaaagagagaagcccccttgaagttatttctggtgtggagttcagttttagggacatcaacatcttgcaattagtcaggcaagcaagaccagagtcattgatttcagagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38138 - DNA, 6208 bp, Oryza sativa
  unsure (1)..(6208): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactagcaagtgcttatgcaagaaaacatctagttgcacacacatatatatatagacacacatgccggtaagagaagaagttgtataagttgtatcactatatatatacacacacatgctggtaagagaagaagttgtatcacgtccataacctagtatcatgctattcaacatatgggaagatgggagggacatgctcattagatgcatgcttctggtacatgaaacaacatattgtatgcttctgattgattacaattttaaaatgatagcacaattagattatttacttgctgaggtaaaatggtttaaccctccattttagtctgaagtgtgaacaacatgtcttgcccaaacaacagcagtttaacttcaattctagctccaagatatccaacttaccaggccagttccttatatatttattttgaagtaagaatttagtttttttaatttgttttcttcaatgaacaatcttgaattagcattacttgattgaacagctaatatgcatcaataatatatgtcacaccttctcaattggaagctatagcactagtcatcaactcatgcatctccatggacaacacatgtttcaataaacagcttcaactatttttaccctaggaatatgggcattttttttcactaattaaaaactcccgtaggccagattgatagaaaaatatttatttttaacactggaagtttaatgttcagccttggcatcaccaactgtccgtacctagttgcgatgcaaagcctaaaagttaaactttcattgttaagaaaatcatgaagcatgctcatagaaaaaaaaactttatatttgcatatttacaagcaaaagaagatgtatttcgtttaggagaaaaggtatcatgaatcatgactcaatggcgcatgtcacataatacttacaatataattaatcatctaatcaatagtagagccaaaatagtgtcattgtcgaaatcctaacatccattacatatagttaactgaacatttcaattcattattgtatccaatgcagcgtctctagtccataacattttatttcttcgtctgacaaaaaatccaccaaaagcagatttctcgctgtctgaactcttccttgcagatagttccttgttttggcgactattaattgtgtcatcaaaacatagagatgacggtcttaatttctcaagctgtaatttcccattgtctcgtagaatttcttggccactattgccaaacaaaatcgtccatcgatcttcatcttggttcttggatcgtgtacattgtattatcatgtcatgtctgcgggcaaggacgaactgaaaactctctccttggccttcagagcctatggaaagacacaagacaaaaacaggccacatcatcaagaaaccgtaatgacaagctgacagaaaaaataacagtatacatgtgacgcatgcaagaagttctgaatgattttgcttacttctttctcccaattagtgcacactgttatggctagaagcaacagcatctgaacgatgagtgcacacattatccctaaccacagtccctgcaagtttggaagcatatatattgttcagaggtcaatttcttctgctcaaaacagagaccgatttcttttagataatggatagtaatcaagcctctgtatccataagtgaatatacacggccaaagattatatgaaaacttatattccaggtcccatatctaagaaatagccaaccaaaatgttgacagaattgaggtaatgctttctcttatgtgagcagtagaattaccatgccaccaagatggtagacgaaggcgaaacacagcgccgctggaattccgacgaggtagtacgctccaaggttaacaatggcaccaatcttttgccacccacagcctcttgcaacacctgaagaatccctcactgtcagtcattttcttggggataatatgtttgttaacaaccatatatacaaatcaatcataaatagatggatatgaaaagaaccgattaacgcgtgaaaaaactcagacaatagtctctcaatcacatgcattttgttttcaatttttttggttgagatcgagcatcgatcatctgacctgacagaacacactgcaggtcatcgaagaggaacgagacggcaagaatgggcatcatcttcgcgacgtactggaccacctcctcctcgttgctgtacgcgtaaccccatagatggcgcaccaggatcatggcgagcccgatcgcgacgccgacgacgagacccagcgccatcaccacacggctggccagacgggccgcctcgggtcgaccggcgccgagctcattcgagacccgggtgctgagagagatcacgaagaacagggcattgtgatgtcgttaatttgtcattgtaaaagttcatgaacagttgttttgatgaaaagaaaaacaataaattgaaagcaatgtttatgataaggtgtttgatttgatcaatatatctgaccttatggctgaaccaaggccgaaagggatcatgaatgccaaggaacccgagttcaggctgcaggaaattcagtggtacacgatcagaggaggcaaactggatgcagaatgtgtgaccaaatcatgaaaacatcactcaccaaatggacaatactgatgcttccagcttcggatttgggagtagtccggagagcagcacaaggagctcaaacgaccaccactccaagctacaaaacatgcaaatttcagctaaattcgacatgagacaacgaaatttacctgaactcagagtgactagcacaatagttttcttagagtaattttaccgttcttaacaaggtaccaaaatgtatcatattttctaatactcctataaaacctgatatctcctgttactaaatttttcagtccaaaattttgatatccataggtattttctcaagtactataaaatttcgtgagtatggtgttatgtgcttagagatgcacttgataatacagtggtaattggtaagggatgtgtggtttcaattctgaggtcccatgtttagcccccaacctgcttacaattccttcttaaaaatagtttgaagaacatctctacctccgaatctctccttttgtgtgtgtgtgttgcgtgttgagtgttgtgtgcgcgtgtacatctatcgtgtaataaaaaaaaagtactataaaatttatttttttaagtaaaagaaacttaccagaccatgagagcagaaggaacagcgagcctcatgaagccgaccaagtcgtggaacgcctccgacgagaaccccgtccacgtgctccggcacgctggcgacagcctgacgtaggcggccagggcggcggcgttggcgaggtaggcgacggcgttggcgagcgcggcgcccttgctgccgagcccggcgccgtacaccagcagccagcacaccggcaggtggcacgccgcggcggcgccggagctgagcatcaccggcatcacggcgttctgcgtctgcaggaaccggacgtggcactgcaggggcccgtacgccagcagcgccgggatcatccaccggatgtagctccccgccgccgccgcgatctccgggtcctgcccgaacagcaggaggagctcgccggtgtaggcccagaccgcggcgacgcacacgctggcgaggccgagcaccaccatggcgcgctgcttgtacacgcccacgagccggtgctgcttcgccccgaacgcctgcccgcacagcgtgtccaggctgctcgccatgccagcctataccaattgacgatgaaccggatcgaacacgtaccaagatgtcaacgaaattcaatattatgttgttgggaatgaagatgaggttttggggatgggtaattttatcatctttgagctcaaggtatcgagaagatttcgaatataaaatttgataactccatgtattaagtatattgaggaaataaaaattttagtgtaaaatttaagtgcttcaaggtactttctcaagatatcatgccatcataccatggatgatgaacagatcgaacacgtaccaagatggggagcgaattcaatatcatgtcaggaatgaatattaggtttcgatgttaggtaattttatagaaggtattaagaagtaccaaattttgaaatataaaatttgatatcttcagatactccaaaaaacttagtgtaaagtttagatatctcgagttactttctgaagaaccgtatatttgaggaagggctggtgtgtgtaccaggaggctgaagccggtgacgccggcgaaggaggtggcgatggaggcgctggagagctcgagctcgccgaggtggccgacgaacatgacggagatcatctgcaccacgttctgcagcagccacccggcgatgagcggcccggcgaggtacagctgcttcctcacctcggccaccaccgctagcctcgagctccctcctttcttctcctcgccattgccgcctccaagaagaggctcctccatgcttggtggcgccgccatggccacgcccccccaagcttagcttcttgctctgcttctcaacttcaaacagaaagatgagtgtgtttacaattacagatgaggtgaactacttactgaaggttgtgagcaacagcaaatcagtcaataatctgacaagtccttataagggctttgcgattaattggaggaaactgcgaggaaacgatgcacactaacttgacagccaagttcaacgtgactaaaaggcgaaacaagctgaggaaagaacacgatacgttgtcttatctggcaaagttattatgacagtagtatatactacctccacccccaaagaaaaaaaaatgtaacgatctggatagcaaaattgtcaccacagcgctagtttgtgcaaaagttattatattttaggtcgaaaatagtagtattgtaaaataaaaaaaagtacggaaaagttacaatatggtcaaactatttttgaaaacaaataaagtatgttttcaaaagttgaaccaaaatattcaaagggatattgatggttaaagtttaaatgtattgccaacgcgcattccaaaatatcacatatttataactggtaagaatatttaagaaaggctaacgaatagtaaagaactggattctaagactgttatcaccacttcaacagccaaacagatcctgcttcgatatggctgaaataacttgcagccaaagtggtgaagtgcagtagtgaagaaaaaccaaaggaaacaacagtcaagcttggcagccaagttcagcatgcctgacataatactattatactcgattaggacaagaatgtgtgttgctagattctttgcaccacgagtcaaaggatgaaacaaattatatatacttttaggtgccgaaatcaaccagacttcctcctcttccctctagtacttgttaacagagtcaaacaggtcatcttcagactgtttaaatttgtgtacactaatccacgattttagttccagttagtggtatatattggatgacttgatcaaatcattttgaaacagcacatgtccaaatttccagctcttttaagcttattttttcatgcctgacgctcacgtgccaaagagacccattctcgacgacatgcaaagacccaccgttgcaacaaattatgaggaaaaatatgcatttggttcagaagttcagaaccgcaaaactgaaccaaagaacgggaatttctaaaattcaaatcaagtcaagcggagaaattttgtaattctttcgcaacgaagaggcaaatccgagcgtaacagatttcgctgttccgaattattagcgacggagcaaattcaaattcatcgagataaaagaaaagaaattccaaggcgtacgtcaaaaacagcaaactcctcccgcagaagccgatctctccggcgccacaaaaatttgactaattgaggaaagaaacacgtgacggggagcgacatgtggagccgtacgtaccgcaggtcgtcagcgtcgccggcggcgaggcgccggagtggaaggagaaggcgccgccgccgtccgtacgtcctctctctcctcctcctccacctcggctagacgaatgaagggcgcggcggcggaccaggaggctggatt

SEQ ID NO: 38139 - DNA, 12304 bp, Oryza sativa
gttgcacatctctctcctctgcactagttcggagagaggagaggagagaaaaaattctacatgtcacatattacgtccatttgagttcattttttctgtggttggttcttgtgtgtccctaagcgtgaaaaaaatatcacacaaataaaacaaaaataaaaaatttcggggggggggggggcgccagccactctggcgtactccccctagccacctcagcatagccccgccacgtcggcggtgggacggcgccaaagaggctggcgccgtcctgtttaacaacggcgccagccactctggcgccccaaaaaggaccatttctgggataagtttttttaggggtctatttgcgaaataagttttctaaaaggatcaaaatgtgaaaaatccagaccaggaggcgaggcaagcggctaaatggcgaaaacgagtgatcggctggatttcatattcatttcctgattttatcaatagaccaaccgagaaagcttattctgaaactataagcctaggtgaaaaagggtcgaaaatggcatcattttattactctcttcgtttcatattataactcatttgacttttttaatcaaacttttttaagtttaacttaatttacaagaaaatatagtagaaaataaatatattatcaaaatatattcaatattagatataacgaaactaatttcatatttcagatgatgctaaatttttctgtaagtttgatcaaacttaataaagtttgactagaaaaaagtcaatgagttataataatatgaaacggaggaaatatattttttatgaaagcaatatcgattggataaagaatttttatatttatgaatttaactatttagtggcagcttcaataaaacacacaaaatttagaaaaactaaatttacattcagaaacaatcagtattgatatcatttattattacttttacgaaattagtatcggtaaagtccaaaaatttctatgctaggtcgttctctctcatgcgaccctccgttggacgccaccagcagtcattccctctcatctatattagatcatcatacgattataacatgtgtgtctctctatttaagaggaagcctaaaatatagtccaactctatccctatcctacacatgtttcaacttccaattctaaactgtaacatcttatatataatgaacacaaattctaacattaacattgaccgtcacacgagcaagggcttggatagtagctccatgcctcgagaccttgacgccgatccaacggtttactttgtatagatatattcacaaaataattttaagaagggctaaaatgttcaaaaaataacaaaaggtgcttaatttggtgcaccgatccattgagcggcgacttcctgcggtggtggcctggtggggccatggctaccgcgatgaacagcgaaaagtaaagatctatcggatcagtgaaagggactctctctcctctgctcctggaaagattcagtcgccttcaacctccagcaaatattttcgatttcctctgtctgatgatcgatcgatcgatcgatccggtggtgatcgacagacactgttcttggcacggcacgagcgatggtgatgacactgaccgtgatctctcgtgttcaccgaaattccagccaattatagccttattttgttcctccccccatgcatcttcggtgtcgcataatgaatggttcgatcgatctctagtacttggcgtccatgggaagagacaaaagcagctagcggccgttgttcaaaagatttttttttaaaaaaaagaaactaatgttcaatgcatcgctgtcgatctctggagcactccacaacaccagcagctgtgtgaaaaaagatgttccaaaacagtaaattaaaagaaaaaaaatgttctaaggcatttgtaattaatacacacaatatcgtttattgcaaaaaaaaaatcaaagttttgtgatttgttttaaagaactcaaatatattttaagccaagatgcttcgtggaatctcatacattcatgtagaacactttgaacaacactatattataaacaatattttcgaatatatatatatatactcatattaatatgcgtaaaatacacagacatatgtgcactttcaatgagtaatgatatttaagaaatttgtcgttaactttcatctcttactctccttgaacatgggttaagagtgacactcgctagtgtgtgtatggagtgcgcatctatagcttggacttaaaccctcaggattacatcgataatcatgtttatatattgtaaaaagaacttgtttctaccatttgatacatttccttccttactctaccactaccagatatttctagaagaacaaggataaataactgaaagataattattgtttattgtctttacaaatatatacttaaatttgctttaaaacttaaattataaacacactaaatttacatatgtaatttagagacttacaatgtaaatacatgctgactattttttagtgaaaaatatagtgccataaatatagctactcccaatatttaagtatatatttattctattgataggctatgtctaaatgcctgctagctttattctagtggcatatatttattctattagctttggtatccctaaaattttaatcccatgttcaccactttgcagcaaaacatgcatgttaatcggctacatgaatgcacaaacagccatcagcaaccacgctttatggagaagacggctaggaacccactttgaaatcattagttcctaaagctcaatattaaagataaaaatcacatcatcacacccactaacaagtattaattcaatcactatctacatttttatcatattttaaagttccacatacaaacatgtcaaatcatgataaatcatgatggggggtgttacgaaatttgtgcctaattgacactcacgattcgttgcaaacaaattgtaattaacaccaggattccgagttatactaccaccccttttgtgttcaaattgacagaatgcgcagaacgtacagagagaagaagtagaagaagaagcaagaacagagtgcgatgcgagaacgcgtaccgcggaacagagaaaggagacgaggagatcgaaggaagccgtcgtcgtctcctcgtcctcctccttctccggcgagcggccggaggaggctggggacggatggacgggcaggcggggaagggagcgtgtgtggaggctgtagttaagggcctgttcactttaataccaaaaaaaaccttactaaattttagcattgtcaaaattttggtatagttgctaaaattttggcaggattttttatatagttaccaaaatttggcagcaaactaaatgtatctacttttttttgacaactttaccgaaatttggtaaggttgaaaatgatatcaaattgaactggccctaagctaaggctgcgtcgagagaaacgagtggcgccagcacgcgatgcgcgtctgcactgcatgtctgcatggtttggttgagggggggatccaagccgaggcggctacgtgcacgcgatgcggcggcagcgtgacgacgagcgttttcatttgccctttttttttctttctttctttttttcctttttctctcctcctttttctgactcgatctcgatcggagctgacgctactgggtctctgtaggttgtctcgtccattggaagggacgaaataaagcaaacaaggtgatggtttgatctgctgttggataccttgaagataggcaatgaactgtagtttctacggtcgtagcacgtggcaccttactccctccgtccaaaaaaaaataaactctgggttcaccgtccgtcttatttaaaaaaattatgaaaaaaattaaaaagacaaatcacgcataaagtattaatcatgttttatcatctaacaacaatgaaaatattaattataaaaataaaatttatataagacgggctatcaaacgttcgacacggaaacctagggtttatctttttttgggacggaggaagtaagttttattgactcataagcaaccaatgctctggtacggagtgtgagcgtgtgcactgtgcataggatacactgcccggtttgcactggcctctacttgcgcttactccatacttgcaaacagaaaaatcgaactaaaaattacaaaacaaaaaaatactacagaacaatatacaattccaacggaatagctgacgtcacgatgatgtcgtcatgttatttatataccaaatctaattcctacgggatatcatatctgatacttacgataccatgctgacatcatgttggcgtcagctattccattacaacagtataccgttctttagtctcccaaaaaaaatattattgaaaaggtatatatgaggtcccttatcttgtcaccaaattacaaaatcctccatcaaccggaaaacctgatatataatatcccttagcttacaaaaccgggtcactctagatccttaagaagtattgaccccaattttatctgacgtggcaactgagtcagcgtggcacccactcggtcccacatgttagggaaccttaaccaaccaaagttggcctcggtcattatgtattgaaccgaggaaaaagcctttgtaatggttgggcgatagtaaaaagtcatagcaaaacctgtagcaacttgtactagaaaacaagtaagtgtaattccccctaaacattaaaatatgttgacatgaggaggaacatatttactagttatattgtctgcaattgcctaaatctcaagacgttcctcaaaccaatcatatactttattgagataggtaactaacccaaacccccctccgagaactgtatatgagaatttcatctcgtacggctcaagcagaaacaagcttctccatcccttctcctctctcttctcttgtctctttacagtgcacgagcgggcgtgggcggtggctggcggcgggcaaggagaagagcggcggagaggagataggcggtagcggtgctggctggccagcgagttcaagatcacccgctcgtcgatgaaagtctacaacggctggtgggcagtggaaaagcggcagtcgggcagcatctacagcggcacttatctcggcgggaaggtggcagcggcaagctcgagggtgaagccggtctccgtcaaggacctcgccctgccaagcaggacgcaccggctgctcttggtgcgatccatggcggacctcgccggctgcctccacacatccccataccccgccttgatctccccacgccccacctcgacctcgtcgcgcctcggctcgacctcaccggtcgcgtcgtcctcccacctcctcgcgcgccgcctcgacctcattggccacgtcgtcctccagcgccctcgtgccccgcttcgacctcaccgagcatgccgtcctcccacctcttttgcctcccacctcccatgtgcaggggaggtcgggctgggcaaggcgggagaggaggaggcccgcgacggcccggtcggatcccttcacgaatgcgacaaggagaggcggagttcactggtgagtccctcccccatgctcccccattgctctccacccgtgctcccctgtctcagctctcccgcagcgccaccatccccgttcatcttccccctacccgtcttcaccaacaagcgtcgccaccgccagcgaaggccactgttagccgtcgagcgcctcttccgtcggccaccacccttctccagttctcccagcctgacactggccaccctagatgctttgattgagatgggaagagagagaggatagaggtggaagaggattgatgtgctgacatatgggccccacgtgggttctacgctgactcggctgccacgttagacaaaaaccagggtaaataccgcctaatgacccagaatgacccggttttataagtcgagagatatcatatatctgatttatctgttgcgggatgattttgtaattcggtgacaaaatgagagacctcagatgtactttttcctacacataaatgaaccaagatttcggcccatcaatctgggcctcaactggctaatatgtttaggcacaattctaaatagatctcaatctccgcccatccaaattaggcccaaaattatcccatcgcaacacccttctttagtctatattacctcccctcaccgcgcttcacccaaatcgcctcctccttccccgccaaaacactcaaccaaccccaaatccccccatctctctctcctctctcctctctcgccaagaacgcaagaacgccaagaagaggccaagatcgcaagaacgcccatggatcggcagcggcggccgagctcaccctcctccccctcgtcggtgcggacgcgcgggaggagcccgatgtcgccgtcaatgccgcagccgctgccgctgccgtcgccgccgtcgagcccccgttctggcgccaccaccaccaccaccacctcggtgcgggcgcgtccgagaccaccgacggcgccgcccgacgccccctggctcgccctctccggcggtggcgccgggtcatcagacgtcgccgggagcagcagcggcagcggcagcaacgtcgacgagaccctcgccgcgatgagggacgccgcctgggcaagattctacgcggtcatggggaaggggaaggggaaggccggggagcgcgggagcttctcgttccccgacctcggggcgccgcacgacgtcgtcgacgcggcggcggtggtcgaccacttcgccaccgtggaggcggagaggagggcgggggcgagggcccagttcctggacgcgacgatggaggcgacggcgagcgcgcggctggggagggtcaagagggagctcctcgtcgaccggagggtgctcgacctcgccgggctggagcggtggctgcggcgaggcgaggccgtcgcggagctcgcgtggttcgcggagctctgcgccggcgagggcggcgagccggtgcccccgctcgagctcttcgagtccgcgttccgggcgctgcaggcggcgcgctccgacgagctccaccgcggcgccggtttcaggaagcgctgggttggcccggccgccgtgccggagttcttcctctgccctatctccaacaaggtcatggtgaatccagtcgtcatctcctctggaaaggtgtgccgaatctttcgctgcttcctcaatttcttcagttcttgtggcttgttcttgtgctgttcttggtattcaattcatttgcataccctgcttggacattgtaattgatgttctctgatagtttctactactagtttcttagtgctggattggtacaaatgttgcaagatcgcttcggattggtgacaatgtagaaatattttcttagtgcgatctcttagctttgttcaatttctgtctgtgaggaactgagtttttatctagaattacagtccaaggaaaatccgtaatggtattattgctttcgattcaagaagtgccattttttgttctttccataacagaaatcctcttggattgcttgaaccttgttatgctgtttctgtcctgccagggtgtgaattcggatgtcctattacttgttctgaataatttgtttccacctagagattgtttcagaaaactttatctagaattacagtccaagaaaaatccgtaatggtattgttcatttggattcaagaagtgtttttgttaatcataacagatttcctcttagactgtttcattcaagttcctgttggaatcttgttaggttgtttctgccagggtgaattcagatcccctagttgttatgcttacatgttctgaagtacttgattccacctaaagtttgttttagaagacattatgcttgcttctttgggccataggatatgatatcaccaaggagaataaaaattatagcaatttgtaagagttgtttttctttgggagttatgtttgcttcaaacaaggaaagaaacattatcctgatgtgaagaataccctgaagggctgattttcagcatgttgtcaagttgttctctttcatcatgtaggtttgagcaatggccttttacgaaagccgattcagggactgagctgtcattataagttaacccctttctcaaaatggagcttttgtctgaatgattcagcaatatgcctggagtgaagctagttgcagtagaaaattacatatgttaaaatttgtttatctttaaacttttgatcgtctagtacaaggcatttttgtttatctttatgtatcttcatttgtcttgttaaatctccccttatatagttttctaattactgtacttcttattcttattctgttccgaggatttatcccttttgtcaagaataaaagagagcttccatagtgaatattaactccctgattctaattcttgttttttcatctcactgattgcatctgttgtgtctacagactgttgaggttttagcattggagaaatggtggagtgaaaatagacgcctctgtccagtaactgatgagattctcgacaacagcatattcatccccaatatcctcattatgctgtgcacagcactatggcgtacaagaaacggcattacagatgtgacaacaattgcagaaccaccaaagatttcttctgaggaggaagccctgttcagggaaatcaacctcttggcactctcccctagcttgtctgacaaaacatttgatgccatattacgcctacatgaactcatcagcaatgcgcagtcctcgctcctgcatctgcttggccaaagcccagggatgattgcaaaacttgcatgcctcttgccagagacatgcctggaccctgatcccggattggacgacattatcctcaagatcatcgcgaagacagcttcctacaaccccaataaggtgatattaggagatgatcaatatgccatacctgtgctgattgcaagggcattgctagggcctgtggacacaagagtcaagagtgctcaaatccttgggttactggctgacaactactacaacaagatcaagatcggtgaacttggaggcttcgctgcgctgatggagctgctgctcttggtaggagacagagaagtcaagaggacggtggcgatggcgatcgccagtctctgcgaggcccaggagaactggagcagatttgtcagagagggagtagcagatgctgctatatccttgttgcgcgacgacaacctagtggatgaagcccgcagcatcttcttgaaggctactggttttgagctggccatgacacaggttctggataagctgatgtcatttggcgatgatgccaactgcttaaagatggttgagagcatctggaataccttcatccggacgaaattaagacgaaggcgccccaacgttactcatgcatcttcctcaacaagggccagtgacgtattttctgatacatcttctgacgggagtgtagaactgcctatgcacgttgaattgacagacaaggccgaggacgatgttaggaccattgtttcatggctgcagaagaggacgtgctacccgcggacgtacaaatacgaagattgatcattggcaggccaacatgtgtaaagaacagagaggagtgtaactgtggctggaaatcatacctgattcttgacagagcacattttctgttaatctgtacgtgacggtagctcaagtgctcaactcaagctaaagagttgttctgatctttttctgaatgtcaaactgataaaagatagtatctgaaaatagcatttgttatattgtttcagttgtacagctgagatactgtattgatcaattctgtcattacacattcctgagaattaatatagcttaaatggatgttgcatgaagttgagcttcatacttgggagatattgtgagtgaagccgtctggctaaatatgagcattggagaccaacattttgaaccctttttctatgataattagttatctttttcgcagtatgagatagtgtgcactctggcatatctgatcctgatcctgccagattaagattaagaacatatatacaacatgaccttatatttactagtaccatcgttttgcagttgtttagccaaaccatctcaaaatccatcagctaaaccatttcttcatatgggttggacaaaatcattttatcaatgaaactcatctaataaaatttgcatgtccatttgcttaattcacctgccttctgtcaaggcatccaagacgatttatgctcttgtctgaaaaacatcttgcatctacatttttcttagcaatgacatgaccatggtggatagatcacaaaagataatggcccatgagttagtggccctgcatctgtatacttatattatatatatgccctaagcaaaaactgtggaatgactcatctcaccgtggtggccataaacgtggtagtagtatatatatagatatgtataaatgtaagtgcctaagtagatatatatatgctagcttaagcttgatcaattcaagccatggctgaaggctgaagctttcctggggaagtacttgcgcgcccgcagctgccggccgttgatgaccagcttcaccaggtgttccccgccgagcaccgcggccgccgtcgccgcgtggcggaacacgatcctcccgtacgtcggcggctcgccggccggcgtcctctccatcatcaccttctccaagcagtcgccccacctcctgcagatgatgtttgcaggttagttagtacttatggatgcctgcaaattctgaaggtacttggtgacattctgcttacggattggacaaagtttttctgaaaaccagcataaatgggaaaagttttttttttcgaacgattagtaccagacaacgcgatgattcattggatggagtaggaaaaaatcacaagactattgccttggaagataatagccaggaaagaaaaaaattccaccacactgacaacacctacgcacaggtaaatgggaagagtttgaaaaccatgattatggaaataacaccaggggcggagcttgagtatactaggggggtgcctaggaacccggtcaagaaaatattttagttatacctcatctattttcaccatgtatgcactccctcaatacaaacttagacacccgcattagcttaaactcgatctaaagtaaagtaaattaagcaagtggcaccatccttcatttcgttctagctccgcccctgaataacacctctcaagtttgaagtccccaaaaaacaacactcaatctgtatctgatggagattgaaacccggttctcaaatagacaaaagatgatcaaatattttaaaacattggccacactctttcaaaacaaaaacaaataaaaaaaacattgaccatatataagagaattctgcgaatgccaccttaatccctcataagttgtgaaataccatatatatcgcgcactgcagaatgaaaaatacctttttttttgttgcactttctataacctggatttacatgattcaagataaaactatttgtaaattgaaatgaaaaattgaaattttcgttattaaattataaaacaacgaaactcaactttcgaaaaatatattataatgatctcaaggcaaaaggtttggagattcagagtttctatatgttatacggtacacataagaaattaagattcaaaaacagaattaaaatgttaacgcgagaaagtttccagatagaaagaggtgatgaaaagcaagggcaaaaatacctttttttatcttttattattctctcaaggtgattagttggttttcccaataataaatgcatgagttacaactaatcggtcaaagtttatcgcatgcacgtaattaattaccaagtgcattgagaaatggagattgagctacgtactcagtgaagtactcttcgatctcttcgcgcgttaatggcgaccccttggagaacgtgatgaacagcgaccggcagccgccgtcgccgaccggcgccagcgccggcgcaagcggccggcggtaaggcgccgccagctccgccgggaggaccgcgccgccgccctcctcgtggcggcgcagcagcgcgtacagcctgtcgtcgaacacgagcgccccgacgccgtcgagcacctcggcgacgccgcggcgcggcgcgtcgtccgggacgagcgcgaagaagcggcggacgtcgatgccgccgccgcccaggatggacgagatgagcgtctccccggcgccggcccagcggcgggcgaggtccagcgcggcggcgccgccgtggagcacggcgcgggcctcggaggcgagccgcgcggcgtcgtggcgggtgcgga

SEQ ID NO: 38140 - DNA, 8914 bp, Oryza sativa
gcgcacggtcggctccaccatggcgagagcgcggcgcggcgaggcggttttttgtggcgacggggaagaggagacggggaggggggtgacatggcgtccgtacgctttcaaaacgacgcggctgcgcgaagtggcgcgtacactgaaaatgggggaatttatttctttttctttttgacgggcactgagaatgggttggaaatgcaatggagttcgcttccttccaaggtacactatacttgcatgttagccattcagctttgcagttatacgaattgggccgtgtttagttacttgtcaaaaaataataatttacatatacgaacacacattaatataggctaataacaaactaaactaaattataaattccgcttataaactgcaagacgaatctattaagcctaattaattcatcattagcaaatgtttattgtaacaccacattgtcagatcatggcgcaattaggctcaaaagatccctctcgtaatttacatgcaaactgtataattagtttttttttccacatttaatgctccatgcatgtacatttgatgtgacggattttttgaaagtttgaagggaattaaacacagccttggtgtaaaattatactccctccatcccattttaagtgcaaccgtgagttttcgtgacctactttgatcgtttgtcttatttcaattttttttttgtaattggtatttttgttgttatgaaatgataaaaacatgaatagtattttactcgtgacttatgtttttaaattttttcaatatttttttaaataagacggacaatcaaagctcggcgcgaaaaaccatggctatatttaaaatgggacggaaagagtactactctgtcccataaaaaacctaattatgtgtgtccaggttcatagctagcattgattttttttagaacggagggatattactcactacgtcctaaaatataagcaattttagactttgacatgttcttcgaaatgataccttgagcaataatatctgtaaagtaaaagtaaaaggtcttaaataaaatgagttgcatattatgataattcgtttaataataaattaacatcattttttacatgatccatctttttttatttttttgctattaatagtcaaacttaaaaatatttgacttggcactattctaaaaatacttaaaaatgcttatattttgtaatggagggagtactctttttgaaatttacgatcttctcgcacaacatttgaccatttatcttataaaaaattaatataaatatgtaaagtataagttaagattatattttatttgataaaacaagtcatataaaataaatgatatttatataaatgttttgaacaagataaatagttaaaagttaacggcgtagtccattataaaatggagggagttttatttttctactttggaagggtgagtggctatatatttgcaacattgtgagatgaatcgttgtgagggaattaaaccaatctgagttaaatcctctttaattggacggcagagacgagagggctacggaagttgatccatcccatagtttgtttggaaaattttcctttgggaactactccaacgcatcatttactcttaaacttattaatcgtaacaaaaaaataaattttacaatttaattttggtgttgattttaatgtttttccataataatagccaagaacgcatgtataaaagatttacccataaaattgtttttctatcagtaataagcattgcggcttataatcagccagagcccatttaaaactaatgaatgatatgaaacggaatagagaaaaagcatactccctccggttttatttcaattgacgttttagacaatggcacagactacagaatatatctttgaccttatttttctattataatatatacaataaataaatacatgtttacttttattatagtgctttgaaagacaaatctataaatgttgttctagtttctttaaactaaatatttttaaagctattggtggtcaaagttataaaagtttgaccgtaaacttatccaaaacgtcaattattatggaatcggagggagtatgattttggtaggggtacatgtacaaagcaaaggaaaaactgcataaaccacacgaattggatgagagactcaaaaggaaaaaaaaaataaaaagatcggagatctttgctaatatatgggttaatattttctttcatgggcgtctgccctgcgaaaaaaatcgaaagctcgacataagagaaaaaaatcaggcgcttcaactttccatattctatcacttatctcctcccatctaccagagagtagatgagtagctagcatgttgttgtcccctcactccattcatgcatgcacgcacaagtgacacctcacccatgccatacatacatacatctttcgtaatataattttcaaatgatattttctttcaaattacttttgtaatctacaatctgattgcactaataaaattattgcaattaaatatttacaataatatcacatatggttatattttgataaaaatagtttttttaatggatttattttaattgttgctatggttttatttaaatatttcaactagtgtttttaagatatttcacttggtaatttgtaaatgttgcacattgtgctctttgaaatgtttgaacaaatattttacaatgcttcatcagttgcagtctaatgttcatacataactaaatgtttcgataatattaagtttgtattttttttcttttatattttacttgctgggacgcaatatttcacatagtggtcattggttttacagtcagtattttttgaatggtacacttgtttgaaatattttatacactgaactaaaacatttgacacgtgatgaaagatctttctataagtgataaaaagaacatttattttttcttattaaaatataatcatgtgagatctttgttaaagatttaattacgagtataacggtgtaattggattataaatcagatagttaatttagaaaaaaatgtttggagagggggaggttaagataggaaagaagttcctaacatactagctagcatggagattagtggatgtcggctatgacgatgcatgcttgcacatatgcttctttcatgcgctagaaagctaggccgctaaccaatcaacggggatggaagtagagcagtgacagtgagggagtgtctgactcttaaaaaaaaagacacctaatttggaatcggctcctaatataagggtggacggagttagtatgtcttaagagtggggttatatatcctaagttgtcttaaatccaacataacattacagtgtaacctgctgcatataaaaaaacataactgattatgcttggtttgcaagactaggtggctcattcctcctcaagatgtccccataatgttaaaccaggtcaatgatttttcttatgacctaattttaagcacattatggcacctccattgcacatgttatttgcatatcctcaagaaaaaaaagggggaaatgaaagaattgttctttttagctagtataactagtggttaatacttattgcagtcaacttttatatacgttttgcaaaaaactttctatatgaaagttgtgctgaaataagcaaaggcccaccatctaattgaaagtaaaagcattatgcctaatatggttgtttaggattttgctgctttattggttagtcagaaaaatattggcaatgtcaaattcttggcaacaaacctactgaatgaagtattccattggtaatgcagatctttttagggtggctggtttatacaattaaacaaacaaacttgcacatcagaaaacgatcttacacagcagttaaggaaatatgaacatgtggtggtgacggtgccggactttttacgccccacacattagaaaacagtagaaacaaaataattgctttgtataaactccctccgtcccataaaaaaccactgtcatcactgtccagattcattgttctaaaatgtatcacatccagtactagattcgttttttagggacggagggagtagcctcaaaagcgaaatatctgtaacagaataattgcttccttaattttgaaaattcgcacgctatacgtgcaacaacacataggagttgatgatgagccattgctttggcatttcacagcgcgcacttacactcatgaactgtatttacaaaggaatagaacttttagtgctccttgaactgacaaagtgtccctgattaatgtatcaaaataacccagtgaaaagcatatgattctgcatctatatatatatcctaaatttccaacgagctaaatcagtatcatttaagtggctccacggcacatggtgagttgtgatcctaaaatgtacttgtatatgttagatgctcaacatatgtgactagctaatgattctggagttcacattctcctctcagtgaagatgattcagattgttcgtttcccatatctctggtcttgtgcagaagaaaagttcctgcaacaattgtcacaaacccacaaagctcggttgctatctgcgttgcattctgagaggcccagtcctggaatgaaaatttagggaccatcaaatatgtttgtcaatctccaaaaaagtcacattaacaatgggttagcacctatcggaaatgtttagtatcgaatggcggaagatgaacaatggaatatcatgcataattcaaatattagtttttcgagtcaagttaaaaaaattagtacaagttcagtagcgacaagaatctcgacgcagaggccccttttatgaatactgaattgtcatgcatactggcatgaaaaaaatttcttgcccaacaatgccatactagacatgaatacaccagcttacaacggatgctaaaattttagttttacacagcaaattttaagatgatgccatatatagcttccccagaataaagtctcaagaaacacatattgaattttcaagtctaggtttcatcaaataggaaagtggtttaatatagaaatatcacatgaactaacgaaaggtatgaacgatgtggaaatcaccttgtacatgatcatgttggcaataatagtaagaatggtgaacatcacataatagactggagagacaacagctgtgttgaatgaatcaagggcctacaataacaaaaaaaaaatgttcaaataaaaaagataaagggaaaaagacaatattgatgtcaatatgcaggactcacaatgccagaaaaaagatttaaattattagaaaatgtaaaattaaagaaatctaggtgctaagactctacagtgaagtatgtcaatgcaaaagattcagtgtgaagtaaataatattttacgacaagacaagatgtatgttgttgaaataaatcattcatgtaagctatgtaacagcctcaactctcaagcatttatttttctgaatggaagacccaattacattggagtaggctagagatgaaacccatgttgagccacaaccaaaataaatagatagtaacaacaataatatctatgagaaaagcggtgatcccatcaagtaaaaaactgctgaatgtttccttaagatgtgaccggttaccttgttcaagtaattcaactgcactaaacagcatataaccaccacaacaataaagaaccaggttgggacgtagataaattggttcactccattaaatgaaagcttcaaggcaatagccactgcttttacactgataacctgcctcaagtatattactttatcagaacataatggatcaacttgattcaaacagttcagttatgatgcatagcgagcctaccgtaagagatcccatcagagaacagattgcaatatatgcgagcattttcctttgttccgtccgatgaacgacccagaaaatcaaaataagtgcaacaactactgccatgcaagaatagactatgaaacctgcaagcacaatgttacacttatgcatcaaaatgaattttgggaaggcaagtagtatccctaacctatagaatataaccacaagtactaattctggtagaatgatggaaaaatctcagcataatgaatgacagtcatgcaagtgaaaattctcaagaaactgattctttgagcatcattttcttatgtgtatcaaccaaaaaaaaattgagaagccaacatgcttaaggatgcaaatagactcttagatagaactcttcaaaaattgcaaaataatactgcttctcttgtttgccaagttacatttcagatcagcaggtcagcactgatggcaaaattgagaataaaacggattattatattaaaacacaaatacaaaattaaaactttctccaaaggtaaacaatacagctatatctactgaaatgacaactagaacaactgttgaagacctttgagataagagctacctggttgagttgcaagatgccatatttcgttaactgaatcgatctttttctcctttggagcatgtagaactataccaactgaaccaacaacgcataatatgcaaccaacaataccaaacatatgcaacctctccttcaaaataaagtgtgctagcactgcactgaatgaataaaagagtgttaaggaaacaacatactactgattaatcaaaattatttcctagacgcaaagatatgtgtaaaacctgaatatgatgctcagcgctcctagaggagtgacaagtattgcaggagcaaatgcatatgctgcgaagttggccacctcaccaagaatcactgtaacagagagataaaatctgtagtgtgaacttacgtagaagctacctcagtagttccaataaattatttccataaatatggagtatcatataacaaaaggaaactggattagactgagaatgccttctttgccacgcattatcaacagaaaagagcacaatgtaatccatacttactagctgtcatccctatccaccataaaggttcatataaatatgagtatcctccagaacctgcaaatcataaggatcaataatggattataatgaaagaacctatgtacattctacttgaaacataactgcaggacaagggatttgagcattcttttaagaaaaaaccttctatgcaatgtagaaaatgaattatttaaccagaaacaagaggaggcacaacctgctcttaccccagcatccccagctttcttcaacccaatcttcttaatcacaaagcttgaaccaataaatgcacttgatgatgtggccagtgcaaagcccctcacattgtctatagacatcaccatctctgacagtctatttgctttccaaaacagaagaatccaatatctgtcctacacaacaacagaatttccattcagtaaaccacttcaaactgtttagattccgcgtctcgaagaaacacaacaatgtcgggttattcctattaatggattttcatatgcccgtccctacagaggagaatatgatgtgaataatcacatgtgttcaacattcctattgcagatgctataggtgatagaatcaagtctgcatgtcaaactgtagcagtaaggctcatccataaccattacaagaacaaaaagataacctaatagggacccactaaactagttcaatcgtttctctcagtaaaaataatcgtgggcatgaatttagaggcttagagctcacaagattctgttcacagaacagagaacttctagtttgataagaacaaaaaaagatagaataaacaacctatagagcagattgtcgatccaaacgagtttgatcattcgattggaatcttccaattaaggttggaacaaaagggaaaaaaaggggggagtgcacaggcaaaacagagtgatgaaccagccaaataatgaaaacaaaaaaaaaagaggtaaaaacatacagcaactacagcaacttttagttgtacgaccaacaaataaagtctccaatcgaggttccaaaccatttgatgagaagtcggttccaacggatcgcggaaaatgatcggtcgtctctcatccacttccttcaaaacagtgagtttcattttcatgggcgacttccgtttcattggcacctcaaattacacacacattatgtgaggcacacgaaaaggacacggccaaactctacgaatatagatactagacgataaaaagaagacggccaacacgggaaaaaagcatttttggagaaagaaaggcgcaggcttttgcacggtctgtccaagcagggcaaaaaaaaaaaaaaaggtcgataccgacgaggcgattgcgctagcgatggggtattcacgctccgaattattgctccctcatcaagaactagtactagtagtagtacaaagaacaaaagaatctgtggctaattggcgagcagcaaagcaggaatgcagagacaagaactacacaagcacggatcactaaatcgatttcgtagaaagtgtagcacatgattctctccctatcatcatcaacaaaaattaaaaaaagtcacaaaataaaatctgtctctggtaatggtaaacgctaaagtctcaggattaatctagggttgaaacggcaagaaaaagaaaacctcccgaaacgaaacgaagagaaatcggtattatgactgacagaataaagacccatccctccccactccccaccacggccgctctagggttcatcccgttccacgaggtggcgatcaggcggaatggcgggacagggacagggacagggagggttcacgtacgtacttacggcaacccggggggggaaacgcgagcgtgtgtgacgaacctgccggtggaggagcgatcgcgggcgggggagcgcggaggagacggcgacgacggcggcggcgcggcttgaggaaagaggcggtggtggtggtggcggtggcggtggaaatggcggtggg

SEQ ID NO: 38141 - DNA, 7776 bp, Oryza sativa
agatggcttgaagattaggtttgcttgagcactttggataccttgtgggctgtcacttgggcttattactcttggagatcttctcctagacggttaggtgtcgcccgtgagcttccaaagatcttgtggatgtccgggaaagtttgtgaaggttttcctcacctccgcaaggaaacgaggtaagtgagtaaagattcttgtgctgagttttcagaggttgtcctaggtagagcaacttgcacttgtggtcttttctagaaggacttgtgagttggatcttggtggtcactcaattctaaaaaacgacctagaagtgttgagttgaaggctgtggacttcttctgggatctttgcataagtgaggcaaggggttaatcgagacccggctctttgagcacctcaacggagagtaggatccgtgtgatccgaacttcgggaaaaaatcgcctttatctctcttgtgcatgatctgtgtttgaatctgctggtatcttgtgatttacatcttgtgcaactctgtgcgtgatcgtctctagctaggacctgttttacttcccttatttcgattttctatgttgcccagaagttcctggctcaagaactccagaagttccaggcttcttatcactgccaggaagttccggtgttcttcaccaggaggttccgggccctgttaatttaaccgctgcgattgttgagaaaatttcaggaaagcctgttcaccccccctctagactacatctctgcatgttcaattggtatcatagcaggttgctcttgatttaagcttcaccgctttgagtgatccacgatgtcggacttaggaggaaagaacggggaaaatgggaatgaagatgaagcaagcagcaagggaattccaccacccaagggagctactataccttttgattacaacaaacttactattccctctcacaaccttgtctccgtgccttccgggcgtgctcctcaatttgatgggacatattatgccacttggaagcacaagatgaagttgcatctaatctctttgcatctaagtatttggaaagttgtttgtacatgtattgatatacccccatgatgacatggagctcacgtcggagcaagaacaactcatccaccgcaatgctcaagcttccaatgcaattctctctgccttgagtccggaggagttcaacaaggttgatggacttgaggaagccaaggagatatgggatactttgcaattggctcatgagggatcacccgccgttcgtgaggccaagattgaattattggaaggaaggcttggaagatttgtgatggatgacaaggagacaccacaagagatgtatgataggatgatgattcttgtcaacaagattaaaggacttgggagtgaggacatgacaaatcactttgtagtcaagagacttctccgtgcatttggtccaagaaatcccactcttgtatcaatgatacgggaaaggaaagacttcaagagactcaccccaaatgacattcttggaagaattgtgtctcatgagatgcaagaagaggaagctcgtgaagtgaggcaaatggtgaagaatgcgcccatgatcaaaaatcaagaagttgctttgaaggcaaaccaagaagaagagtcaagttgtgaagaaagtgaagatgaagaaatggcttttattgtcaagagattcaaacactttcttcgcaagagtggctatggcaaagggaggaaggatgatgacaagggaaagaggcaatcaaagagagcgtgcttcaattgtggcgaatatggccatttcattgccgattgtcccaggtcaaatgaagctaaggctaagggaggcaagaagaagccgaagcgtgctcatgtggcggaggcacacatggcggaagtgtggtactccggagatgaagaatatcccgaagtcaagcccaagcccaagtcaaaagacaaggttgaaggagaaggtggtgttgctactatcgccttcaagtcatcctcttcaagcaaggagcgtctcttcaacaacttgagtgatgacgacgacgactcctaccactactcttgcttcatggcccaaggccgcaaggtgatgactcaaaagccctctcacacttctcttgatgttgattctagtgatgaggaaagtgataatgaattagatgatgtgcttaagagccttagcaaacccactatgcaacatttggctaagttaatgagagctttggatagtaaagaacaatcactcgaaaggcaagaagaattgcttattcttgagaagaaaagaaaccttgacttagaggagagcttagctaaagaatgtgctaaaaatgaacaactagctaatgatcttaatttggctaatggttctttagctagccttagagatgtcaatgagactcttcaagagaaatttgcttgtttagacaaaagtcataaagatcttgaagttcaatttgacactctttggaatagtacctctcaaccaaatgtggtttctaattcttctaacccttctactagcaatggttgtgttaggtgttacaatatttatttgaactcttatgctactaatattgatgctatgcaagctcttaagaaagagaatgaaaggttgggcacattagtgaaatatggatgcatgaagacataccattcaaaagatgccctttacaagaccatcaccgctcatcctaacaaggatggacacgggcttgggttttcgggtggaagtcctgtgtctaagcgtgtgatggtaaatgtgaaagaatgcttgatgtttgtgagagaaggaaaagcaccacaagcaagtgaggtgactaatcttgtgagcagccagggacccggaacatccagacaaaccggccaaaacctcctggtgggagtctctgtctctcaaaaattcccaccaggaagttccggccggtttgccaggaggttccgggccaatggccgtgcacaagacatgaccggaagttccgggcataatgccaggaggttccggccagatggtctttactatgattcatatgtaatttccaaaaattcagagggcaaagtggttgcttattttaatgggaattacaatgatgagtaccgcacttgtgtgtggttgccaaaggctttggtaactaacatcaagggacccaaacttagacaagtttgggttcctaaatcccaagcttgatttcttttgtaggcatactcctccggtggttcatgttgggttgtggacaatggttgcaccaatcatatgactggagagaggagtatgtttacaagtcttgataaggagaatggaactcgtgagaatattgtgtttggagatgatggtaaagggaaggtaattggtctaggtaaaattgccatctccaataatcaatctctctctaatgttcttcttgtcaattcattaagctacaatttattatccatttctcaattatgtaagttgggttacaattgcttgtttaccgatgaggatgtgaccgtctttagaagggatgactcctccgtagcattcaaaggcaagttaaagggtgatctctatcttgtccatttcgatgtggatagagtgaatccggaagcttgtttgattgctaaatcctccatgggttggctatggcatcgtagactagcccatgttggaatgcggaatttggcaactcttctaaagggggaacacatcctcgggctcactaatgtcacatttgagaaagatcgtgtgtgcagtgcttgccaagccgggaaacaagttgggaatccacattctatcaagaacatcatgactacaacatgcccttttgagcttctacatatggatttattcaggcccgtggcttacataagtattggagataacaagtatggttttgtcattgttgatgatttttcacgcttcacttgggtgtatgttctccatgacaagagtgaggctcaagatgtcttcaagcgctttgccaagcaagcccaaaacctctatgatcttaccatcaagagggtgcgaagcgacaatggaggagaattcaagaacactcaagtggaggaattccttgatgaagtgggaatcaagcacgagttctctgccccctatcatcctcctcaaaagattcgagatgtctatgatgggcgagttgaccttcttcctcgggctacaagtgaagcaagcacaagagggcactttcatctctcaaaccaagtacgtgaaggacattctcaagaagtttgggatggaagatgccaaacccatcaagactcctatgcctactaatggccacctagacctcgacgataatggtaaatgtgtggaccaaaaggtatatcgctccatgataggatctctctttacttatgtgcatctcgtcccgatatcatgcttagtgtttgcatgtgtgctcgctttcaagcggagcctaaagagtgccatttgattgccgtcaagagaattctaagatatttagttcatactcctaatcttggcttgtggtatcctaagggttgtgactttaagcttttgggctattccgattcggattacgccgggtgtaaggttgatagaaaaagcacaaccgggacttgccaatttcttgggcggtcccttgtttcttggtccttcaagaagcaaaattccattgcattatccaccgccgaagccgaatatgtcgccgccggttcttgttgtgcccaactcctttggatgaaacaaactctaaaagtctttggctacaacttcaccaagatcccactcctatgtgacaatgagagtgccatcaaaatagccaataatcccgttcaacactctcgaaccaaacacatagatattcgccaccactttttgagagatcatgagaccaaaggagatatatgccttacacatgtgagaaccgagagccaattagccgacattttcaccaagcctttagatgagaaaagattttgcgagcttaggagtgagttcaatatcttagattctcgcaatattaggtgatgggtggttggctaatttatagtcaaacatatgtcactaaaatgtaaattaaaaaaaattgagcttttgtgtcttgagatcacttcttgtgtagaagatggtcttgataccaggaataaagctcaaacattccccttttatccaaaatcccttttgtgaaatttttgcaaaaattcttgtgtgtgtttttcttgcgaaaatttggtttttatctccctcttgtgatgtatattgaccattgttatgtattgttgattgttggttggtcatatgcatcataagtcccttcatgtccatagatttccattcctcttttttatccctttccctcctctttgaatttgggcctgtctgcccactgtttgtcaggccggaagttccgggcctccctgtccggaacctccgggtgtcggggaatatttttactcagggggagttagaaaccctagtctctctcctcacttcttctccctccccgacgccagccctagccgccgctacagttcctctagtggtgattttcacttccatccgtggaaacttgattcctctccgtggaatcaaccatagtacaatgcatagccaatctaacgactctaagaggaagtttaatagtatcgccattggagtctttatgtctcgttactgaggacctcgtttcgaaaaaatacgccgtttgggagctttaccgggactaactagtaaaagacctagatcctgaagtatctttaaaaaccaattgcgttctgggaaaagatacaaatttgtacacatcagcaatagatggtaccaacagatgttacggactataactagttgctaagctacatgcccatgcttctctaaggaactgatttttattcttttgatcagacttgtttccctcgacccaatcttgtacgttttttgataggccatggtcaagttattgggcaaaagctaggactgagagctggtttgtatagatctccatgacttgcatcgtttaatgtactagagctcggcgcttgcattagcaccggctgccttctctctccggttttctctctctacgatctgtttgtctgatacagatgcttgtatcgccgacttacaatattctattatacccaaggttgtcattatcaggatcctaggtagtatagttttgctcaaagtagtattttatcgtaggatcagatactatgagattttttttaaaagtttaatttaatatttatattaattacatatagccattctataaaaaatatagtaataatatatgtcatacaaatagagacacttatcaagagaaaaccacattggttttatatatttaactgatttttatataaacttgagcatatttatttacattatttttaaatcatcttattttaaataatattttgtaggattgtatggatcgtagaatcgaagtactacttaagatttcgtaggatcatatatgtcaaggttatggattctatatacccaatagtaatcgactaaactcggtaaggtccaccacataccatgtcttatacggaatcatacctcgtatatagaaggagttccgggtaaggaaggacgagaagagttctatatggaaacgacaaggactacttggatcgtatccatatttatctccctagtcttacttggacaagggggaatctatggatataaatacaagcccccctaggaggagaaaaggacaaacccaccacaatctacaaagccacaagccaatacatcgtcgtatatcgacatcagaaattagcctagccataccccatccagcacctacaggggccggcaagagggatctagcaccatctttgatctcgccgagtacgcattcgaggaggaagactaccatgtcgtcgactacaagttgattatttagccgtcaggtcgtcgacggacagatagattatcctagacattgtatttatgtgatccagatgaataaagagcaacaccggcttcggccaacaggatgtagggctattacctgtaagataaggggcacaaacctgtataaaaatccctgtctccatctctttacctcaatctcgcatataccctggtaccgacgatccccataccatctaaataccgtagtcgcgatatcaaatgtcgacaatatagtaataaatagtagaatcaagatactatgaaaattaggatactacgtgggatcggtatcattttggtttggtaaaatcgtaatattgtaaaatactactccctccatcccaaaaaaaaagacaaactctaggtttccgtgtgcaacgtttgaatgtccgtcttatatgaaatttttttataattagtattttcattgttgttagatgataaaacatgattaacactttatgcgtgacttgtctttttattttttttcataattttttcaaataagacggacggtcaaacgttggacacggaaacttaggtcttttttaggatggagggagtatataatacataatacggatcgagattctgacaacctttagtacacctgctctaaccgattcttaccactcagggggtctcaaaaatataagtccctcccatagagactcactcactgaagccaaccctagtgacttacccctcgtacagtagcagcacacagcccctttcctgccgttctcggccaaaaatcccaccacaatccatcaatcattcgaaccgcgcgagatggcgatgccgagatccatccctccatcccaaccactgaaaccacacacacgctacgcacgtgacacccgtgccgccgcgggagatctgaattctgaccccc

SEQ ID NO: 38142 - DNA, 16130 bp, Oryza sativa
aagtggtaagcgcgcgcctctactcctcctgatccgccgcttgatccgggcgcttgactcagattcgtttcgcgcgcgcgcaggtggggaacgcgttcgtgcaccagtactacaacatcctgcaccagtcgccggatctcgtccaccgcttctaccaggacgggagccgcatcggccgccccgcctcccccgccgccgccgagatggacaccgtcaccaccatggaggtctctctctcttccattccggcctcagatctgggcctccccgtggccgagtgatggttttcgggggagggggatttgaactgtttgttgttgttgttgttgtaggcgattaacgcgaagatcgtgtccatggacatcgtgcgggcggagatcaaggcggtggacgcgcaggagtcgctgggcgggggcgtcacggtgctcgtcacgggccacctcaccgggagcgacgacgtgcgcagggagttctcgcagtccttcttcctcgcgccgcaggagaagggatacttcgtgctcaacgacatcctgcgctacgtcgggggggagggggatcaggaggtggagccggagccggagctggagctgtcgtttccgccgtcgcagcagccggattcggtgcctgctccttcggcgaatggcactagcgtgccgcgggaacagggtgtgtggtgtggtgtggaggagcattttcagggctgtttctttgctgcgagcttatggtcaaactgattgtgtttgcccttttgtagaggccttctcgcagccggagcagcatgtggctgatcctgcacccaatgctcaggaggctgatctcaacggcgaggaggtttataacccaccgaacaacacagaggggcctgttgtggaggaaacgccgattcctgaagttatagatgaagtgccaaataacgtagctgtggctatgccgactccgcctgcccctgcccctgcccctgtaccacaagaggaggcccccaagaagtcgtatgcttcaattgtaagtttttgaacgctgtttgtctttcatccaccgagctgaaagtcacctgtcctggttgatattagaactttgcattttttaatgcttctgaatgtgatcatgggaattgggaggagatatgcatttttcattccttcatggagttctgcatgtgttccaacctcgagcaaacatgcataagtaattgctaggatttttctaggtgcatgatgccttttaatttctgatgtgtaaagcttcaaatgaagcttccagttctgaattttaaatggcactggcacataaattcagctgcaaatgttaataatgcactgcacaataaatatgcaattcagctgcaaatgttaataatgcaatgcacaatagaaatgcaatttagctgcaaatgttaataatgcacttcgcaatacatatgcatgggaatatcattttggtaattgggtaatgggaattgttctatgaaattgaaatgttaattcttgatgtcatgattatctagtttcaatacaagtagcaacttaggtggaagaatttttgaagctagttggtggctatgatctaattgggtaacatgtagttacgttgcatgttaacatttttacatttgagtactaccttgtaagattgtcacttgcattttttgtgtgatctaggtcaaagtcatgaaagaaattccaccacaaatatctgcaattccttccaggccggcaccaccaaaacaagagaagcaagttgctcctgcacctgttgctccggttgctgatgctccaactttcagtcctaatcctgaaagcagcaacattcaagaggctgaaggtattttctagattcaaactcgcagttaaaatcttttttgtaccattggtgtctgactgaaatgttttacaatcattttcaaagttgatgcacatgcgatatatgtacggaatctgcctttaagtgccacgcctgaacaattagaagaagcattcaagaaatttggcgctatcaagccggacggaatccaagttagaagtcacaaggtactttttttttatagtcttacataatgatagagctctaagtgagtcctaatgccaactatttgtctttgtatttccatttgaaaacacagattcaagggttctgctatgggtttgtagagtttgaagatcccagttcagttcaaagtgcaattgcggtaattccatcttactaatctcattgttctgtgatattgaagaatgctcatcatcatttatttcatttagttatgagtgacttgttgcagaatgtgtattttggtgttaattgcattacatatgtgactaaagagttgcagtaagtttgtttggcaggggttctaagtttttttttttgggaggggttagatgtttgtgagggcatatataaacatgatatatcattcttttaatctttttcttgtatgactgttatttgctcatcttttagcaggcagaactaagagaagtatatgcaatgatattgttatttctagttaattaggttttgaactactagtatttataatttacattctaacttaccacacaacactatggttagtttttctttttccaaattacaatttgactatgcctcgtcaaattttcctggttttagaggtataacggaatatataaaagaaatactttccatgctaagctaaattaacccttgttttcctgaatcactagagtcaaccctccctatatatctgatattttctcataaagtgtacagtgcttgttgtcctagccatcaacctttttcctttcctttttttggtggtagcctgatgctgctaagcaacctttagcccgctgctgtctgctcagttggtggaatcaatgccattggaatgatagctgtccgttgttatttgctcgtaggccttagacttgtgctgccttgagtttatgatcccagtggttctggaacgtggatagcttttattccccctaccctccggccccatatatttttaaagcacggaggcattcatggatttggtttagtgtttaaagcttttatgatcctttgtgtgtaacagttgccataatttaaccagcaaatgtggagctgggaggaatgattatcgtattctcaataccttaacacaggcatgccagcactgttggaaaggaatgttgtattttcttgactgttccatttagaaagttaagactatcaatgtgcgagagaaatatatatatagttctgattctttgatttgacaatacattttagtgatgctgataatttgaccatgtgttaactgacaatgtaaatggagatttatgtacaagggagagaatacacaaatctccaccaaggagcaaaactacactcgcgctagttaagaatgcaattgcaactgctttctgtcattctttgctcggaagtgttttttttagtgttggaacttaacttcttcacaagcataagtcatatgtactattactgatgttagaaaaaacactaccttgatacattttcttatctaatgatgaatcagctttaacaagactacaagtgctgatgcgaataccaaaaggagatcatgataagtgcagtcaactgtttttttatctgacaaactctttactctgcagggttctcctgtgacgattagtgaccggcaatgttatgtggaggaaaagagaactgctggttcacgtggtaagttcagaaagcattacaatgtatatcttgaatataagtagcacatgattccatttggattttatggaagaaattccggatacgtttctatctgctgttgaattggcacttgtgacaattgaatatttgacgttgctcacctttcattcaaattgcattcgtttgatcagagatgtgttctgtttgtttgtgctcgcatttattattacaaataatgtcttctgcctatcagagtcgatacacattgcttctcctggttgtatgctcgtaaatttctgattcaagagcaaaaccaaattgctgaacatcgaagtttttctgtggaaccatttgtatgttgcatttcatcgtatcaaattttatcacgtgctatggcaaaaatatacttgtctatctgcctccctattttgtttttttgtcttccttttctgttaagtcaacatgtcctatttctggtttcaggtggtggcagaggaaggtttgctcctggtagaggtggtaacttccgaggtgaaggcatgagaggccgcgggaattacaccggagggaggggctatggaaggggtgagttcaattatcgatccgactatggaggcagaggcgctggtagaggtggttcatcacgtggtggtgatgttggctaccagcgggttgaccactctgctggtcgtgctgctcgggcgccatcgggcactagtgccgttgcaaagtgagcgagttagttgctatgcctcggttgctatgcgtcggtgaaaaagtttgatattttcgtgggttggaattatcaacattcgggaagagggtatgtgttgagttgggtttatgtgagagattatcagcaaaaatcgggtcataaattgaagcttcccttgttttgtggcaagggagagcagtggtgatattggtttactaattgtagcatatacgtctattcagaatttcagatgtagtcctggtaagcttggccctttttggagtacctgatgtttgtttttccccctctttttgtccctcttttctagcaggatcgattctattacgaatgagaggtgatgagttatagattccaaaatttgcatgggagttcttttttgtttgtgatttgtcagtgcaatggtggttagtgttcgctagggcctgtgcataagagcagctgctagttggtaacagtgaaaagtaacatgcaaaaggatcaacagaagcagaagtaatctcgatatataatgccctcagatttacagctcctaaattcttcaaaacgcagaagagagaaacaaatctcgagtatatatcatcaccaagtcatatcatcaaactaaacagatgccaaactgactagtattccctattctgtattgttatgttccaaccaatgtaagtttccacccacgaacaaacaagaacaaccgaacatgccaacatgatactatcacccttccatctcaacgactatcttgccggtggcgtggccgtcgatgctcttctgccacgccttcgccgcgtcgcccagcgggaacctcgagtccaccaccgtcctgagcttcccttcccccaccagcccgaccaagaactccaggtcggccttgttcggcgacagcagcagcggcaccagccgcttccgccgcagcgtcaccgcgtgcagcgccgaggtgagcatggctgagaagttgggcgtgatgtcgatcaccttcccgcggggcgccatcagcggctcgaacgccggccacccgacgccgacggtgcagtgcacgacgccgtcgtacctcctccccgaggggctgcgcatggcggcgccctcgggcgtccggtagtccagcacctcgtcggcgcccaggcccctcacgagctccgcgttgcgggcgccgcaggtggccgtcacgtggaggttcgccagcttggccagctgcacggcgtagaggcccacgccgcccgaggcggcggtgaccagcacgttcagcggctcgccggtgccgtcgaacttggcgccgatggacctcagcgcctgcagcgccgtgcccgccgcgatgggcagcccggcgccctcggccgctgagacgttgggtgtcctcttgacggtcaggttcgctgccgccacggcgtactctgccaatccacctccgttctgttgcaacaggagggatattcagatattggttaaccttaaaattgagatgtactccaagataggattggactgacaatgatgtgtttattttcatgatatagttaagtgtttttttttttttgcagggcatgatattgttaagttgaaatggcaaaccaaaaaacatgacacaggagtggaaagaacttaccatactgttcaacatagcgacaacttgatcacctactgcgaaatcattcactccgggaccaacaccagcaaccactcctgcaacatcggtcactgcaaaatagatcacagagatgcagctattagcatatgttttactggcataggtgccggaagaaagacatgcctaaaatgttttactctctcatcatgtctaaaatgttttactctgtcagatatgcttaattcagttgtgggctgtgtacatccattgtggatatagaggccggattttaatccattttctaaaaaaaaagcttaattcagttgtatcacacatatgaacaaaacatgcaagaaaaatcataatttactctgtcatctgagaattaatactaaaactaagtttatttctgtgaatctttgataacagaaaatacttggtgtgttctagaatctacatagagcatcagtatcgccaacaataaatatacaagacaaatttagtgaaatgtcagttcagtggtaatgctagatgtttcagtttgtggtaatagttggtcctgcgcccgtgtctccatcctgaattctgtatatgaaaagatatgtggtctctccatcccctcacagatttctaattcccaacccagccgacttaaatttgattgtactcctcagaagaaaagatggaaaaattccaccatatctccctgttgcgtacgattagccagccttgcggcggcaaaaggtacatatgaagaagatatagaaagataagtgtttatgattccgcagcaagaatatgtaatttacctgggataaaaggcagtctacgaggcagcagaggacgcagcatccctttctgaatcttccagtcaactggattgatggtcgctgcctccagcttcaacagcacctcgttcttctttgccgaagggaccgggacttcaacatgctgcacaaggaggagtatcatcacataatttgttcacaaatctctttaaagaaatgtagaaacacagaataagaagcaaagtgttgggtgagtgcgctcatgcagggtctgatctctacagttcagccttaaattaggcttgtttttggaaagagttgggtcactcagtcaatgacacacacaacaatggtctgcaccattagttccaaaataaatttacttagtttcatctatattcatgtaaaaaaagttaacttattttgtgatggagggtgttgctgccaagttgactcctgcactctagtttaatagactagattattactatataatttggtgcaggtcttgggacaaagaaaaacttggttcgatttgaaagtgacatggaatttagaacaggagaatcatcagacatctagtactaatcgtcaagcaggatatcataggccgactctctgtaatcctgtaggctcttaaacggttaaacccatgagcataacaatcataaaaaaaacaaatctctatctgagcacataagcacataaccagatgaaccgatatggacttttaatcaatggggtgtgaccgtgttacacagagcacaaacgaattaagaaaagagtagcaaaacaaataatatcaatcatctggccatactgctgaggctatcatcgtttggccaatcgctgataatacgtcaaacggcgtattagcaaaactttcataataacttaaatactaacgttgaaaaagaaaccacgataaataaataaaaacctgaaaatcaactccgaaattaagctttgagattcaaattttagcattggatataagttgtagggcatgaactcatcgcccgaccagagtgtaccgcctcgaacactccgcctcaacgaaattaattactactactacggtactaccactagcagcagagcagaaaaagaaaaggaagcgcagagagagagagagcagtgtggcggagggcgttgctcaccttgagcccggcggctcccccgccgctggcgtcgtactgcacggcgcgcatcatcgccggcggcgtcgcggcggctccggccatggtggggaatcgagagaggaggggaagcggagagacgagacgaggagcggagaggagaggggggaaagacgaaaatctcgccggaagagagcgagagaatctcgtctcgtttttcttcaggtggggggattcgctgcggttgaagcctctggaacacacgtgtgttgttggttactacgccttcgtgtggtacgcgcgtatatatacgcgtaatgaataatttcctcgtgtgtgtgacgcgtattactaatgtggacggactcgtgtccagattcgtagggatatatgaggggccggcgtacgtacgcgtcgagggatctcctgggtttcgagggagggacgcgtcgtgtggcgtgggcccacgctgtcggcgagggtgggtgggttgcttctgcttgtgttgtgcggcgtgtgtgggatgatgatctagaaggtacgagtaggacggagacgagggcgtcacacgtgacatgatgcggcgcgtcggcccggcccggcccaataaaataaatgataattatataaatcttgaataagacgaatggttaaactttagacaaaaaagtcaacggtgtcatacattaaaataggctccctctgtccctttggtaccattttcaaccatatcattttttggtaaagttgccaaaaaaatatctacatttagtttattgctaaatttggtaaatacgtaaaaaatcatgccaaaattttgataattatatcatcttgctaaaattttggcattgccaaaatttggtaaagtttattttagctacaatcgtcctaaatgttttatgccgttgacttttttaaacatattttgttttatttgtaaaaaattaagtaaatattaaatcttttcctatcatttgattcattgttaaatatacttttatatatacatatagttttacatatttcacaaaagtttttgaataagacgaacggtcaaacatatttaaaaatgttaacggcgtcaaagatggaggcactccctcataaggtctttgtttgattaattccatccacgataagattaaggaaaatgtgaaattaatcttctcaatcatcctccagtatcttcactaagtgacttccatgattttagttgtaggactcacacgaagtcacttttggggaatacaatttaaaaatacgattatttatcaggagacacctcacacattaagttagtatttttgtgctaccgaggcgataggggactcaccttttcacatgacgtgatcaaatagcacctgtgtgaccaaagttatttcttatttgggtttaaattttggtgaaatacaaatttcattgaagttaattacaaatttatttaaaaatttcaaatttcattttaaaatatttggttaaataattctatcgctgttgtttttctttttaacaactgaagatattctcaagttatcaattgttttttctatcactgagctaccacaagcgtgagagagggcaataccgcaatacaatcacctttaaagaaaactaatactcaactaacagaggagcatttaaagattaaggtaaaattcgtgaaattgaagagattgaggaaattgtttgtgcacgttgagaattttcacttaataacatgagtcactctgtgaaatgaaggcgatgatcttgtattagagaaaaataaattagggtgtgctcgtttgaagcataagagatagaaaagtcagttcgttttctatgcgcacacttctcaaacttcaatggtgcattttttttaaaatctacataaaattacttaaaaatcatattaatttatttttaagttttaaataattaatattaattaattatgcgctaatggctaactttgttttgcgcatcttctcaatcttcttctttcccctcctattgaatacacccttaggccaagtttgaggagagggaagagaagattgagaagatatggaaaacgaggtgaatcattagtgcatgattaattgagtattaactattttaaactttttaaaatggattaatatgatttttaaagcaaattttatatagatttttttttcaaaaaacataataccgtttagtagttaggaagcgtacgcgcggaaaacgaaaaaaaacaaactcactgtacctccacgtagtgcacatactgttcatgaatgctgaaccgatgaaattaaggctttatggtataagtgcatgtttggaagagcttaagatttttataagcagccggttgatagccaattcataagaatctaaaaaagctaggttcacagcttctgtcttttagttcattttctttattccgcaactacagcttcttataatatggttgaaaagctagactgtttgcatgggcagaactagaacaaaatggaggagagagccactcgcttactttactctgctttggatggagtttaaactaatacgggtgcctactcactccgtcccataaaaaatcaagctagtacaagatgcgacatattctagtactacgaatatggacatacctctgtccagattcattgtactagaatatgtcacattcagtcatagattcgattttttcggatggagggagtaagtttacactgaagggttgcatatatagtgaaaatatatgaattatagctaaaaacttttcttgaccaggtttctgagcaacctctcttgaactatagcttcaccctactgtttggggagcttctgattttggaagaagttgtagctgccaaaagcttctcaaacaagctctaagaatggatctgtcataacaaagtttcataaatactttccaaaattttcccctgctttttgtaaaagggagttacaacgatagataacaattatttggagctactgcaaactcatttgtacctttaaccaatgaacagataaacaattctaacaaagttagatcatcaaaatgaacttatacacttgttatcttattatctacttcctccatcctgaaatatgttcatttttcatacatgccatacatactatacaaaactaaaataaccagaatacccctagctaatttatcaaattctcacttttaactactcccaatacaatcacactctactttcacaaattccgatgcaatgaatttattttggaacaaatgggaggaggtaaaaatgaacttattacgagatggagggagcaactactactccctccgtcccaactcccaaaatataacaacttttagcacacaggatttgtcataaaatataataatttcttcacaaacattctcttcacaaccaatcgcaaccctccaccattcatttttctcatctgtctctacttctcaactaatcataatctctcactatttaatctatctactttcttaataaccatgtccgacgctaaaactttctactacctccgtcccaaaataagtgcagccgtggaattccatgtctaacgtttgactgttcgtcttatttgaacaatttataattttttttaaaaaaaatagtcacacataaaattctatttatgttttattatctaataataataaaaatactaatcataaacagaggaagtatctactatatatattctaggacgaaggtagtagtgctttacatgctcaaaaacatatgcatatgagcagcaacaagtagcgaacatgagcctaagggagagttgagagagggaaaggagaacatatgtaaaacaagatgagtaattagcacatgattaaataagtattaattatttaaaacttagaaaaaatatattaatatgatttttaagaaactttcatatagttttttttaaaacacacactgatcagttatttattagtttgtaaatcatatgtgcgtaaaacaagacaaatcttctcccttcccatcctactagagtaggagttatatgcctgtgcattgcaatggatttataccattagaaatagtttatgtctgggatgtggatatgacacaaaacagaacctttttatccaaccattttttttatagtaatgtacccttcacaatggacccgtaccatcaaaaataggctagaactataatatgtggattagtataagtaggaactatttttatccaaccaggttttctcttttccgatttccttagtaaatttcttgttttttctccctttttttccccttatagcgaatttaattttttttctatccaatcaattttcggaactttctgattttcttagcgatttttttacacggttcatgcaggaaccattttcctccattttttctgcttttcttagcctaagaatcttagggattttttttttttgcggagtgcagtgaccattttctctatggttctttttagcgcgagggtggaggcgctgggatgagaatgattttgtttgtttcattgcagcagagaaacgaactcgaccatgtttccttagccgattcagttggaatttcccggtgcctactcttcctaataggtcccatacagaactgtttgcttataggcaacctatcatgaatcatattgaactcttcgtatcaccattgtaaatttgtagttagtttgtagtgatatgcgaaaagtttcatttatagaacaatttgctactacaacatgcatatggttattgagatgctttatcttttgtcgctgggatatccacttaggtatatatagagagatgaaccacgcattaatgttacaccaatttatcaacatttcttaaaacaacgacttatatatatagttatattgtcgagtatctattgatgtgcaagcacatggctttcgaaaaaccaccctgtctaaatttctttaatttgaatgttccacaatagtaaaatcaattatgatataatatctctacatatcctccaatttaatgaccggttgtacaaatggaatggacggcttccatgatggacttctgcacattggcccttcagaactctatttgcttttcgacaaaatttcttttgaatcttgtgatttgccaaaggaccaacagaaggggaaaacatttgagaagagatatgcccatatatcactactacacaaccgatttttgcatgcggctaatatgatttttgcgtgcgggtgggcggcccgcacgtgccaaggggtctgggaaaatcacgattttcgcgtgcgggtgcctcacccacacacgaaaattggatttttgcgtgcgggcgcttaagccgcccacatgagaaaataaaaagtaaaaaaatagaaacaaaaccctaaccctaatccgtcgtcgccgccgctgccctagccaaggcccgccgccgtcgcccccgcggtcgccggctacgaatcgccgcccgctcccgtcgccggcgccggatccgtagtcgccggccgaagacgccccacccctccgctggatctgcaagggaaggggaggggagccgagggagagggaggggaggggaatcaactcacccgacgccggcttgtcgcggctgaagccgccgcacctccatgccagccactgacgccgctgcacctccaaatccacctctgtcccaccgcctcccgcggttgatgggtgcggccgcctcctgccgccgaggggtgtgggtcgcctccctcccgccgccacacgccgcctctcaccgctctgccggatctgccggttccccgcctcccctccgccggattttcaaggggagggaggggaggggcagccgctgtcgatgaccttcttgtcgcccgcagctgagggagagggagggaggggccgagcgccgccaatgtatcacccgcagccacctgctgtagccgttggtcggccgagagaggagaggagaggagttggaggagaggagtggagtgggagagagggagagagtgaggtggaagggaggttgtgggcggaggggcgcgaaggatatcgagctcgatgtattttcgtgtgcgggtcatttaataggtttatttttgcgtgcgggcctgttaagtgacccacacataaaaattgattttcctgtgtaggcgatggcctggcatcagtccccccattttcctgtgcggttccacttacgaaccgcatgtaaacaaaaggggccccgtccaggaaaatcaatcctgcagtagtgtatatagagacagctacgcatttctttcctttttttttttgcaggcacgagtcttttaacatttcacccttggtatgtttcatttgaacaaatcagcaaatagttaaatcaaacacaaataattttatcatgttttccaaagttaaagacatgttgtaaatttgtagcaatagaacatactccctccatactcgtaaaggaagtcgttttggacagcgacacggtctccaaaacataactttgacttcttatttctataaaaatatttattaaaaaatgatatatgtatacttctatgaaagtatttttcaagacaaatctattcatataatttttacattttcaaactcagcaattcgaaagttattcatgatttacattcccaaggtttgacttaagcattgtcctaaacgacttcctttacatgtacggagggagtacttcttaatttgattctgaattcagaatcagatttgtccttttgacatgatcttgtggatgttcttatgtagtttgctccattacattgtgagggaagaataactcatctccaagaccatcatttgtatgacagacttgaaactaggggtctgatccaaaatgcagaggacatcagttatgtcagttgaactataatttaggcgacaattagcaacagaaaataatatagcaattatacttctcatttcttgcgtgagattaggcatacaactggttagtatatattattagttacatgtcacataaaaaagagcaatgatgtgtaacgtaaccaaaaatatatattgtaaaattgttgtacatattagatagctagctctcgcttcgcatcggcgtcgttaccataacaattgcaattcgtattagacccaaccgctaatgttttgttactataactaatgatacaattcaacatatacatatatagtttggttcaattttatatttcacatacaaaagaaaacaaatgcagatttggatcgaccaaaatctgattggttttgagagaggcattgattcttctttttttttttcatataattaggtaataaataaattttttattccatcatatttggcttgtgtaaagcattctgcacaactaaaaaaaatacatcagagatcgttataaccataagagaaaaactacggaacggaataccgttccaacagattggagcggaacaggcgtacatcattcttttcaattcacgtcgcataaccctccatgctcgactatccactctctccaatcgtgcgtagtctctttgcatgggctgctccggctcatcacatgctctagccatgcactacatgtctacatgcatcgagagttacgagcctttagtgctatgtgtaagcaagttgggtcatgcaactcgtgcccactgaccaggccatatatacgtgcatggttaattaatttttttagttaagatgtgctatccatctacacagtatatgatgtgtgtgtacgagtctttaagttactcacaaatctcttgtcggcctctcataagtactggtataataatagacatccataaatttagtacacgagatggtaccatgtgatacctcatgtatcattgataatattttttatgtatcaatgatgatacttgatatgtatcactgagtgatgatacttgtcaagtaccaataatgatactcgagaggaatcattaagtgataatacctgtcaggtatcaacaatgatactcgataggtatcattaagtgatgatacctatatatcaggtaccaacaatgatactcgataggtatcgttgtcaggtaccaacgatgatacttgtagatatcgatgataatacttgctaggtgtcaatgattgatggtacttaccaggtatcgctgatgatacctgtaggtaccagtgataatacttggtaggtattatgaatgatgcacttaccaagtactggtgatggtactgtaggtatcaatgagtcattatttctatcaggtactggtggtgatacctacaa

SEQ ID NO: 38143 - DNA, 11999 bp, Oryza sativa
ggattttgaccgaccgagcaaagatgatttctccactagtgccgccacctcctcgtagcagctgctctacggcatgtggcgacgtgaagatctcgtatcctttcgggttcgaggccggctgctcgtggcctggcttcgagctcatctgccgtgacaccatcaagggcaagaagcccttcctgccaccggtcacggagagcgttggatacttggagctggagagcatctctctgctcgatggtaaggcacgggtgtggaacaacatcagctcctatactgctacaacagcgccactaaagggatgacaaatgagtccagcgacacggtctacctccccggccgaggcatacaggctctccgacaccgagaataagttcataatcgttgggtgctacacggtggcgtacatcacagttggagacagggaggacatgcggtacgccagcgcgtgctcggcgttttgcgggccgaaaggcaataacttgacgagcctaatggatggcgcctgctccggcacaggctgctgcgaggccaccatcaccgagggacacacctcctacaatacgatgtttgatccggactacaacacgacgcagatctacaatgttagcagctgcagctatgcggtgctgatggagtcatcaagatttagctttcggaggagctacgtgatgaattcatcgcagttcatcgataccaacggcgggcgggtgccaatggtcgttgactgggctgtgcagaacgcgagcaattgcgtggaagcgcagaaagatcatgactcctacgcgtgcatcagcagcaacagcgtgtgcgtcaactcgtccagcggacccggctacatctgcaactgtactcatggataccaaggaaacccttacctattacacggctgccaaggtgaatatgttaaatttctatagttttcatccttaattacttattatagtcatggaatatttctcgatatttaattattcttttattttctaaataaatttaatattccactgtagatattgatgaatgtgaagaacatgagaattaccattgctacggaacctgcaaaaatatactaggaagtttcgaatgttcatgtcctgcgggtacccgaggaaatgcctccattgaaggagcatgccaaaagaacttcttaacacccggagtacgagtggcatttggtacgcaatataaattccaactctatgtttcagtaacttgtacgattatataaactttcctcgtataatcttgtagcaactccatctttatttttaactaggaaggtaacccgcgcattcgcacgggcatatgtcatatgctaagttcgagtattaaacggagaacatctgctacgatttctccataaattgttttcatcggcattaattgcttttataaatttctaacctattaattttatattgtatcatatttaagtaatatatataagcaattatttataatcttctttatcatttgaaattaaggaagacttattttttttagaaaacatgtcaacgaaagtaaaagtaaggtgtatttttaattgcatatctattgtcatagttcattaaagaaataattaggcggaacatgaagctccaataaatatatgggtttgtatagcctaatatgattgatgtagtttgagtggtgatccataaaggaacatttcatgtagggtgggtgacaggctccttgcagcctaatatgaatatgataacaacgaaatataattgcatagtaaaaatttggaaatatcatgtaccatgaatacatgctttttatatatatataagatagatctaacgattataactaatagattaccgatttaaaaggcatatgagtattgcaaagttattgcaaagtgagtgcacctcaatcgttacgtttcctgtgtggtacttgcccactcgggttcaagtcctagatttgatacgggtgttggcatttacggctaattatttttttaatggtaagtgatgtacccatcgatggcgaggtgacatacccatcgatagcgagacgtcgtggtaacttcgtcaatcaaaaaatgtactggctcagtcttttggaggtactaaaggggtagggtgcatgcgcgctgtgtttctaaacaaaattcaatattattgattgtttctgttttagttttatagctaaaaaataaggaggggacggcaaaatctatttgattttttcttaaaaatgtatggattagtgaacaacagctagtcgatagaatatttgtaatgatttttttaataatattgttaacttgttctttaattttaaattttatagtaaataacctaatttatctcctacttaggctacattcgatctcattagttgagattatgtagggcactcaaaacgatgtaggccattaatgaacgattaattgattattaaatattatagacatgaaaagagttttttttttaaaaaaaaagtttattagtttggagaacatgctcaagacaaataagggatagccaattttataagcactttacaactcaaccttaaatttgttatttatgtactcagaaaaagtacaaatcaaaagcgtagattgagtcattaacggctaaaatcctaaccgtgtttagcgagaaaaacattcgacatatttttatacaatacattttttgttttgtgtttctgacaatatgtcttaagtaatatttaattactcattatttcatcctaaactatcaatttaggcccattgatacaaataaattctatctatactcaacaataatattctgaaatgatacgtttatttgatattttatattatattatacatctatttttggctgtgtatgttttgtcaagtaatatatttttcttatactatcatcttcactaaatatataacgttggtcatcaatatataaaaaacaataaaaaaatacatatgaactataatagaaaatccagtttaaagagtattgttttctttcggtagtttcactaaatatttaacgttggtcgtcgtaaaaaaatacagaggtagtgaaaatccaagtttaaaaagcgatgtttttttttcaatttccagtagtatgtatgtcacgcccagaaatttagtccaaatttccagactattttgtgtagtaaatccctgtccaggaccagccagggtacacaaaacgacaagtaataaacaataccaaatgtaaataaagcgtaaaatacttacaggagaggcacttagtcctcacaccgagacaaaagcagcggcagcggaaaagacgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagatgtgcaaggggatacaaggacggtttgtggctatttgcataaagacagttgtaaaacattttattgagcaaaacagtaaaactgttgagtaattaaagtaacattaaatctccactgatcaacgctacaccacgttgaacaggcccaaccaacccacctgaaccacagtgcattgagtcgatttattaaagtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacatatcggaaagaggccgtgacaggacccttcgcataaccccctctaatcaagcacaccacacctcaggtttcacccccaatcctcgcaaggcagcgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatttagtcacactttagttggataattacgaccatgaagcatggccagatgtctcgagcacgcagctcattctgttactaaaaggtctaatactataattatcccatcaactgagctagtggtaattaagcatggctaagcatatagttctagctaggtcacataagtaacatgagctagtcgatttattacccaaggttgacaaaggacagatatcaagtaaacatggcacaagcgagcagataggtaatacccggatcccatgtaattagcaaaacatgcatatttatttgtaaacggtaaaacatttgtaaagtaggctcaatatgctcaaggggaatgtgtgacttgccttgcttcttcacttggatcttctgaactcttatccttgcgaacgcgatcttccgaaacgacgggaactacacgctggcacgcaaaacgaggaaaaactctaataaaaaccaagaaaacagtacataaaaagtaaacaaacatgtagagctcaattttagatgaattttgcaagttgaatggcccaatttggagttcgaatgaattagatatgaattttagaagttttgagccatttaaattaatttctagaattaaactcgatttattgcgcaattattatttaatttttcaaaggaaaaaggctgccgctgacgtcatcaagtgaggccggcgccgacaggcgggccccacacgtcagcgggtcaagggaatcggtccaccgtggaccgggaccacggggtggtccaccgccggtccacgggaaccgacggcccagatcagcccgagctgatcgggcggccacgaggcagggcgcccagagcacgggcacggctcagtgccggcccggccgagcgatggcgcgcggcagcgcggccatcggcgacgacggccggcgacggcgcggggaggagaggagggatgctcaccaagggcggcgacggcgagactgcaacggggaagccggcggcgggctcctcggggaggcaacggtggtccggtggcgtaccacggcgcgaggcggcggacggtgaccgggacgaccggggcgcggagagggcgatttcagtggttcccggaggcgaggaagcggtggccggggtgtggctcggagttgccgatccgagggaggaaacggcgcagtccggcgtcgaccggggaggcggggcgacacagatggagacggcaaacacggcggcgatctcgggttggtggtgaagttggtgctcgggcagcgaggcgcgacaaccgagcggcggccgagcttgactttgaggcggcgaaggtactggcagtggtggcgcattggggcgacggctagggcggcggtggcgcgcggctggaggcggtgaaaggggcggcggcctcgggtgtacagtgggagtggtgttcgaggggtggagagggggaaataagaggcggccggacttccccttgcggtggcgaagctggcggtggcggcggctcggcgcggcgacggctgtgcggcgggaaacggcgaccggagttcgccggagagcggcggtgcgtgggctcggcgcggggagagcgagggagggcgcggcggcttgggaaaaatgggggaaaaggatgagggaaggccggggattgtttttataggggaggggaggccggatcgagcccgggagaggcggagtcggggcggcaaccgccggtggcgtgggcggcatcgtggggtgtgggtggcggttttggaggggagaggtgggggaaaacggcgcggacgtgggcggcgaggtcccacggacgagcgcgcgcgcgcggggtggaggaggtgggcggaaacggcggcgtcgtggggtggctcgggcggccatggcggcagttgtggccggcgtgaggaagggggatgggcctgacaagtgggtcccgcggtcccacttgtcggcctaagggagagagatgggagagggaggcaaaatagacttgcgaaagggagcgagctgggccgaggaggggaaaggagggattgggccgaaaggggcccaaagagaggaaggattttaatttgttttcttttttttttatttaattgattcaatgaactttgtgccattaaaattatttcttgagctccgaaaattcacgggaaatttcagagagtattttagggcacaaagaatattgcaaaatattcccggccaatgatttttaagggaaaattttaattcttccattatttcacttgattaaattgctttaaattttatttaatttctagaaaatgtattattaaatgatttttaatcccgaacgaaaatcggggcgttacaatgtacgtataacgtctgttttttgctgtatatcatttcttcttttctcggtcgtggttgttaattcgtacatacatatgccttctcagctttttctggtcaatattttttatgaaaagttttactggtaaattaggagggatagattactatttatatataatatatttataacaaatctaatctaatggtttaaactaatgggtccactaacttaaatgaaaatcgggggctagatttttttcttttttcctcagaatttctaagttttttctattttattagagctccatatgacaacttaagagcgtttttagagcaccatgtggtagtatgagagcgtttgtaggaagtttaatagactttaaattagtatatatataatagacaggttagtcataaataatttcaagatatatataagcatatttgcacgatttagatatatagttgctaaattttttaacatgaaattttgcttttctaatcaataaagcatgaaaatagataaagaatataacgaaggatgatggtactgtagataatggcacgtacgtacctacattacatataggcctgagcggggccggtttaggagattgattttttaaagataaatctaatggttgtaataatgggtccaccaaatttaattaaaatcaatagctggatgtttaggaatttctctaatttattatagtgccacatggctgcttcagagcgtttgtaggatgccacgtggcggtttaggagcatttgtagaaagtttaatggacttttagtatataataataataataataataataataataataatagtccatctattatacttataatacttatttattatacttgattgatttatacttgattgatttctatatctcgaactattgttgacgaaataaagaacatgttaggagtgtatatatggagccatgcataatggcacggaagaggtgtgcaacttgatggcgtatttgcttttttagattgttctaatttaatggtttaaaattatgggtctaacggattaagggaaaatcgatggttaggtgttttgtttttatataaaatggcttttatatgtaaataatttattatagcgtcaattggtggaatgtatatatgtacgtaaagataataacctgttgttcactgaggtacatatacacgtatgtttcacattatatatagctaatcttgccagagggtcgtaactaatcttggctgccatttaaaatttgttttgacggaactaattttgagataaatatggcaaggcccaagatcgttttgtcagacccatgtccgacgtccccacttgcgtattctaaataaggtaacatcgcgtgggtccttgtcttctcatgttgcaccacgccgcagcttaggagcgtttgtaggatatccacgtggcgcgttgagagtgtttataggaagtttaaatgaacttttagtatataatagataatagatagatagatttctccataagtaattacattgtaggtagggaacgacccgaacttatgactcatttatggtttgtttctcttacaaatgataccataaattaaataacacatcgatgtctgcaaatatctatctacagaacatcttagggcttgttttgatggcatttaatctttggtgcactatttaaattcttaattctggatacaaattatccccaccataatccccatgacccaaacatacaagttaataggttaggttgaggggtattgaagggggttggggatgatgagagaaggggattcacccaatccacccccatgttgccaaacaatgttttaagcctttttcagttaatctctctgtcaagtagattgaagtggatttagagaaaattaaggtgtggacttgttcaattaatctccttgaaaaaaggattggatgaaattgaggggccctcaaaatcccatccaattctctttgtgggggtgggaggttgcttaactgaaaaagaccgaagggaatgattgtttgaacacactaaaacttacggtttgcttaattgtgtgtcctagactgttaagtacaacatgtacattgatgccaaaatattgaagttcaaacatatgattaagccttttcagtaaagaaaaaactccgtcctttcagggcttgttacctgtgtatttgttggtctatttggtttccttggatgggaggtgatccggcacagacagaacacaaaaaaacaagctctattaagacagacagatgaattttttcaacaacatggaggtcagctactgctagaaatgatgaaggtagagggcaatgttgggtttaccctctatgagagagggcagatcgaaactgcaacaaataacttcaacaaggcacacattgtcggggagggaggacagggaacagtttacagggcagagatagatggcactattgttgcgataaaaaggtgcaaggagattgatgagagcaggaagatggactttgtacaggagctggtcatactttgtcgtgtcaaccaccctaacattgtcaagctacttggttgttgcctacaatttgaggcacccatgcttgtctatgagtttgtgcaaaatagaacacttcatgagctattggacttccaaaggaacaggagttgccatgtcactttgggaacccgcctgaggattgccgccgagtctgccgatgcgcttgcgcatctccattcgttaccacacccgatactccatggtgatgtgaaaccagcgaacatactactcaccgaagaattggttgcaaaggtgtctgactttggctgctcaacaattgatgagaaaactcaggttgcgcccaagggcacacctggatatcttgacccagactacctgcttgagtatcagctcacagctaagaatgatctgtatagctttggagtaattctggttgaacttctaactggtaagaggccactatcaaaagaaaggaagaccttgacctcaatgtttaaggaggctatgacggatggcacactcattaaactccttgatagtgacattgttaatgaagacaacctgagagtgatccatcaggctgcagtgctagcgagtcagtgcttgattattccaggtacggcaaggccagagatgaggtatgtggcagagcagcttcagcaacttgcatttgcagatgaagtgcagcaagatccacagccaccgcttgtgcttgcgggtcttaggtttacggcagagatggcaaatacacgtacaacatcctcatggcaaactgatagcaagactaccggggtttacagcctcgagaagaatgttagactttgctctaggatcacctaggttagatctagtcgggtggttctatttgggattgatgtttgaactatagagattgaaaacgggagagggtttagatagaccgaccggttgaggagttcgtggaggaagaggcgccggacatcgtcgttgtcgtcgcggcttgacgtggatgcgacgccggtgaggtcgacggcgatgacggctgcggcagtggtggtcgtagacgtcccggcgatgaggcgtggcgcggcggtggcgtttcccgtcactggctgcgccccctctcgatcggattagggttttgtggggtggagttggcggcggcggtgaacttcgtaccttgtgccgtgccggcctccacccctcttttatatggcgcagtgtgacgggggcccaccagccattgggctgggcgcccccgatcagggtgcggtcaaggcccccttgagccgttgggctcaaggggagggagatctatctaacattctcccccttgatctcactttttcttttagctttttctattccatcacagatttgtaaatatagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagcgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttttgtaagacagcatgaggccttttgttccttgcaaataacgcaagactttctttaccaatttccagtgctctaggcctggattactctgaaatctgccaagtaacccggtaacaaatgccaagtcaggtcgtgtgcacacttgcgcatactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttttttgtttcctgcagtagactgacatcactactagccagtagaatgtcatccacatacagaattaggaaaataaatctcccattcttaaactttgaataaatacagttgtcctcgacattctcttgaaacccaaatttttttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccaactgatgtaattccaaatcataatgtgccactagtgccattataatcctgaaggaatctttacaagagactggagaaaatgtctcattgtaatcaatcccttctcgttgtgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattttaaactttatagtcatcac

SEQ ID NO: 38144 - DNA, 3317 bp, Oryza sativa
ctcctctggtgtggcaaccatttctgttgaatcctgtataacaggttccctcactctcattcattgttgccacaggaggggtaacaacaggtgttggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcagctgactgttttggggtccaacttcccaatatttgggttaaatactttggcctctgtaggactcccccacacacggaggtgagttagcgagggtactcttcctatccatagctcatacggtgttttgggcaccgatttgcttggaactctgttgagaatatgaatggcggtttttaacgcctccatccataaaccgagtggtagtgtggagtagctcattatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggttagatcttactactttaatctttatatcatgctgattttcaacttcagctttgaatatcttaaatttatccagtgcttctgatcgctctttaattggataaatataaccatagcgggagtaatcatctgtgaatgttatgaacgagtcatagccatccacacttttcacaggaaatggaccacaaatatctgtatgaatgatctctaaaattcctgcgcttcgttttgcaccctttttgatgctctttacaaattttcctttaatgcattctatgcattgttctgagaaccccaatggaggaagaatttcattcttaactagtctctcaattctccccctcgaaatatggcccaaacgacagtgccataatttcgatgagacatcgggagttcactttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagtttctttgcaaagaaggaacataaaagacatctcgaagtaaaagtatgaagccattcgcgagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctctcttgtagtgtcctgtcttcttgcagtggagacattgatctttctcaacagcgaactgttgttgctgaggcagatgctgagactgtttaccttttgaggtgggagacttgtggttttttttcttatctttaacatagtttattgaaccaccatttgattcgttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgcttattctaagtatgtggtctctaacaccacctccatggtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgataagttcagcaagttctataggacatggggtagtcaacacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatagtatgcattaagcctacatcaccgttgggcagaattagacataacacatagccataactataacattgcaattatcaacgttggtcagaaaattacaacatcatagcacataattaatgttcctaaaattaaattctcccgttggttcgaaatttaattttagaaacactaattttcatcaatttcatctatttgcagcggaaaaactatataaaatttatatgaacagtagcaaaacactgtaatttactctctgcaaaattctcccgttggttcaaatttaaacagaggtaaaacatgcaaaaatctattcaaaattctattgaaatttgcatgaaaaatcgacaaaataaattggaaaaaatgctactgttctcttttctttgttttcggccccgagggacctcaaacagacttttcccggtcggcccgcggccttttggcacgggcgggcgccccccttccccaggccgcaacctgggcctgggccaggaaagcagccccccgcgcgcgccctcttgggccgatttcggcccggccggcgtcgaccgtccgatcagctagggtttcgatcggacggccgggcgccgagatcggaggatcaaaacccccctctcccggccggccgccgaaaaccctagcttctcttctcttctctctctcacgcgaccgcgtggacggcgtcgccatcgccggcgaccttcgcgcccgccgcgccatggccagcgccttttctcttctcttctccccccaccgtctctcgccctccacccgcgaaaagtgagagagagaacggcgacgacggagatggcggcgccgccgcgggccccctcg

SEQ ID NO: 38145 - DNA, 12546 bp, Oryza sativa
aaagaaagccatgctaagcacagaactggcaagatgatagatatcttgcttatatatctgcttgatccatcgacgtcatctatgtaagtgagtgtttggcacccagtccatgtgttttctctattcgtataatatttaaatatcaaagattgtatatattcttttcacaccgtactgatctactttatcttctacttatgcttcatttgatctagctggatggctgtaactggatggctgagcttattcaggatacatgaaacgacacatatcattagtgcaagattaattaaatattgaatataataaagccaaaatagatttatttaatttttaaacttttatataaaatatattttaattatacacaagttgcttttaaatatatacgatgtaggttatggttgtcaatttaattatagtgcataaaatggttcagatggatttagatattattatcaaaagatatgtcttttgtaataattcctatatcaatgggtagataactgggaaaacaaggagtaaccaatctgataagtactctagaacttattgcttatttactaaaatgtttaatgtgtagtatataatatactttatgaataaaaaaatatcctaatatataatcatatgccaccacttatccataagtatataaatactatccactaatcgtcaagtcatattgcttacgaggtattcatgcatagtgcacctaataattagctaccatccaacgagcacttatgtcatgaagcaccatatataacggactatgctaagtggagaactatcaacaaatgataggtaaagtaaagcatgccaccaagccacagcaaataataatcgactacaagtatattgtcagtataagcaatagaatttctacacttctacaagaactcttaatatatcacgtaatagatctcataaactagaaaaaaagtataagaaaaaatataaaaaagaaaatatctggtcatcaatttacacttcaactggtagatccattattttcaaccattatattggatatattccagctaaaaaccaactaatctctccctacgtacgtacctatacaagagatgtcgaaaaggaaaaaaaaagaagaatgtatatatgatctgctccgtctggttgtttttttgtttctttctttgcagcactaaagttttcctcaaattatgcatatatatagtgaaactctttacgatgttatcgaaaaagtcatgccactgtggcatcgcttcatgccatcccacaaaacttttttaaaatatttttttaactaatgatctaaaacgaaatcatagacactcatataaatatgtgcacaaccatcctacgaatatgcgcagtactattcacaaaaaaaatacatacgtacaataaaaaatgtcgcatggaaacctattatatccttatataagtatgtcattctcatctaaatagtgttgacaaaattagcacaaataattttgacaatatgaattattccttcgaatattacccatgaatatacgtaggtgacttagatgtatagtaaaagaaaaaaatctaaacccatattaacctgtatgtttacgaaagatggtgatatgcgactttatgtatagccatgacaaagtgaaatttgtttgaatataatagatattatcaattagtatatcaaagtttataatttatttcacataataaatatttcttattttatattataaggtaatctatggttcttaaaataaatacggtaacatatggtttattttagtattctttctataaacaaaaaaataaattgcccgcgcatctgcgcgggcttcctttctagttgatcaaatggacaaatcagaatccagtatgcatgaaggccagaaaaatttgtaggaaaacacaaaaatgcatgaaggcggacaatataagaccaaaccattgtactcgataaaccggatttcctttcgtattctgggtagcaaacggcacaagctctcgccgtagcagatgacacaactggaagaaatcgcatgcatgagctttgttggatggccaatttccaaagcttcaggacaagatacagcagatctttcttcctcaagagtcctcagcaggagaggcaacaatgttatatcattctcacatgcttcctcaagaacataagaggaaattatctctattatgggcattgtttttttcccccaaaggaagtaattagacaagcttcactcttcacacaagttttgtgatgattcactactcaatattatccacgataatctgagtagtgacaagttattgttgtccggggatgacagtttgtggattgctacagagcttgcatgagctttgtattatctccattttgcaacaacaatatcagtttttcttttaaattttgcttgcatagggatctcaatttcaggacaacatctagatgatatttcgatcatttacctgagataatattgcaacctcatttgatgaattgattaaactatttttaccgtgatcttaagatttttcatagccttggtcagataagattccttcttacaatgtaagatgctctgctacctagaacacatgttggatcagagttatttgttgcgttctttagtttttccaaagaaaaaatctttgtgctatcactggcattttcatcttaagatattggtgattctagaagaaggcccttggtatttcttaaaatatttcttctttgcttttggatataccttctatacttgcagaaaaggaatacccccacacaaacgtagaagaaaaattccaaaggcaacacccagaccaattaatagcattacctacaaatagtgtttcccatatgtcttcccttttattttattttcttaattaggtctcttctaaaccgttattacaacactacttgaatggctggtgcaagattaaacttttgaacgttaccttttcctttcttaaagagtgcacaaaaattaccaataggatgaaagccagagttccaaaaggggaaaaaaataagaatctatacaaaagaatttcctgataaatgataattaatctttttctgtaaagtggtgagaatggaaaatgaagtccaatttgtatgtagttttgaaaaaagatccaaatgtatttagttttagcctgacttgtgaatcattcatattgcaaaatactcaaattacaaaattaaattcattggaagagaaaatcaagtacaacacgcattgtatggtcttggacgccacatatgtgctaatgtgcattatgttgtttttgtatttcatagctaatagtattcatagaatatgttaaactagaggtgcaaacaaccttgatcagctaaaaacatggctcattctaatctgtttaaccttagtagtacgtgaaatttaagagacggtggctaactgaattgttgttgcatgtgcaatacttttcaatggactcatttctactctttttataaccttactagtacatgtggcatcatgcaggcaaaagtgggtgcttaccgagcacaaagagcccatttgccacatgctttattagaatagaattgcaaggctagaatgtatttagaactccatgaaaaaatagggatgtatccctgaaagaaagtacagcgatatatagagtcaggggcgtaatagctctttctgcctcaggcaatagaggcatttgtcatcatcgtcgttgctccctcccaatgttgttacatcaaagaacaaggcaaccagatctggccacccctgaactcgtggcggccatatttgactacccctgggctcatcgcagctagatctgacgacctaacatcgacactggaccacactaggacaaagatttctgctagggctgcagtggaggaggtgagggcgaagcgatttccacagcggccacaaagaggtgggggaggaggtctccaccggcgcacacgggacccaaatgatggtggggacatggaggccggcgagtaaagaatgagttggggagaaggggttggagacaacaggagacagataccaccacacttaaagaatatcaccctttgcctggcgcagcttggctcagctagtgctctgcctagattgattttctgcatcgattcctctaaaaaattgccactagtagttgttttggtatgccagttcaactaaaaagccagcactaatgtgggatcatcagtgctagtttttctcttctcattgcacgtatgagtcctagaagttaggaaaccgctatcaatgttggttcttgcttaatcagcattaacagggcatcaagaacaaggagttctatggtagtggcattgtgttctgctccaaaatcacactcggcaaccttactcgcagataattactttatgaactctgctagtgttactttggatgccattacatatgtttcctccatcttgattgtgcagagtcattaccaaacccctatcccccctcctctcctccatccccacaagaaaatatattgcacccaaattcaaatccatagcagattatttttattttgtatgtcaatatttcggtttaaatgagggcctatatagaatatacaactcgcattggagtttaagtagtaacctcaaacaagaataaatgatggataggtggacatcaacatagaatttgcaagctggcaaaaatatttccacactttacgtttcacggaataaattaagagattacattttcattgttgtatttggagggacaaatgaggcattagaaaattgagatgctaagaaacatgcctggatcaattttacctcctgtagaatatttagtacgagccaagtttggaggtaatgcaaacacgcatccccctgcacccctaaaaaaaatactaattagtgtcaaatgtaccaaagtagaaatgatgataggtcagagcagagtggtagtgtagtacatagtacaattgtactaccctatttaatgatggcaataatactagtaagctattcccaaatcaaagatcctacgaaatcgcccacttgtgcaattcccaaatcaatccccttccccaatatccaatctagtctagcttaggggtagagccgccgcaaccatcactatggcctccgatggtgacaccgtagccaagctcgcgcaactctccggtgccaaccttgtgtgccacctccaaaccacaaatcgcatggctgattacaaggtggccgcacatgtgcttggcgagcgtgagcgtcgggctgccgagactgaggcatgtctacaagccaagattgatgtgcttcagatgaagtgtgatcttctagccaaggagggcgcatatagtgaaggtggcaagaagactaacattgactccaacaaaaatgaggtaagtggcaccaatcattcaagttcttcaagcaagaggaagagggtcgacatggacaacatgactatcccaccagttttgcgcaagaattctcattgcatcgacaacatcaagagcaccaaaaaaaagagggaggccatgccagagttcaattaagccagcaccaaccatgtcaaataatttcaagtgcattctacaattgcaactaccactatcatccacagttcccgcatccacagatgtatcattgtcagatataccgattatagccacagtaccccctccaacagcgatcttggtaggtccacccttacttttggaatcagataatcaagagagaaattggaacaagagatcagtattctctgagttgggaagtgttgatcaagagtatgtaattgaagaggaaactgctcccttgttaccatcatctatgcagcaacctccttccatggggctgatatccacgggtggttctccaatagctccagcactagtagcaactagttgtgcctctgtacccgatatgagcccacacttggttgaagaatcaaataagggaaatatagaaatgcagaaccaattatctcatttgcacttgaataatttgatgaaccaactttcttttgatgcttggatggaagaaagtggaggcccctttatgagtgagcaagtacccttctctttggtgctcccatccagcagtaaaagtgcatctctgctgtcaaaaatcgaaaccagcttgtgggagtctgaggaaaatatggttatcagattcatggaaaatgtggagctttgcatgggagctatttgcgctctttatcgccaaaagaagctaatggttgaatcgacatgtgaagaacgaactaagtttacttcactcaatgaaagtcaggcttacaggtatgttaaatattaggtttgaatgctaggaagggaaattattcatattactacatattatatacatactgtattgtatagtttatttacaaactagttatataaatatttgagtatgaatttcagctacaatttattggaatcttgtagttttttagtttttgtgtctgaagctgaactttttttttcactgcagctcatgactgctatgtagaatggttattctaagaaacatttatatggctgtcatatatatgatctgtcattaaaaaaatgctttataggaaccacttattagaaaaatgcttcatcaggctcttcgaagttactattaactgtttatgttgtggaatgcattattaaatgctttataggaattgtcagtatggtgttttttatagagtttctatttagtttaatttatatgatacactaatagtatatccttcatttttaagaaattaaggtagacactccatgattggggtgcattttgttagttcttatgtatagaaaatgatgaatatataccctatgttgcctttgttattataatacaggagaaagaaagatataaaactaaaagtctttctttccttggacaaaatataatggaatttactatgttgattatgtgatgaccttacaagcatgcatgctcaatgccctcactaggttctttatgtggtgtattttatagggtactattatttaattcttgatttttgtactcatttttcaatgtgatgtaatagacaggttcatcttaaattgcatatttggttaactttcctaaaaaattgaaaggcaatgctaactaacatagatttaggtgcataactatgtaacaattttgctgatcatctcaattattgaaaatattctcctcttttgttgttgtgaatagggcaacacaattggcagaatttcttttggatggtgatattaatgggccaatgaagaagaacaaagaagacctagtgaaccatgatgctacagggcccaaattcatccaggaatatgcaatacagtgctctaagcagttgtttgacatttacaggaataaagaggatctatacttttgttgactgaggcaaggttatgtgtgttgttttcttttgaggttggcgagcatcgtgtcattaaaattcaaacattatggaatttcatatgcagcagtgcatattttattgtcatgtatgaataagagatcatggaaacttggttgaagaagttaattttataacagtttcattgatgaatattttcaagtttacttgtatattgttgtgcactttttttcttctacttagcactcaatcttgattttgttattaattgtatcatatcttccctgtgtaaaagcaatattgcacaccatggcattgtcactaacatctgaacaaatggtacttgataatgcatttttttactatttcattttttttatctttaggcatgagaaaagagaacatgtttttactacactagtcaaacagagtaaaatcaatttatatacagtattggcatctaatgttttattatgctagactccttcgccttgatgacccatagacgtgggagatgagaaaataataaattttgtgatatgccatgtgacctcactaatcaatcctctgttggcatttatgccaaccgataaatagaagggcctggacactcctctgtcgtaaaatccacaatagaagctcatcatgtctcacaagttggagatcaagaggagaacagtacagtagaggcttgtcaaatgagagtaatttacaggaaagggagacatcaggaacccgatctcttcagattttacaggagacattacaaggagtggtcactgtggttttctagggaaatatggcctggcacaaccatagacctgagcatcgattggcatgctacttttaatcattccttcaaagtttaaagattagcatgctctacacatcaaaaactatggacaagcctgcattaacagtttcgtatgtaatgtgcacagatcacctgccattttggtagagctctgtcaataacctgggtagaactgagttccttttattatttttactagatgatatggattgtgaaaggcgaaacatacgcacctattgcttgatagttttgttgatagaaagtatataaattgtatagttatttttgttcatgatgcaccatcatgaagatgtttcctttacagtttacaagggatcaatagagagggatttaattaattagtactccctccgtttcaaaatatttgacaccgttgactttttaacacatgtttgaccgtttgtcttattaaaaaaatttgtgaaatatgtaaaactatatgtgtacatgaaagtatatttaacaatgaatcaaatgatatgaaaaaaaataataattacttaaattttttgaataagatgaatggttaaacacgtactaaaaagtcaatggtgtcaaacattttgaaacggagggagtactggaaattactccagcaacaatgaacaataaccctcatgcacactctacagatatttgctcttacagtgtcatactcccttctgatgtggccatttcagtcatggacatagttctcccttgtgtctataaagcttgccagaagacaggctgaactgcctaaggacatcttgacaattttctgcaggcaggatgaactacctaatgtgtgcatgaattaattcaacatcgacgatttcacatgtatgctcttcaataaatggcaatgatctactctttggtagagacagctaatttgtaagcaagcttctcgagttctccacagagattttattcattagaaagatcaagaatatttgggaaattgaagaattagtgcatctaatcaacctgctaaagaatattataggagaaggaggcgctgggaacttgatccgtacaactgttttgcttgatccgtacaataatgtgtttgttctttttttcaaaaaaaaattatggactgagatttaaaagagagtaccatgtggttttctaactaaaagatacgtgaatgtaagacatggaatagaacaatgccattgtgttttttttattattttacaaagagtataaatcgtcaatactcaatccattgaactagcaagtagaagaagaaaaagtgcagagtggtagctatagcttagtggtacattattttactccatatatacaaaaaaatatactaattgctgacaatttgttgcaataataatgttgagtagtacattagtttgatccaacaacaaaggctcatcctctttttcatacccctactacttgattaaagggtatgtcatgaaagaggcaactatagcttgtgtaagcaaaagacggttgatctagaaaagtccatctaatttacaactcaagtacgcatgcacttatatcttgcatgtcgatcatgaaagattataaaataacctcaaaacgtagattatatgtcactcgacaaacatacgcaacactaaattcaatccatgcatctcacaacaaaaaaacacaaattcagctattcagctataaatagctagcctactcaacggttttgtcatccactatcattaaaccagcaagagaaattcgtcatgtctcacacttgaagttcaggagcaagcaaacaaaaaagtataatggaggatataaagtcaactgatagtgtgtagtttgtaggaaagggagccatctggaacttgagctgtacagttatagacatggttcagcaacagtgatttttttagggaaatatgccctaacaatattagaaaccttagctaaaatcactcatcgtccatcatgtccgttcctcctccaaatgatggagcactgcactcattcagcagcgccacatctacagtgttgtgcttaactgcttatgctctcatggcatttacagtttccccatgtactgcatgctgaccacggcatttgtctccatcgatgatccaaaagtgatagggtgaaacacgcaccagttgattgttagatttgttgatgttgctgcagttattttgattttttgtagggtgtactatggttaccctgtctatgatgtgccatcatcaagaaagtgtttcatttacagattataacagtcctatatatatgtagacaggtttaccggtttagtgccccatgaaggctgaagtactgatgtgtatgagttaattcaacgtctttttcaagggtgatgtgttttgttgctctccactggtagtattatacaaccaataaaaataatctaaaccgttcgttattaaggagttgttcagattaatgtcacttcaaaccataccattttttggtaagttgacaaagatatgcatacatttaggtttttaccatactttggtaaacacataaggaatcctgccaaaacatggcaatattgccaactaagtttattttagatacaatctgaacagcctctaaagacatactagtaatgtactaaacagtgattaggggtagattaatctgtgatcatccatttcgttagcatctttcatattccatcgaaaaagtcaaaaaaaagagagaaaaaaggtttcatcactgctaaatgatgtttatacccctccaaaatattgtttttactaccggtaaatagggtggtagtgcaaataaatctaaactcttggatcgaatgagatcaatggttcaagtttcttgctactaccagtagatagcaccatatataaggggctcatgtttcaaatccatgctggccaataaactgaagcaaccaaagcactcgttctctgtggtagaaacagcagctaaatgagttcattacgagagaggaatgctgacgaaaaccaacagaggtatttgaaaaggaagaaattagtcaaactaccaaagtatatatcatgggaaaggggaggcatatgcactcagaaccaaagtatatatcctgtgggaaggggaagcactgggatctttgagtcatagaacttgttcttacatactccctccgtattttaatgtataacgccgttgactttttaacaaacgtttgacctttcgttttattcaaaaaaattatgtaattataatttattttattgtgatttgatttatcatcaaatgttctttaagcatgacataagtattttcatatttgcataaaaaatttgaataagacgaatggtcaaacgttgattaaaaagtcaacggcgtcatatattaaaatacggagggagtatatcgttagacaaaaccgaaagcaggatacaatgtaaatgtagtgcaaccgcctcactcaccggggcgtggaagttgtctagcactcgtttgactgtgttgcgtcatattggcatatctgaaaagcttgcaattcttcctgcaacttcagcaaaagtacatagctgcgaattagttgacacacgcctgatcttgtcagaaattccaattgtatatatgtgctgatccttcaggcctacgagaagattagaccatgacatgatgtcatcgacgaggaaacggactagtataggatgcacccacttgttgaattaatagttagataagaaaagggcatgatgtttacaaatgtgccctgccattgttataggagaatatggtagaatgtatgtacgagttttgttcttaattctggtctggtgttgggataaaaacaagtaccttccatgcctctaaaatgaggaataatatgaccaatgccatttgttatggatgggtagaaatcatcagtaatcaatctagttgcacccaaaaaaaatactgccaagtggtaactagctactatttactctaaaataccttatcgatgcaagcttcccgtgcaccaactacaaatttaaagaaaaaatttataaaaaaattagacacatacttcccaatctaggtgtgaaatcttatcttcaaatttattatattttagctctaaaaaatacgaaattctgatagattttctcttcaaatagtcaaatttttaaatttttttgttacggccaaaatataataaatttgaatatcagatttaacagatatgtgtaatactatcaggagtacatgtcattttattttagaacttttcgtggcatttgctagttaatatgcacggaaattaggttgtacgcatagtacatgttccaaaaaaagaactgcttccaagtaggtgcaacaataatgcttggtacattactaactagctgagctgatataagggaaaatctgtagtgcaaaccacatatgtagtggaaacttggaaactaccgttggatcgagaaatggacgtcc

SEQ ID NO: 38146 - DNA, 8821 bp, Oryza sativa
tgcgaccaagcacccgttgacacggcggtttgatcgaggcggcgatgacggtcatgctgtgagggggggtgttgaagcctgcggcgagcttccatccaggcgtctgccttcttgcggtggcggcttgccgccgaaagatggccacgctggacgggcgagtgcggggagaggggatccattcttctctctcaccttctccctctccaacccaaccacgtggatggacgtgaagcgcggtgaaggttgagactcttctttgatggccggacggtggcgaggcgtcggcgcggtggctacgtgtcaaagggaattagatggtggttctgctaaactggcatgcactttttgacgcgggagagtagaacaacaggcgaaagcctagctttcgggccggcaacggcgacgcctacgggcgccgttttccccttggggcattgtcgtgttttctatttttcccagtgggttcttcaggtgaaaacctcgtcctggttacctaggacggacggtggcggcgcttttgtcgtcgttttccttcttggaggcatcgtttagaagtcctattcctttggggtgttgtgtgcttgttttgttttaaacagtaggatcagacgtagacgcgtggtgtggttgtatattttctttttcctgactacagtctcccaggactataggcttgtattttattccttctttatcaatagaaacgtcgcactatcttgtgcgggttgtttcaaaatactctacaatctactgatctgcctcatcgttagctagtactccctctgtctctaaatatttgacgccgttgacctttttaaacatgtttgattgttcgtcttattcaaaaaatgtaagtaattattaattattttcctatcatttgattcattgttaaatatacttttatatataaatatagttttacatatttcataaaagtttttgaataagacgaatagtcaaatatttgctaaaaagttaatggtgttaaatatttagaaacggagggagtataactcagtcttctgcagctaggaaaacttcaacttcttttactttgttagtttgttttgagacggagccaaattaagcatacgtttcgaatctacaagtccttggagctggactttttcactgtgctaattttagtggagttcaccccaaacgtcacctgaaaataatgaaggcccattcttttcatatataccaaagtccaatcctagcttcttattactctgtcaaaaaaaaaaaaaaagacaaactttagctacgtgtgtgttcaggtttgtagctaaaattggaccttttttttttaaggacggagagggtatataagaaaataagacatgagtcaaccagactgcttggagaaggaggcactgggaaattctcttgcttactaacttttactaatgtgctgaagcgtcacattcagctatacagcacggcgctcgagcttatagctataacaatcttcaaggagggatttcgagttcttcagtatacaacacaacactggattctaaattctaatgctttacatgtgtccaatatgaaggaatagaaatattatttacctgaccatatataagaaatatttttcagtgcatctctcaaatccaatcagctttttgcacgatctgaatctgtaattgttctcttttgtctgtgagattcaaaattgagccaaactatgtaatgttgaactgtaccattaattagtaacaaaactctagcgatagggtctaatacccattatattgtaattatgattgtaacgctgatgcacagttatctaagttgtgaaacattgttgcaataccttatatggctatgttacaggagaatattttgctgtagtggatacaagccaatagatagctaggttgcaatttgatacagtgatataggttcacctttccaatccagtgcataataagttcagcattgaaccatttatcacatgcaatttattacaaactggaaacaatggtgcatgtatatatgctgggcatttcacaatctaggatataaaaaaacagggttcaccattttctgcagttcaggccctcgatcgcaacatgagtgatcaagttggaattcagggcaaacgaggatggatatcgaactggttggaaagggaggcactaggaactttagctggtcaggtcagtagttacaaggtgccacggctactatagtcatcttagcaattctcccttatcatgtgcactcctcttccttagatgatagatctgtctgatatgtagctaggaaattttcaacttcttgtaatttgttttgagacttaagctaattgaataacgcagcattttacatgtagatgtagagccaaagtatgtagctcaaatctacgacatggagctagactttttcactgtgctaattttagtggagttcaatatgggttggtttggcccaggaattggacactatttattactcttagatttggcattttaactagttgtcatcaatgtgtcaatgacacgtagactctcatatgtcaatgacatgcggaccctcaagtgttgggcccgaataacaaataattaattaccacatttaagagttgtaagtattttttttccacctcatgtccgtacgtatgctaacaaataaatagtattcctttcgtcccagaatataaaaagttttagagttagatacggttattaagaaagtaggtagaagtaaatgatggaggattgtgattagatgagtagtggaggtaggtgggaaaagtgaatggtggagggttgtgattggttgggaaaagaatgttgctagagaagtagttatattttggaacaaatcctgagggctaaaagttgttatattttgtgacggatggagtagaaggctagatgctctctgtagtaaaactcacagtagaagctcatcatgtctcactacaagccagggagcaagctagtggagaaaattatggtagagaggaatgtcaaaatgagagtagattgtaggaaagagagacaccgggaacccaatctgtacatatcatgaaggagatgctacatgatgcggcaactgtcattttttagggtaatataccgcgacaatgtgagcagaccatccatcaggctgcacggcgttgcaagcatggcatttttatgggaatagcactgcactcatcgtgcataagcgtagcgtcaacgtaatcgttagcgtgctctgaacatcatgcagagacatggacaaccttgctggcttttagctcatggcattttcagtttcatcgatgtactggacgacgcagaatgtgaaaggctaggcagataggtgaaacacacacggattactttacagtcttgttgatacaaaaccgagaaaattatgtagtatgtacctccattttaatatataacatcgttgacttttttaaaacgtttgataatttatcttatttaaaatttttatgcatatataaaaaaatattaagtcatgtttatagatcatttggtaataaattgaatggcaatacaataaataagaattatatttttttaataaaatgaatggttaaacgtatctttaaaaggtcagcgatgtcatataataaaaaagtggatatagtagttgtctattataatgttttatattataaattgtttgacttttttccatagtaaaacatctttaagtttaaccaaatttattaaaaaatatagtagttttttcaacacaaaacaaacatattataaaaatatattcaatgttagatttaatgataatattttcttattttagatgttgttaatttttttataaactcggttaaacttaacaaagtttgactagaaaaaaaaatcaaatgacttataatatgaaatggagagagtatttcagtcatgaggatagtactaattatgtgcattttaatagtttcttgcaggcaggctgatctaattatatgtgttcaaataaattcagcagccatatatttcacacttatgcatgttggccaagctttttgcgagtccaatatataagctcctcaagagggagaaatgttccctacagaaacaacaagaatattagagaaagaatacatcgaatcaaactaccaaattatagtatcttataggaaagggaggtgctgggaatactagctgtatagaatctctagttcaaccactctgacacaacaaggatgacataatctacaccttggtacaaccgtttcacttcagttacctggacatggaacatgtatagttgcatgtatgattctattgcactgaacaagctgatcttctgttcaacacctttggcttgcctttcttccgacagcaccgggaaatcaccgttcaacagttgatcttctcagatcctgtgcgttcatcctccgggcatggaaagaaccgagtgccttgtacgaggaaaatggctgcaggggatgagtttgagttactaattagaaaggaaattgaattttgaaggccaaatgtgtggcagaggttattactatttacaaatataaatactgttctaaacaacctgagaaatcggtaggatgtgttaacatttctaattatagtctgatatttgaataaaaatatacggcattgattttgcattgaaagacgcattcctctaaaacatggaatagaacaatgcatttgttctttttctatttgcagaggggtataaatgattgaacagttataaaaatcatcgataatcagtctagtagcaggaaaatttgattgaacgttagctagcttctatttgcccccatacctaaaaataataactgaattggtgcgacaataatgcttggtacattaataattcattgattaaatatcatgaggactattaaaacaaagtttctggatcaccatgacatatttgcttgatccatcaacacagctctcttacaaaggtcttttttactgcaacgaagttacagcttataagctcaacatgaaacaggcaattgtgctagcttgcagaaaatggatccaaggcatgtggcttgaaactaaaaatccatggagctagactttttcgccttgctaattttaatggatccgaactcaatatgggttggacttgctgttgttcgcaagtacgctagccaataaatagtagatgttggaaactcctttttcgtaaaacccacaatataagctcgtcatgtctcactataagttgggaggagaaaattatgatagaaaattgtcaaatgagaggagtttgtcggaaagggagacaccaagaactcgagttgtacaggttttaactgaaactaggaagatagcccgcgcacatgcgcgggcttttaatataatgttgtttgaatttttgttaaagaatatttgcacgcgggtgattttttttttcttgaaatattctttgattctattctaaacctgtttttgtcaataatctatttgggattgttttgacagtgattatgattttcttctaattacccttgtaacatataaattgtaaattagacttgaaaccgtacagtcttgaatttatgagaatatattgtatcgcaacaatggagtttctaaaatttaaatagcatgtcttttcttgtatagtactccctctgttttttaatttataacaccatggacttttaagatatctttgactattcgtgttattcaacacaaattaatgttatgagagagtatatttatgaagagtgccatttatagattgatttattcaaccggttggtatggtttgtttccacatatgtggattaacttacctttgaatatttgtaaagtagtatatttgatttcataatatatactgagatttttagaaatttctaaggttgtttggatagcatgtaaatgatatggatatttgaactattgagataagtgtaagtgcttattattttacatgtaagaacatatagttggatccatgctactacaaatataacattttagataaataccactactattcacaatatcggctatgtgccactggaatttggagaaattggaccagtgccactccattacatttccgtaaaaaaatctctgttatccccaactgcacgtgggacctaactgccagttccatcttcacctccctcccctctattctctctccccttcctctctccccaccaccatcgttgacaaccaccgttgcagccgccatcatcgaccacctcagcggtgggaggcctcgagagccactaccgttgctactgtcgtcttcaaccccatccatggtgggagggctcgggacccgctgccaccatcctcgatgccaaccgtggcaggaggctcaggagtcgcaatcctcaacccaatctgtgcgggagggctcgaaagctattgccgccgccaacatcgtcgttgtcctcatagcagtagcggggatggaggaagagatgggggaagaaagaagagggaggatgggggaagatggacctcatatgtgggtccctcgtctaggggtctgacggaaaacgtgatggaatggcacggtccttgtttcttcaaattttaatggcacatagccaatatcgtaaacagtagtggcatttgtctcaaatggcatatttgtagtagtatgatccatttaaccctaataaatatatgggtttaaactattgatttaattgtaaagctagactacaaccattcaaattaagtatagccaaggaaaaatagggccaagtgccctagctagattactaaatattttctatcatcaatcagaccatcaactgatcaacctgcttagggcctctaaatataggcttaggcttattactttcgatttttaagttagatttttagcttatacgctagtggatttagagttataagtttaacggtggagtcatacatatgtcttacatcagccaaaattttcttttccaacctagtttttgatttaacagtataaagagtggcttatggctttaaaagagcaaaaaaaaaattgcttgcttgtttaagagtggcttatttttctcttctaattcgaagatctttaatggatttttggtgtgcatatgtatgcatatagatcatccacaactgtgtggctatctagctagcataaaaatctatgcatgattgcttggacagagttgagcacctacgggaggcaggcatgcagcagtatgtacgaactcatacatacagggatgaatacgtgcgggaggcagggtttaagggatctttttttttttaagattgatccgatggttgataataatgggcccatcgatttaaatgaaaatcaatggttagattttttaattgccacgtagcagcttgagagcattttgaggagtgacatgtggcgtcttgagagcgtttctagaaagtttaatggacttttagtatataataatagatagatagatagatgttacatggtgccacaactatgatgtttgagggaaccatgcccagccatagtcatagacctgatcatccaatatgttgattcccgtctgaatgatttagagcatcgcacgccatgacctctggtacggctgcaatcaagattagagtgctcttcacatcaagaaccatggacaaattaaacttgttggcttttacttcatccatttacagtttcttcttgcagcatgtgtttgttggccattgtaagttaaattattttgacttggatgatgcagaatgtgaaaggtgaaaaacacgctcgttgcttgacagttttgttgatacagaacatgtaaaatcatattgtgattttttgttgattatggagaatgctttatttatagtttataaggaatctatatatagagaggggtttaacgatgcggcatgaaagaggcaactatgtgatcgtgtaattaattgtactaagttattaaccagccttatacctattctcatacgatcttattgagtaaatgagtaactagaactgagatataattacaatatcttttttttcactgcctacaaatacagctcaactaacagtccaacaagaggcattttaggacatagctaaagcctgacaatggaagtccatgtagaactggtaccaatgatcatcctcattggttccgctaaattgaggggtctggaaccagcactaataaagactttttactagtgatagagctaattaattctttaccatactaaatatttaaatggagcccgacaagggttaggccagctgggcatgtatgcttgctagctagggcatccacagtgtgctcccaagccaagtaataggaaatattttaatccttatatcacgtagtactaaatattatggaatcaataaatagctgctaccaagctagagcactgcaacctagtagtaagtaaaaaaatattgattcttttggcatgtattgatcctcaccccctctcccttcatgcataaaagcagcaatagaactgtagacagcttaagagtcttaggaaagggagacactaggaatttaagctatacagaatggcgatgtctcgtgttacatgttgtagcaaaagtgaaattttacggaaatatgtccctacaggattagagacaccagttatccattaggctgattcctccctctagatgatgagtattccacccactttcggttctagtggcacagctttgctccaggactgcatacatggtacaatctctctctatgaccggagggaaatttgagtttttactagatgaggcaaaatgagaaagggtgaaacacacaatcttgcttgacagttttttgatattgctacagtgcttttatatactatagttattttgttgatgacgtaccatcataaaaggg

SEQ ID NO: 38147 - DNA, 139 bp, Oryza sativa
gagagttcagtcatggacaagaaattcaatgtgtcttggagctttaatgttgaccctgattttgattacttggtccggttgcatttctgtgagctggagtatgacaaggcggagcagcgcaagttcaagcatttacata

SEQ ID NO: 38148 - DNA, 1679 bp, Oryza sativa
cagcttcctctctagctcatcctgaaggcttttaatgcagtctccgatcataatgctggtgacctctaattgcatctcgtgttcccactggagatcacgaattgaagcactgaacaagctcagcatctccttgatttgccggaacaccacaaccagaagtagcttgaagccattgaagccctcatatatctcaacaagcttcccatggtgacacaccatagggcatgaaccatttgcatcaccatcatggaccaagctatgacttttcaggaaccttatatcctccttgagcttattaaggtgctgttcaacttccagtttcatcaaatctaagtactccgtgtaattaatctctacatttgcatccaacaagtgctggcgcagccgtgacattacagttgcaaacgcctcaaagttgctcccgatatcacagctgcgatggtaggacaacaaccatggtggcggcacttccaaatcgttgaacttttcagcctcgctgttaaactcactaatggaagaggaagacgttctgtcaatcaatggcccgctgaataaggacagatcattgtgagcagtacatcgtgattggcaagtagaggctggtataatcattctaccagtaaatgggtccattctttcatccaaaacctgcaacattttcaaacttaagatttggtataaaatagatttaaaattcgatgaaacatgcttagcacaatagcatctgttacgaaaacaatcaatgcggtttcatcagaaatgggtgtgataatcatggtcacacaggcatttgtcgtgattgaacacaaaaaaacagggttcctagaactatcagatactgcttgcctggctatactgattggcaaaatagcagttcagagaagctgagctccaccgccagagcagtatgcgaagcaacaggcgacgctaacaatactaacagagaacacaagccctacataaaaataaaaacactagatacttcactgcccactccattctattcattgcagaatgcagataccaagcaaacccgcagtaaaaaaatgcaggaagtaaccgcaggtcacagtgcggtgaagcagagtaattaacggcagtttcgttcacaggttcactctgctcatcctccaaactcccccacaaaccaaccagcagattcccgcagctcgatcccaaaaaaaacccttccgcaatcgcagcggagcgaagcatccccagtaccacaacctaggcgcaacgcaaccccccgaatcgcaccgcaccctcggatgaacgaaccgaacgcacaaataaaataaaataaaattcacagtgagcggaaaacacagtagcagcttacgggttggatccccgccatggacgggagccgcctgagctccccccctcgtcgccgtgggctcgccgctcgcctccctctgcgctgcagcctgcaaccgcaagcgtcgggcctcgggcgggcgaggagggagggaggatgcggcggcagcggtagggtttggggataaggggcagcagcggcagtggagtggaggagatcgcgcgtggtggtgaatcgtgggagagagagagagaggcggtaaattttttggttgggagcagtggacgatcgagcagcgatcgcgaggaggaagacgacgaggaggatgacgcagcactcgcggccagccaagcgaagc

SEQ ID NO: 38149 - DNA, 8347 bp, Oryza sativa
taatagttagcaatgaacgcttctattaaacttgttgtgatatttccgagaaactcatgtatcctaggtactcctccattctcaagtacacttcactactaatcaaaacaatttttaactttgactattactcaattttaatgatccgtctattctaaaaataaaagattttaaccggatgtgacacatcataatattacaaatttaaactggttttatatcttgagatggagggaatatatgttccgggtgacacatttaatcaagtctcatctatccatgacttcagggtttggatgtaaatgtcgggtttaatttattttctgtgaaaaaagactccagggaaaacagaacttacggtttatagcagtccatcgagaaattttgattgcgattctatatatttaattacgggttcagtggacatttacttaaaatactggatttggatctgatctgtcgtagatccagagaaatagcattgtccatactggcaggtgagacaagggtagcatcgccaaccatgtgcctttgttattgccaacacggcctaccatggtcttcaccaaatggatctacttaagaattagtatgctttaagataggaattgcatcaagctttctgctttttcccatttctcaacaaaattttcaagtcttactgaaaataaacaaattattatgagggtttgaatcaaagggcctgtttagatcccctggcaaaattttgcaccatgtcacatcgaatgtttggacacatacatagagtattaaatataaataaaaaaaataactaattacacagattgcgtgtaaatcgcgagacgaatcttttaagcctaattacgccatgatttgacaatgtggtgctacagtaaacattgttgatgacggattaattaggttcaataaattcgtctcgcagtttacaggcagaatctgtaatttgttttgttattagactacgtttaatacttcaaatgtgtgtccgtatatccgatgtgacacgccaaaactttacacccctgtatctaagcacagccaaagacttgttttgaaacctttacagatacaggtagctctactgtaaatctgccacagtcaacattcaacaatattttgcatgggtggcttgagaagaaacagaaagggaagcagagaaaggcaacagaacacctgaaacctgctggaagatctgtttcccagctgcacagcctttacagatcatggagaccaggagatgcagttgcatcagatgaaacaacagcaaaagggaaaagtgacaaaaaggcagcaagttggatggagcagttagccagttactagctgggagacagcagcaaatgctttgggagagaatgcaagatatggagtataaacatgaatgcataaatcaagcagaaatcatgcaagatattgagactaccattttccttctgtaacaatgctgacttctgaattcagctggggagatgaaattggctgggctaacattcagcagaatattgtacattttgatggatgctatgatgcattagcaatccttcccgttcttttttatttgtacgtttagaatccatgctgccaatactgactataacagaaaaaaaatattgttatactgtaattctgtcagcacatactagcataaaaatttagaagacaattggtcagagttatttctcttaaataccaataacataaagtgaaaggagaagacgagagaaacaaacagtaagaaagtcccactacttcacatttttatcatgcatgatgcccatgaaaagctggtatgatttcacaatactaagtcaaaattagcatatgcttcattttattcaccatgtcaagcagaagcttatgaataagattgacaattttacaatgcaacgagaatcatcgctttttactgttttatgtttcaactcgctgcaaaacaatcacaaaatcacagcccgtgctttttagtaacttagtaaacctccacgtgccattgtttgttctttttgagctgcgacagcttctgctcccaactctcacctctttgctcagctactctcttgagtgtgtcctggatccctggcatcatacccttcaaaccacaaaagtagatatgtgcaccgccatccaaaagtttaaaaatttcatcgctgtactcttcaatcttgtcctgcacatacatctttccaccattcttattcttctgttccctacttagtgctttatcatacctgcaaagtcaatgaaattcaggttagttcacaaaagaatcagtcagctactcaccttttaacttcagtcaggcatcaaatacaaccagatcaatcaacgcaaagctagactacatctttctcaaccatgtcactgaaatactggatagaccaagacaagatgttaagcaaaaagcataaaagggtccacgaacctgaaattgtctggatactgctgaaggtagtttgtgaactcttcatcatacagaaggctatcagtgttagcaacacctagaaatagccaagccagaccaccaaacttgaaacttgggacatcctccatgaacatacgacgtagatagccacggtagggagcaacaccagtgccagtagcaatcatgatatgggttgcatttggatcatcctcaggtagaagcatgattttgcctgaggggcctgcatgtgaagagtaacttcagtgataagcttgaggctggaataccacatgcaagccataagttacaaaacaagtcataataatattgaaagacatctcttcttcagattgttttctccaacaaccacatctttcagaaagcttataagctaatattttctccagccacatctttcagaaagcttataagctaatatgccctctatacatacccatccaaaagatttcagaaaaaaacattgcatcacagatgtgaacttcagataagaaaaaaaggttaaaagcctaaattttcagttaggggctattgtttatcgttggaacatataagaatgatatttatatgccatctgaaaggagcacgatacctgttatctgaactttgtcgcctggtttagagtcgcataggaaattactgcagatacctttctttgtggggtcttcttttccagtttcaggatcataataaacagcacgacgaacacacaaactggcagtctttccatcaaaagaatcaccgtacctagtagatgcaatagaatagagccggacagtatttggggaaccaggtttcttcgggttctctccctggtggaaaattaacatgaagattaaaagggaaaaggagaattcaggatgaatggatgcagcatgatacaggaaagcaagcttggtacttggtattgttaaggaatataggtgccaattaaatttgggtcgttcttttagaactgtttaagaagaaaggtatacagtacatatttcatatctcttgctaagagaaaatgagtaggattaccatcagtttttacagtgcctacatatttcatacctctatcttttatctacagcaatgatggacccaatggcaaattatttgataataagcaagaggttgaaattccaggaaagcgtataataaactttcacttctagacaagatgatgacaaacctaaacaaaaccaaaacttaaaaaatattgcattatgttgagcaagaacaagtccaaattacttactggaggaatgacaccataactttgtccttcccagtatggaacattgccaccatgatcaataacaatatggcatgtttcaccaggagctttagggcctacaagcctttcgactgagacaattgtggctgtgtaaggctcctttggtttgtataagttaaggggtggctccttcgcattatccaattccagaggttttacagcaactttgcttttgcttgcttgttgaacggacatggaaaagatcttgttcatatgccttgattttagggccttgctttcccatgctaatgtggttccaatccatgatttgttgcagaagttaacagtattgctaccctgaacataacaagtcttttgttaaatacaggattaccagtataaccacattgcaacaactataaaaattctcatggaagcaaaataagagagtccacactcaaccaagaacaatgcaactatatgtgttgctacaatgtcctcatcctccatttctcacatgataaatcctatactttcctaggcaggttttggaaaaggaagagtgcatgccagacaacaatttgtttgttgtagcaattctcaaaataaattcgtgcacatagcacatggttcccattcaaggactgatgtaccagtttttggcagtaactgacccaacaccaggtaggagatattgatgccaaactccaagcaggcaggaaggtggcagcttagctaatctaagacaggccaagtgcccatatagccagtcttcagggcgacataaaactcatctagaattgatatttcaccacataaatcatcacaatacaattaatttatttatacttgcagagtatactgtgaatgtgccatttcaagagccactgctgctggacagaatctgtgcgagactgatttccacatgctagaaagtactacacgcgaaacaaaaactagctgcaaaccccccaaatttataggagcacaatttgaaacttatcccttccagcaactaattttctacagtgccagaccagatcgaaccacgagattcctcaacgagagcccctaaaacgcaatctctagaggcagaaatcagtcacaagattcacccccacgcaccttgctcgaggaactcctcccgtagccgcccgcaccgatgggcgccgcgacagacgcctgcaggacaccacagaaagcgaaagttagcgccacaggatgcaggaaaagccgggaatcgtgcggcgggagcggcagcgtacctgagccccgagggcggaggccatcgccggtggatcgcgaggaagaggaggaggaggaggggttggctagggttttgatctctggaattgacgcgaagctgaggagagggaaagggacggatatgtttggcacctcggagaagagaagagagcaagcgaagatgagacggattccaattttccttttccaaattagtaggagtatcaaattaaagaaaacgattatccaacttgctttgagcatgtgacaaaaaaactttctttttttttccttcctaaagaatgtctaatgcatgctgctaataattttgcaaatagaaattaagaggtactaagtaaatatatactatttcatactaacaagtattctctccgtcccaaatacgtcgctattcatagtgttagaaagaaataactatgttttggaatggaatggtagacaaaacatgtgataggctgatagcttacatatgcatacatcatagtcgagttcaatggtcttcattcttaaacatgtgctgaaacttttttccaagcaaacaaacatgtgcgaagcaaatggaagcaagagtgcaagactcgaagcaaacatttgcaaatcaaatgggagggaagtaacccctgtaagaatttcaaagcacatgaccatgacctctggaaaaattcagtcaaatatagttatacaagtacaaccatcatcacaccttcaagcaatggtttcttactgggccttggtgtgggctgtttgatgctgggcaatgggcatagtttgctaggctttgcaaattatatatcctttgtgaggccactcaattgatggctgacatatgcttcagtttggaatgaaatcatctcaaatcttacatgaacgttctgctcattgcttctcggataatcaatttataaaattaactctaggcaacggatcacacattcacacatccttaatgctgatcttttaattgttttactggagaggaggttagcgattgtcccttctaaaacattttttttatcaaaaatcacatgagctaatggcatcttcgtaattattttcagaattagaggtatggccaaaccaagatcccttccattaaaggacggagagaacaaaataaaatatatcacttttgtaggcctgtaacaataatatagaacaaaagtctcagcatgtgaatatcacttaaggcttttcaaccttataacattactattaattatagagagctctacagtctatatatattaagggtaagtcaagatgtataagggaattaagaagctaacaaaacaagccacctcttcatcatagtatgcttgaacacaacgttggttcatctgaatttcatctaatttgaattttgccgggtccacctaatttgaatttgaatcaccacattggtttttgcttgaacatatggagcattttgaactgcctgaacttttgtggttgctctttgtttcgtttgaccaaagtgccatgcacaatgtataatcgagctaggagtaaaaggaaaaagaaatgtcagggtttatcagtacttaaaatgaaataaataaacaatacttacgttttaatgtgcaatatattaataagtatatatgttaaatattataaaataatagattgatttgttaaaatattatgaaagtgatgtgagaaataatgattgaatatacttgtatgttgatttgtagaattaaaaaaaatataaatgatgttacatgcttgtatgaggttaattatgtaattattgctagtagatgataatgtgctatggttgtatgttgagctttaaagttagtgattataactttataggaagcataaatactctgcacagaggttgcgccacagctgcagtagagtagccaaacatgtttgtcctggtatataataatctatcaaaataaatggtcttcatttgcagtaatataacttttttatcgaggttgcaatagtgtaatcgtctattcccttgtaggatttttttaaagttctactccatccgtttcaggttataagattttatagcattgtccacattcatatagatattaatgaatatatgtctagattcattaacatatatatgaaagtggactatgaaacggaggaagtatcataataagggtgtgtttagctcgcgaaaagaaaatttttgggtgtcacatcggaagtttgacaggatgtcggaaggagttttcgaacacgaatgaaaaaactaatttcataacacgccttaaaaccatgagacgaatttattaagcctaattaatccgtcattagcacatatatgttactgtagcacttatggctaatcatggactaattaggcttaaaagattcgtctcgtgatttccatgcaaactgtgtaattagttttcttttatctatattaaatgctccatacatatgcctaaagattagatgtgacgtttttggaaaaaaaattgagaactaaacaaggcctaagtcaaaacatttttaactttaaccgaatctatggcattcaaatatttaccgtaacaaacatatccattgtcgatacatattctatggaggatttaacgaaaccaagtttaatattgttataagttagtagatagttttgatttctaatgaaattaaagcgattggatatactgcaatggaggggtaattttaacttgtaataaaattaaagtgatttacaatatatagaatgaattaaggggagtagttaaatacctcggtggcacgggacacgagggtacgtgatgttgttaactggacgaggaaggcgatggggaaagatgggaggccagtttactaaacgcgaagcgctcggccatgttgccgttcgatcgatcgacctgtggtgaatttggatggaaaggggcagcttggctcttcttatgaaggaagggatcgatcacctattgaaccacacgaaatatattgaagctgaatacggaaccatattaggataaagatatgtatttgtgatccgttttctgagcagaaagcgtcccaattcccaaatctgcatgcctaaacaaccctttgctatcagataatcaaaactgattaagagaaaaccacctttcaccattgggtcctaatattctttctaactttgtaaggtactccctcctcggttattttttttactagaaaaaaagcacgtgcgttacaacgggtgaagtctattttaatcttattattgttgtattgtttagttaagatgaaattcactatgggagttcgtttggatacggagtatttagaaaatcatgagttgcagttaggagtccgatcgtctcaagttagcatgcgagttttcttaaatatatttcttatatgattccttctgtattatcaaaagtgaatgaccttaaaaaccgattcaaatacggatacatattttgaaaagc

SEQ ID NO: 38150 - DNA, 8104 bp, Oryza sativa
  unsure (1)..(8104): unsure at all n locations
tagattaaaaccaaaatataaaattaaaatcaactcaaacgcggatgacgaaccaaaatagattaaaaccaaaacataaaattaaaacctacttaaatacgaatgacgaaccgtggaaacatcttcgatttttataaccgactcaaagacagatgacggaccgcgaaaacatctttattttttttaagtagtaaagaagagatagagattccttttcccctctatttggaatattgtatcagcgacacataacacatatatgcatgcaagcatcacaaaatcgaagctgaataccgaactagggaaacagattagttgctactccctccgtttcacaatgtaagtcattctagtatttttcacatttatattgatgttatctatctagatttattaacatcaatatgaatatggaaaatactagaatgatttatactgtgaaacagataaggaagtagtaatatatgtctagcaacatacgcgctgcgcgactgcaaaggtatcggccatgagctgcacactcgtcggcttcaccgccttcgccactggcccattgccgtcaccaaccgcaaccgtggcgccggcgaggccgtctccggccgcgggtacagggagcaccgtctcggggactaatcgacgtggctgcagcgccacgtggggagcagcaagaactgggacaagattaggagctgcctcgccgacgccgtcatgtgcaggagcctgcaggacggcaacttgacgtgcgcgtagacgcgtagtttgtcgccgactttcaaataatttcggccaaaattttttgaaatttcggtcaccccggcataaaatccaatttcgaaattgaaaaccctggtcgccgacgacctgtccccgatccagtccggctgctgcaaggcgtccacgatcgagttgcaacttcacatactttcgagttgcaagtacgtaccagctacaactttcacgtacgacgacgtacgctgagtgctgatgaacaaagcagccaacaaataaatttagaccaacaaattcatagtacatcctaaattttttgtgaaatactccctccgtcttacaatataagggattttcaatttttgcttgcaacgtttgatcactcgtcttatttaattttttttgcaaatataaaaaacaaaaagttgtgcttaaagtactgtggataataaagtaagtcacaaataaaataattaataatttcaaaattttttgaataagacgagtgggcaaacgttgcaagtaaaaactcaaaatcccttatattatgggacggagggagtatttggtatagcggtgcccacccggcacaccctttgggtccacccctgactgtgactgcatgcttacgtccatggcgctgacaatccagtcccgcatgtgatttacgagaccgcatatgctatggagcaggctactagtatactcctcttgctcagatacgcctgcagtggaagcagccggaggcaggcacggtggacgacgaggagaggggcggctgccgccgctggtaggcccaaggggcgggagtggaggaggccgcgccatccttatctccgccggcgagaaaggagggaggagaggagagagagatgaagacaggagatgggagagaggaggaagaagaggaggggattgaggatggcatgtggggtccacgtgggctccactatttaatattactatgtgtaaaactgacatgtgggtcccatgggttctattattttttcggatcgaattgctatgtaagcgccacgttaatgccacgttagatgaagactaagtcaaattagccacgtaggcgtcacgtcagctaaaaccgccatccaaaccatcatgagcctatattacatcggtcttgacagttgatggacatattatatctggttttttgttgaaggatgaaaatcggattcgttgacaagttaagaacctcagatgcacttattccccatgagaaaccatccaaaatcttatgaacaaggagctgtacatgtgttgtatactaactaaaggggaaaaaaaaggtaattaagctagactcgaggtgagcgacatactgtacttggctatcaaggataggactgatagcgacatacacgtgttgtttctggttcggtttcccactctcatacgctttcaagtacaattattgtagccatataatgcgtgtatcatagtagtatgtcacgagctaatagttactatacgcaaaacaaatgcttagctgtcgagaatatgtcacaggttccattcaccgattaatttctctgtcggcttgattgtgatgccctcattgaattgacttgccactaattactgctccgtctgatcttaaatagtactctcttcgttcctaaatacagggcgtaacttcttttcaactgggttccataatacaaggcggcagcttctcggtgcatgcaggaattgatgagtaatcctcggctcctgtactggtgcatgcagaattaactgatgactcggtttggcttttaaatgcatctgcatgcatgctggctattcgcgcggaaagtgcaggtcgagcgcacgctgcatgcatggtggttaatgctagcgtatctactgcgcaacaaccgaaacgtcgctcttcgaacggagagaattaatcagcataactgctatttaaacggttttattggtctttgcaactacaacagtcacgccctatattatattaagaaacggagggagtagtacatgatcaactcagtcaaaatattagttttatattaagacaagtttataagatctaataaacgtgtatcagtgcaaatttgtgtatacttatatttttttataaattaagcatttgagaaattattgaccgagtattaccgtaaacataagatccaagaaatactttagttgcagaagctagctttacaaattttaacagtttgaccttttgtaaaaactaattttataaataaatcacgacaaaaacttatttcataaatgatccttttgttcagcgtcaaatcgtatagcactgaacttagaaacctcagcgccacgtcaactggtgttaaatgccatgctactgcggatgggagactgagttggcgtgccgacgtgcattcagcgccgtgctatttggcgctgaggtgtctaagttcagcaccatacgatttagcgctgaacaaaagggtcatttttaaaataagttttggccacgattcatttataaaattagtttctgtaaagggtcaaattgtcaaaatttgtgagctagcttggcttcactatcatcgagaaacgataagtctaatgtgtactccctctagtcgtagatatatttgacacttctaatcaaacttttgaaattctgattataaaaaggtttcttaaatgacaaaaactggtctcaatatgtagagatttgtctaaaaaaatattatactaataacatagatattaaagcttattgaattttatgaacttaaattaatataaattgattgctagaatttgaaaagtttaaacaaattttatcctagatgtcaaatatattttcaccgaaaggatagcaaattttacagtggtcttcataaaatcgtcaatttgaggaaatctataacttgtggaggagcgcgggaaagctattttgccatttgaccttgtgatatatatttttaaataaatccaagatagtctatatatggtactcctatatcacgctacataaatatacaaactaaatttgacttgtataaataaaaaaacaacaaattgaactttgcatgatagtactagattttcaccatagtactagctagatttaacacaaatgttcgtatttagaactaattattatttcaatagtaggcaatatactcgtcaacagcgagatgtctgtaatgaatttattaatttcaatatatactagctcaattttttcaagatactcatagcagaaggatgtatgtgtgggttcataggaatgagtgcacacgtgtcattagcacttatgtttgtaccgcatttctaaataaaaaaacattgcacagtatgtaatatctacccgacgggttggaatttatttcaaataagtccttcttcaaaataattttataaataactcatcggtactaatgacattggcaccatcaccttcgtataagtgaattagctttttcggagacgctgagccaatggcgttggcgcagcgaaaggatccaatcacggaataaacttgtttagggccttgcttgctaaataagttttcacaagggacccaaagtgaaaaatccagtcgtagaagtcgcttcccgtggcaatatatatagtctgatggatgagacgcgaaagaagactgaagacaacgatatcacttcgtcaccttgcctatttccgcaagaacgatcgcacgatgccgtcgtcgccatcgcacccgcacgtcgccgtggtggctttccccttcagctcccacgcccccaagctcctcgccgtcgcgcgcgccctcgccacggcggcgccctccgccaccttctccttcctctccaccgccgactccctcgcgcgcctccccgccaccgccgtcgtccccgccgggaacaacaacctgcggttcgtggaggtgcccacggatggtgatcaggaggagacgtggccggtgtggcgccggatggagatgttcgtcgaggctgcggagggtggcgggctcaggcgggcgatggaggcggccggcgacgcggctggcggggtggcggtgagctgcgtggtcggggacgcgttcatgtccatggccgccgaggttggggtgccctgggtcgccgtctggacgggtggcccgtgcgcgctcctggcgcacatcgtcggcgacgcgatccgggaggacatcggtgacgacgacgacctccacggtgctcgcggcgacgagctgctcacctcctaccctggcctcgggagntaccgcgtccgcgacctccccttcggcggcggcggcgtcggcggcgacatgcaccgcgtcatgaccatgctcctcggccgcgtggcgcggcggntgccacgcgccgccaccgccgtcgcgatcaacgcgttcccgggcctcttcccgccggacgtctccgccgccctcgccgacgcgctccccaactgcctccccatcggcccctaccacctcctccccggcgccgccgccacgcaagccaacgacgacgaccccccggctgcctcgcgtggctcgcgcgccgccccgcgggctccgtcgcgtacgtcagcttcggcacggtcgccgcgccgccgccggacgagctccgcgagctggccgcggggctcgaggccagcggcgcgccattcctctggtcactccgggaggactcgtggccgctgctcccgccggagttcctcgaccgcgccaccaaggccggcgactccgccgccgggctcgtggtggcgtggacgccgcaggccgccgtgctgcgccacccggcggtgggcgcgttcgtgacgcactccggctggggagccgtcctggaggcgatgtccggcggcgtgcccatggcgtgccggccattcttcggtgaccagcacatgaacgcacgcgccgtggcgcgcctgtggtgcttcggcatggcgttcgacgacgacaacgacggcggcggcaagccgtcgatgatgacgcgcggccgcgtggcagaggcggtggcgtcgctgctcgccggagaggaggaaggggcccggatgatgagggctagagcacgggagcttcaggccatggtggtctcggcgttcgagcccgacggtggatcgacgaaaaacttgcacaaatttgtcgaaattgtttgtgcccgtcgggtgtgatcgatacatgcatggcatcgatttttagaacttcagaagaaattaaaaattttagaacgataagctacaataatgttatatatcaccttaacctatataacaatatcatcttcttcctccatttcagattataaaatgttttgattttgatcaaagtcaaactactttaagtttgactaattctatagaaaaaagttgtaatatttttaacctaaaaaaatatatttgaaaatttatttaattatagatttaacgaaactatgttggtgttataaatattactactttattctacgtagtaagttattctacgtagttagtcaaagttaaagtagtatgactttgaccaaagtcgaaacgtcttataaccttaaaaaattaaaatattttactatatttatgaaaaatatttttaagacttgacatgtaggagatgtaagatttgagcgcacgcgcgctcactcaagttttataaacagacttttcattacaccacgacacaaaatccctaatagaagatcagtcggcaaagtacacattcaaagcacaatgtcggttgggaaaaaaatttcatgatagacttcaatattatatttctagatatggatacagtctccaatatttctcgtgttgattatattatatttataaacctataaatgaatttatacgtgtaatttgaggaatttactagccatttgcgtttctagagaaaaagaaaaggtagaggttgccatacgaggtatatatagaggaaagagtgtttgtcgtcggacggaaattaaaactactaggaggaaatgatcaattatattattttaattaattactgaatcattttttagtacatttaaacgactaataaccatgtgtcacttttgcaaatcgtcatgggaaatattatctatgcaacctacattttataatcggagaggctatcatttaattttaatttgttgaacaataggggtggataacataccaacggctcgtttgagcttatctatactttctataaaattataacccactaagtctaaagcttaacatgcaaccatgccacatcatcatccactagcaataattaggctgtgtttaattccacgccaaaattagaagtttgactaaaattgaaagtttaaagaaaaaagttagaagtttatgtgtgtaggaaagtttcgatgtgatggaaaaattggaagtttgaagaaaaagttgggactaaacaaggccttactttttttttacgaattacacagcacaacgcggacacactcacccctatgaacgcacgcaagcaaactttacccatatgacaaagtcatcataggcgcctcgttgtcgacgggtatgtcgccttctaccgaaagcacaatgccgttaaatccttgaaaattcgtttccagggggagtcgaacctaggacctaaggtgctactgaggctctagtaaccactaggctataggtcctttcgcaataactatttatttaacttcatgcaagcatgcaatatatatcatctacaatctatttaattgtataaatcaagatgcaagtatatccaattatcacccctcacatcatttacataatatttgcacagatctatctatcatttttataatatttaacattatccctaaaaatttatttcacattaaaacaggggtgtcatttatttgtttcatgataaatattgataagttttaacgtttcattatctttttttactcatagcttgattgtcgaaaaaatatattaaaaatcgtttagttattctagcagcaaagcctagctcattaattcatttatcttaatgagaagcctagctgcttggctcacgttagctcattaattcatttataccacctttataattttaaatttgctatgttataaaaatagtacatgatgaactcactcattaatacttttatactacctttatatactcctatatatacgtaataataaacactaactaaataaatagaaatagtttgataaaaataaagaactaaacactagttaagaagcactactgagtacataaaaataatgataataaatactgatatgttgtactaacactcagctcacgagcttggctcgttaagcttacgagctaaaagcctaatttagtttaactcagtaacgagttcgaactgatacaaaccataagcatcgaactgttcttttccaccacatttctaaaatgtcccttgacaactgagaaagctaccaatcaacagagctaaaggtcaaggaa

SEQ ID NO: 38151 - DNA, 246 bp, Oryza sativa
tgtcaggccagacgactcggcgattttcgaatgacccaagcccattcgagcgtgcggatttcggtcatgcgcccggaaaactcgaattgcaggcgaaccgccagcgtcacggtcggatgctccagcccctgggcaaccgcacggtcgaaggtaagcatagagccgccccagttcctcgttgttgatgtaccgcgtctcgccgtcctcgcggtacttggggacgtgacggcacggattggagccgtc

SEQ ID NO: 38152 - DNA, 1002 bp, Oryza sativa
attcgagcctgtaagaaagaaagttcctgagatcatttcaagagttgatcaaatcattttgaataccataaatgcacctacagctttcagcactaatcaggtacttgaggaaaggggcagattgactggtagaattgattcactatactatgcaaaccagaatcttcgaggtttgcttgcagaaaagatgaaggatattaaggatttatcacgccaggtttctgatgccagcaggaaaatgtcatttcaattgtcactggaggagaaactttcaaggcagctccacaaaattaaaggggactatgaggatctacacattcaaagcactattagagatgaagtgtatcaaactgttacaaaaagaatgtttgatgattataggaacagcctgcaggaccctgcactaacttatcaagaaaaagtgacttcacttgaagctgcactctcagaaaaggagacggcgttacgtttagctaatgaagaaaaccagaggttaaaggagaagttgtcaaaacaagaaaaggagcatggcatccaaaataaccaggactatcctgagttaatcaaacaagacaatgaggaaatgatactccgtgatatcgagatggagcctcatgtatcacctaggagatcatatgccatttctgagcagaatgcagagtatgaggagctcatcaaactgaagcaaactttagagattgcctcaactgccttgaaggaagttgaatcaaacgaattggattataatggtattctaggtaaaaatgagcaagaaaagcaactagaattcattttggtatccattatggatttgtcaaaagaatttgtgcagattgaaaataaaatgtcaggggatatgaagggaagtgaaaaagggtatgtccatctatcttttagtctttctaattactaatctcctgagctgcctaggccctggtgctcatttttcatgcagaacatagtaaaacagctcaattaggctttctttatgataatattatg

SEQ ID NO: 38153 - DNA, 2506 bp, Oryza sativa
gttaaaacatcaggaagatgtatcgcggtattctttggtcttaggactcttgaccttaagtctcaaacaaacttgtctaatactacctccattttttaatatatgacgccattgactttttaacaaacgtttgaccatttatcttattcaatttttttgtgcaaatataaaaaaatgtcatgcttaaagaacatttgatgataaatcaagacacaataaaataaatgataattacataatttttttgaataagacaaatggtcaaacgtatatcaaaaagtcaattatgtcatatattaaaaaacggagggagtattcagtaatatttatgtttttactacaaaattactgtttatgacaggcattaacaagtgcttactattaatctacccttgatatttttacagataatttagcaatatttagttgacaaaggctttaggatttctagtaggataattgatgccatggtggaggagcaacatgtttcaagcatctgaaatctctccatgagcaaatcgaccaagcgaatatgcagtcattatgaaatcaaggggattcgtcagactcaattttggacctctaggtgaaaggcagttgcaccgcatgtaggtatctgatttatagtaatgtgtgtgtctaaagtctagatatcatgtgggtgatgggtgcagtaacatcgtggaagcacattgcctcactccacagatggttttgtaggttttcaccctgtatggtgtatatagaagttaatactgaatagccttctgatgcagtgattacggtatgtttagttcgtaatcggtgagggttgatagcatttttgcctgcagcctgtatagaaatgatgtttctcttagttgtatactacacatacatcatattgtaagaattcacagcttcgaagtaagttattatttccttattttttggggattaattatgaatacaacgggatactgtcatgtacaatatttgctgattgttttggaggcaaattcaaactaaattttgtaatttctttataatttggaaactgaagttgcgattatttgaaatatcaatttcaattgtgttgttgctagctcgcctgtccagtggcctaaattatcaggtagcctcatgctcatgatgcagttgaaggttttcttgggggataaatttcactctaaagtgtgcagtttttttgtaaactgcaaagtgaaagttggggttcctacactatgttgacactaatgacatgcaaattttggtcatcattttgcagttttggtcgagcaatattcaacatttcaactgcatagtaagtgatgttgcttttcttattgcccttatctgttcatagtcttgtgctgcctgtgcgtgcttcctgttaaagtttagttgataaattgaaattttcatttggagcaaaactctgattctggttacactagtttctttatctttctcatgatggtgcttcttgaaacgattacaaatatccaaagcaacttggtgcaacaaatgcaaaacactaatgtaatatacaagaatatgatggaagatcacattctaggcaacagtccgaggactaccgtctaattcacttgctacagcattccatgccaacagtgctgcaccaacagctggttccacctgcaggtaaagcaaatataagctgatgaagatcaatttaaagatttcgtcatagaatccaaaagatatgtgatgtagctgaatttcttccatttctatttgaatcgatcttaaattttactcaatcattgaagatagaagaatctgaagacgatatcttgtagtagtcattatgatcaaaggcaaactattggtgcaattctgcatttgtgttcaccttggggtgtattggataggctcctggataagttttggtaacacaatctatcacttcttttccaatgtcccatctcttgtttgccatgagaactttaccaaccataacaagaggaaaatggtcttttccatctgcagaagcataagcatcttgtaacatgttttgttgaggtaaagccaataaaggaattttgaggtattatttattttttatgagcactaatttttctcgttttccgtttttatatctgaaattactgatgacttttgtgccaggccagttatgcatttcagttagaaagaaatccctatctcaccttcaccgctcaattcaagtctttgcactacagccttgacactggaagctagttcaccaactgaattgtgcaagatcttgtttgctacttcatcaccagcttcagcagattctaccacaaccggaagaaggtcagctattcgcgcccaagattggtcttcatatgtccagctgttgtgtgaagaagtaatcaggtaagtaaatgctatctatgctcggtgattcatttgctgaaatatatttcctgtgatattatactcttcaattatcatcattatgtgaaagaaatgccatacaaacatttcagcttgataaccaagttctttacaccataac

SEQ ID NO: 38154 - DNA, 3532 bp, Oryza sativa
ttgacatgacttggaaatatctccctaggaaacaataggatttgctgcaataaggttttgtgaatagctgcaaatctttcctgttctgttaaataaatagtaataagtaggcaaacctcagccagtccagcattctttgttgatcaatcgggtgattaacgccagccacagccaagcagacagcacatacatttgatcgtctccggcgtgccttgagaagagcttgagccatcactctttccagtgtctcccttgccttatcttctgaacatatcaaagcaaaaaaaaggacaagttctgatttttggcctagttttcaacacatttctactacttatctacagatcatcaccatgtgcataactatgattctatgaaaaccatgtaatactgaaattttgaataattttgtggccacagaaacttgtacaggagtcctggcatgcagatgagatgatacctccaacagagttgtggttggagcagccggcgacggcgcgggagaggacggggagagggtcggcgaagggcatggccgccgggatgcagacgcagacggtgttgccggcgccgccgtcgacgccgaggatgacgctccccatgcgcgggctctggctcttctccatgtcccatatctcaccacccgtcttcgtgtacctctgcatctctgcggacaccaacagcagctagtgctaaacaaacaaactgacacagtgacaatggagaaggatttctcttgctgtcacctacaagtctgcaactaggtgagtgcaaccttatggttatatatatgtacgcgttaggtgcaccaacacattgcatcattgtgtgtgtgcgcttcgtcgaggagaaagggacagggaagaagaagatgatataggaaatattaatgctgcaattgaagggcggctgtccacacgctcgtccaatggcgagacggccgggttaatttacatgtctacgccggacgtcacaggcttctaatctcgatttgtggttgtcgttttgctacaggatgttactgatcggcgtttctccggctgatgttaccgacggcagtgggttagcatactctcaattatggtatcaaatcctgaatcttgagagcacttttgggtatatttgcatttacaactgcattcttgtgcttgggtaaaaactgacatcaatttttacatgttaaactggcaagttcgagtttatatctaagtgttgttaattttcatctgaaacaatacatgatctttgactttctttttctgaaacttgcaacaggtgacaaattcaatgctggttggttttgccttttgtatgtccgaagagttgcatgatttgcatcagtgacatgtcgaaactgtgctgcagtctagcatgcatatgctccagctctactcacaaaaaaactcaaaccatttgtgctccaaatggcatagtattttgctgtcagaaacggcatgcagattagttcagcacttcaacgctagtttacttttcttacgccacattgtccaacacccactgccatcggtgacggacaaaattcctcttcccagaagacctgccttccattattatcaagactcaagaggacttaatccgtattatatgcagctgcaagaatacatataatctctggtcgttgttaccattgtttttggattgatctcaaccccttgatggcctcttctcctgccaaatggctgatttccatggcaccacagctacagcctataagagtacaagacattcaggaggagacaagtgagctgatgacattggataactttctagcttgcgtccaaacaaaagcagagaaaactagcgtatcttgagcaatctgtcaaggagttaaattaacctcaaactgatgttgctagcagcagatatgtactatccagatggggttgcacttttgtactgcatagagtatgatcagataatgtgtagcctcatgatccaaatggctccatcggatcacaaaatgcctatatcggtctgtttggtctcactctcatctttaggactggagcacaatctttcaaccatcttgcaggattggaacacagtcttccaaccatcttgcaagatcatgattcaattgtggaacaaaaaaaaaacatatatattcctttgggtgaagagcttatttttctttcttggcccaagacgctctctctgctttgcctggttgggccacggcctacagataggcatacaaactttgaattgggcccagcatggcccaccccaccaaggcaccaagagtccaagacgatttgtactaaaggattgaactttttcttgttgaggaaaaaagagtgccactgccagctgaattttgatgagtcaaacccaaacgttccaacctgacaaagcaataggcaaaagcaagcttcgctagtagctactccggagtagtagcaaaagaatacgctatatatgcttgcaatttgttctgaacaattaatcgaataagatgcagcattttctctttttttccatcttttttttgaacgacgacagattgttaatagttgcatcgatctgtaagctttaataatcccctatcttttctttctttccttcaaaaagcaccttttaattcctttcgctcgcctatctttcgccctgtcaacccagctcaaggaagggatgcaccagcctgcctttccttgctgcgagtcgcagtcgcacgctggtcaaaatcgcgacaccctggcgcgccgtggcgcgcccgtgcacgcacaaacacgcgcggcgcgtacgccacgcgtcgcgtccgccgcatccgtcgccacatgcaggtgcaaaccagcttgcttgccttctttcctgcagaatgattccttgtcctcctttgtgtcggtgatgctaataaaaaatttcaatttactactagtagaagtactatactactaccgttttatagaatataaaactgcaatttaatactgttctaaaatataaaaagaattagtgttcagtatagttattaataaaataggtagaattaaatgagagaagattctgattggttgataaatagataggtgaaaaactgaatgattgagagtggtgattgatttagaaaagaatgttggtagataaattgttataatttatattttaagataactttagtgtaagaagttgttatatttaaaaactaagggagtactacattttaccttgtctgttggcttggcagtattaacaatgcggtgaaataaacatataggactattatattactagttttcttttttttaatacgcaaggagattatattactagtactattcataaatttgttgataaaaacagcgaccaaaatctgaagcaacaagagacagataatgagataaacaagtgctgcttcagacaaaatccgtaattactactactcctgctgctgctctatacttgatggcttggttggtaactcgagggaaggggattgagagtttacatgaggtaattgataatgagattaagatgggaatttgatttttaatcccaatatcttatttgg

SEQ ID NO: 38155 - DNA, 2012 bp, Oryza sativa
agttccttcctcaattctccatacccatctcaccaaaattcccatgtctcccaatcaaacaaaacaattaataacctcatccctctaaactccaaatccctcctaaaaactccctccaaccaaacgggctgtgagagttcacacagaatccagaatccagctaaggctgtgtttagatccaaacttccaactttttccatcacatcaacctgtcatacacacacaattttcagtcacatcgtaccaattttaacccaaacttccaactttggaaggaataaacacagcctaatctgcataagctcctacttactgtatctgcataagctgcaccgtacacctctgtacttgtctactgtaacctgacacacttctaacagtagtaacatggatcgatctctgtccatactcctgcaaattatcctaacaccataatctaatcaatcacccacgaccctgtgtccccccatcagatcagatcatactaattctctgaaagtttctcccattatgcatgcacattgcactgacagtgagtgacgaatgctactacagcattcatggctcgctagtacagtacagctgctgagctgcatctgcaggtgcatctcccctaaaaagaaaaatcatctgctactaataataatcagattcagacgccgactgaaatcccactgttcgcgctagcgtccattcggtgcagagacaccggcatgtgctccccaagaatccgctccattttcttttcctctcttttctctggaactcagctgattgttttattctgaattctgatcagaaaaagggccagagcatcgtgtgatgattgagctgtaaatgagatcaagctggatcgtattcagacagcagattggcgactctgatctgatcacgcttgctatagctagcttgtgatgattgatgattgatgattgattgattgattgcccggtcccagagcctgcatttgcatcagccagctttctttgctcgtcatggacagtggcagcagcagctgcagcagacagcccacgcctgggtgctcatgtgggaggtcgctgcatatctagcagaatcgcaatccacatttcctcctgcggatatctctccctgtctccctccctccccctcccaaatccaatcagtcagctcctgcatcacattgctgaatttattattaatgcttgcttgcttgcagcactagcattctactggtatttgttcttcagttcttcatgtctctctgaacttctgaagctgaagtgagactgtgcagccatttcttgtgccaaactgtcactcttcagtttcttcttcgctggtctcctcttgtatttatgggtttggaggtttcttggttttggctcggctgctgcgcgtgaatcgattggtgagttggagccaagaacctgaaatcttcccatttctccattcttcgcttcgatttcagtatttgttttcacctgtcatattcttccctgttcttaatctgttccattgcctttcccctctcgtgattaacgactccgggttcatcgccgctcgcagttcggatttctacacatcaaggagaaacaaatctttggtgattcagctagggtttaatagtcctcccaagaattgcggcgctggaggttatcgaggattgcccaagatgaagatggagtctttcgcttggttgctgttgattcttgttctattctcgattttggaggatgtgcgaggatcaaaatccaagccgatcttgatcaactgcggctcagattccaccaccgatgttgatggcaggagatggattggggattcttctcccaagaacttcacactcagcttaccaggaacagttgccacagctccagattctgatgggaaagagacatatggagatttgtacaagaatgcccggatcttcaatgcatcctcaagctacaagttcatcgtcgccgctgccgggagctactttctccggctccatttcagtcagctacccactaatttcagcaccaaagaat

SEQ ID NO: 38156 - DNA, 12130 bp, Oryza sativa
ttgatgccgcctcaccgcagatggacactctttgggttcagttgggatctgaatcctcagcaggtccctgcgctactgatgcacttctgaatggcatggagatctttaaggtcagtcggaatgggaatcttgctcatccaactgtgaggattggaggtttcaacagtgccatggggaaaccgaaacgtagccccaagtgggtactaattggtgcagctgctggtttggtgatttttgtgtcaattgttggtgttattttcgtatgtttctatctgcgatggaagaagaagacttcagctaacaaaaccaaggataatccaccaggttggaggccacttgtgctccatggtgctacaacacctgcagcaaattcccgctccccaactcttcgtgcagcaggtacgtttgggagcaacaggatgggaaggcagttcactgttgcagaaatcagagaagccaccatgaactttgatgattccttggtgatcggtgttggtggtttcggcaaggtctacaagggagagatggaagatggcaagctggtggcaatcaagagggggcatccagagtctcagcagggtgtgaaggagtttgaaactgagatcgagatcctctcaagactgcgacaccgacaccttgtgtccttgattggctactgtgatgagcaaaatgagatgatcttagtttatgagcacatggcaaatggtaccttgaggagccacctttatggaactgatcttcctgctcttacatggaagcagaggcttgaaatatgtatcggcgcagcccgggggcttcactaccttcacactggacttgacaggggtataatccacagggatgtcaagactactaatatcttgttggatgacaactttgttgcaaagatggcagattttggtatctcgaaagatggtccacctttagatcatactcatgttagtactgctgttaaggggagttttggttaccttgatccagaatattatcggaggcagcagttaacccaaagttcagatgtgtactcttttggcgttgtgctgtttgaagttctatgtgctcggccagtcataaacccggccttgccaagagatcagataaaccttgctgagtgggctctcaagtggcaaaagcagaagttacttgagaccataatcgaccctcggttagagggaaattacacactggagtccatcaggaaattcagtgagatagctgaaaaatgccttgcagatgaagggagaagccggccttcgattggtgaagtcctgtggcacctagagagtgctttgcagttgcatcaaggtcttctgcaaagtgcgaatactgatgatttatcacagcctgaactgaagctctctgatgcatcctgcaatttagggtgcatcgaagaagttgaggaatcctgccgtgcagggtcccaggatgtgaatgaggaatatgtggatgtcaaaattgaagttccatgataatggaatgctggtcaaactagtggcttcaagcaactgaatagggtgagtgtcaaattaacaaaaatgtttagatgcactgctatctagtattgtaacaccatatatgagtgtccctacaatgtactgagattattttggtacagttaggagaaaactctcttcatttcttttgtacttgtgctgatgtacaagtctttatgatgcaaatttcattgattcttttgtaaaattctagagccgtatgcaatgcaatactgagcattaactggagatgtgctacagagtgaatgagtttttcagttctcttatcaactgtgctctgtattgagcttcgtacgcagtattttgctacccgttaatgttcagttagatattcttttagccagttgttgtgaaccccatatgtttactctgcttattgagcttctatattattgcacgaacacataagaacattacttacatagttttattcactcagaagttaattctaggaacatagctgtacacagatccattctagaatatgtaaaccttgcatggcactacaataagttggttttcttcaaaacaagcttcaagaagccaaggcactagtattgtagacaagaagagcaccagccagcagaattccagaaagagtgactgcccagagcaacaaccctgtctttcctgcataaagcaagggatgaaaattatatgtgctttggaaattgatttgtctgatattttttaagtagcggtgagcgctaaaaagtgtttggccttttgggatggttatatgtgcttacctccagtataaacatcaccacttggtgaccattcctctgggttatatattgggctacaataaatacagcaaatatccattatgaaaattgaaggcaataggtgagttatgaatgttatgcctgctgttcttctattcagatgaatgttttacctgtatccatcaacattagctccatacttgctggcaaactggtagacccctttcccctaattacaatggaaaagaaatatagtgatgagcaaattttactattgttgatttttctctaattttgctttcaacctcagccctgaccttgattggccttccggacgcgtcaacaccgtctttcaggttcggtcctcctccaggtcctacatgttaacattacatatgttcatatataaaatagtactatgttgatagtgtcatccattagaatcagtgctagttctctgatttttttctgaaatagtttgagccactgaaaagaatggtgtgcttgtgcatacatgaaacaaggggcaattaagctactaacttgaagcttaacctctatgcagtttttccagtgctaaactctgtagcgtgtactaaccgaaaggctgagaagtctggatcttctttgcttttttggccattactctgaacaaggatggccttgatgatggttggatggctcggattcgcgtctgttccaaaaatggagatggagatggttttagagcacaagaggccatgacagaggctgccatgcgtaagatgctatctcttactctccaatttgctgtcagtctcttttcttggctaaattgtgtaaaagtcttgctttaaatatacgaaggaaggctagaagtagcagcaactgactaagctttgtttgacaagtgtcagctgctatgtggcatactaggctcatggaccactactttgtgatcagtcgttgtccttcacatgaccaactgaagatgatagaattcgaaggaaacgtctagcgctgagtggataatcctgagaattttcttacttgttccactgattgagaaatttcgttttgttcttcgtgagtcaatttcaccaagtgcattcatatctgttccccttattgggaaatttctttcgttctttgtgtgtcagtttcactgagttaagttctgaagattattttagccgggttggccgaagaagaggccaaccaattgtattaagttttgggacaaaaagaaacaggaactgtacatgttggcaactgtacatcgacaggatgctgtcgaaaacggaagaagcacaggaaaccccacaattacaagctactcatcctgaaaaggaaacaggcctgcttccttccagatcatgagctcctccttgacccctccaaagagctgtgtcgacaagcatgattactgatcgaacactcttcaattctcacatagataagccaacatactatgaaacaaagcgagtcaaatgcttcccgcctatcaacaccgttctttaagttctgaagatcattttcatttctgtctgaaagaacatatattaatttctgtgagatttttgcatatagggataaagtcttaatcattgtaaagtaatctgattctcacatagataatcttatttaagagggtaataagttttatggtgcaaaccctcttctattatgatggaaatttagattcttaaggcatgcatcctggatagccatcctttttttttttgaaggtgatagccatcctttttgtggatatgctggatatcattcttattatctgaaagaacatttatcttattaggtgttgttaaatcagaaaatattttactaagacattgttaatatgcttttgtggttttgtactttcactgatgcagagtatgttttatagcacctaatttattattactattattgtaatactggagaatgacatgtaatccttggggatatttcgatgatgaagatttacttgcactccatggggatcggtacgctaccaaaactttattttccaatttttcagaataagctgttcaactgatttaactcttatgatccaacaggtgccaactctgttgaactcaaaattatttgtccctagagcccaagaacactatgttgctcactaaaacatcgttgcataacttagaattaacattactcggccttattcattaccaccgctggcagtcaagtccagtccaggtacataactggttacattcctagtgaagattatatacatggaagcaggcacagcttggtctgctgcacttagctaagccagtgcactagtgttgtagacaagaatagcgccgccaactagaattccagcaagagtgattgcccagagaagtaaacctgcctttcctgggaaaatcaagaaattttgtaagtacaaaatttgtgagaacaataaacatctcatgagaaatttaaataagcagtgcgcagtgttaaaattcttgtttctcgagtccttttttttgcttacctccaacatagacatcaccagttgaagaccattcttctggggtatatattgggctgtaacacggtagaagcaacaaaatgtcatggataagctatggatttcactgtttttacagataataaataggtgtttctcttttcatctccctcatctagatctgtaaatttctccttttattcattcacatgctttatcccatttttactttgaaactaatatttttatgagttactatatattattatttgtgcatggatctcaaatatattgttcttcattggatcggtaacatttacctgtacccatcaacatttgctccatacttgttggaaaactggtaaagaccctttccctgattaaatttgaaaaatttaatggtgaaaaataaccattttgtctgatatatatgcttgtctgagcttatagccttatactgaccttggctacccttccagatgcatcaacaccttccttgaacaccactcctccagcaggccctagatggtggcataccataactttgtgagaaggtaaactaatttagagaaaaatgaatggtaacaatcacagttctattcactaccatttatcacctttgcatgtaaaaaataagataaccaggagacactcattggtacccatgaaactgagaaacccattttccatttcatgtttaagccagttgctaatatattaactctgaattttacagcatgtactgaccatagggctgggatgtctgaatcttctttgctttcttggccactatgatcaaagatggccttgccattgtccctttccctcgaagcttcgaacgttctagtaatggagatgcagatggtttcagagccagagaagccatgacagaggcagccatgtttatgcaacaacactcaactgatcactcactctatctctgaaattaatgcaaatgatctcttatgcagttcatcatcagatatccatggctttaaatacaggaaggctttcagtagcagacagtgagtgactatgatttgttagtcaattgtcagttggatagtagctatgataatactgtgtcatggggccatgatcacgtgacaagatcttgtcttttacctggatgattagagatgatgtactgatgaaaatctgaagcaagcacctagttggttggttgatggataatcctggggtttcctgccctgcttaactattttcctggtcgagaaatttcaggtgtcaattctgatcatagcgagttgtctggggatcttatctctaacagagccagcgagttgtctgtaaacagtatattgatatatgcagttaatgttacatattttcgtggtaaaggatgaatggtgcttttttttttttgatatagttcaatttatatgaactgactattgtgtagtaggtatgaaaatatcagtttacctaacaagttgttatgtttttactcccaataatattataccacaaataaacgtacctaacctgatcattttacctacattatttgattctctccctgtagcctgatcgatctagcactccttgcaccaagctcccttttattaaaaaaagagtaactactgagttttgtttttgtctaacattgccgggacagtaattaaacaataaagtaaattttgtgcagattttagtattttacattcctgatcgagcctattcgtgtactaagtattcgtgtgcaatgcatgcataagcgtaactcaactttgtatcgaagagaaagaaacacgtagtacgttaatatgaaattaaacgtaggtcggtgcattactagtggcactgtgggtagcttatcttttactcctaaccactgtccttattaatccctgcgttatggaaaataaatcttaacgagtggagtactccctctgttctcatttactccgatccaataaaaaaaatatctcgaggtatcggtacctcacggtaccaaattatttctgatcattaaatctagttagacataatgtgtattgttagatctaacaattggaaatgatttggtaccgtgaggtaccagtaactcgagatacttttcgttggaccggagcaaatctcatccattcctaacaccttgagcagcaaagttgaagtagcgttagatccagacatgacgccgtgattgttatatgatgttatctgatccagttgtagctgcggatgccgggagaaggaagcagaactagcacgaccaaccgccaccaagtgttagcatctcatgctgccatgagcatccatgtacatggaggtaggggcgaagttagtgcgaaatggagagatgtatcacatgcttgctttactctactttggaccaaatttaagctgatgcgggtgtctaagttgatcttaaggggtggtggaaatagaaaataaacgaactatagctaaaaattttcaaaaccggattcctgggcactgtgtggaggggaaagggcggatatactcaggtacgggttcaaaattctagtttgtatgaaattttcaattttttttatgaatttgataatattttattcaaatttaatcaaattttattctaaatttcagtatatcggcaccctccgatacaaatcccaaaaatgaaagattgaaccctgaccctcgtgtggtttgagccagtactaatgacaaagtttgagcagagaagaatgcttacaattggaattattaggttacatttctgttgacatttttggagattccaaagatgattgaattttgacaagttcgaattgatactttcttccttttctttgaagaagaaaaaaaaataaaactttgattgatccgtacaaatgggccttcgtgggccgtgcgcgcgcgactgggcgagatcaagcccaagttcaaggccttagggaggtcgatcagagttttcttctccgacccttcccctctggcatggacgcatggtgatacgcgcacgacgacagccgccgggttcgcggccatgatctctgtctggctcgcgcccgcccggcgcacgcatccgctgatctcgccgccgcaggtgaacaacgcagccgtgccggcgagcacgccgacgcgcgcgtcatggacacggccaagtccctgaacaagaacagttcgaggtcgacatcgtcggcctcactgccttcccgtggtcgcctcgccggcgccggcgccggccgatgacgactgaggactgaatccccggtggaggccgtagactgtggcgtccgcgagtccgtttcggtgtttcaaactccgaaccccattgacagtgccggttacctcgccatggcctcccttagcttgctcacctcaccggtcaccgcacgcaccgacttccgaccaagttccgggcgccatcatccaatgcatgtgtgcagtgtcagtgtgctggtgaagtggtccgtatactccgatcccaaggggtcggagtcttcttctccgaacccccttgccacgtcaacgtaactccggttcattgttcgtcgactcgccggagcgccgccgcccaatcctggcggtccgctgctttggccgctctccggcggtcgcacgcgcaggaacacccacaggcatgcatgcatggtgatctgatctgatcccgtccgcgagctacgacgagaacgttctcgccacgccgcacgacagccggttcacggcatgctcagtctcgccgcttttgccagccgcagcgcgcggggcaaacggacgccatctcggacgctacgcacgccgcgtgcagagcgtcggcgtggcgaccgcgcgcatggccaggcagagggtgtgcagattaacctgatcgatccccattggaaattctgaatggcatgcagattctgcagttcttgtgggaaaaaaaaaaggagctcttcttcgaaaggcgttgttgttgtattattgggaatgtgctctcagagacaggcatgaactgaattactgaaaccatacaaggttgaagtaaaaaatgccgtactgttcttcaattgcgtaaatgatcatgttagagtagatttttttctctttttttttgaacaatgatgttagagaagaatatcatggtgcattaattgtttgtttgatgcagcacaaaaaggttccagagcaattacagtcgtcaataatccagatatggccactatctgtggattccattatttcatcaagtcttggttagattaactatgattcagattttttgttttttggtacctgaagtaatcatatcaaccgagaactactcctacatccctcgtgaaacgcacatctgttacagtgatgtactagtatatgatatatccaacgcgatattaaaaggagctggttgcaacttgcaaacaaaaatgtgcagtattttattcattagttgaccttattaaagtttaatttactttttttttctataacttgttaagatcgaatttaacactgcatatttaaagatgatatatcgtgcattaatatatcttgttaactttcgttataaaaaaataacgactatttctgtgacataaagaaacgtgatctgtacaaataacactgatcgatctgtacaaaatgcatgcgcccaacttcaaggccttggggaggtcggagttttcttctccgaaaccccctcccgatccaccacctcacgtacacgcacaacgcggccacacctcctctctggcgtacgggaagaagcaccttggcatggtggtcccgtcggccatcctaaccatcagcaagctacgacgtacggacgtgttcccgccacgccgtacgccgcgcacgacagccggtcactaccagcagattcacgaccaaccctgtaggagcgaaaccatcagaaaaattggttttaccgttagaaaatgtattcctgtaggtgaaccgtcagaaatcgccgatagaaaaaaggaccacgagaaattcaattttcctatcaggtagaaaattgcaactggcgtcaagaaatgttaattgtgacgtggacccgtcaggaaaaaccgtcgatcaggctcacggccatgatcgatcaggctcgccgcgcgcttttgcccggccggcgcaacgtacgcagccacagcggcatgcatggtctcccgcggtgtaagtcggcggccggccctagctagcgcccatgcatgcaaaccagacggagtagcaaacgcaggatcgttggcggcgaggcagaacggcgactgcatgcacacaacatcatcggcgaggttgccggccggagctcgcgacgcccctacgggatcgatgtcgctgccgaagcccaagtggtccttcatggctaccctgatggaccatggtcatccaatgcatgtgtactgtgctcatgtgacaaggaaggggtaattaacatagctcatctgatttttaaatacgcgaattggcttagtgctacacgcattctatacacggttggccgcctagcgctatgtgattcttttttataaagtcgcagttagctttgagctacgcgcattatatttttaagacgtggttgccctaaagctcgcgttatattcttaagccacgatttgcccagagctacgtgcatcatattttatgagtcggtatattactcagagattaacaccgcatatgctataaactaatattgagtcacttggttggttaaaattatggttcttactatgtgcttagttgtttcccaactaagcacatagtttgctacagttatcaggtacacctattcgatgtacctgtttatctatcaattcgatgcacctatttttttaatttatttgacgagccctccacagtctctttgcaagatatcaagataaggacttaataagtaaacactcgggaggccttcgcaaagaagattgaagcactcagtatcggtcatgaaccatagagaagactgtaactcgacttcgaaggtttcggaggctaatgtggataatatggataccggataaccacgtgacctccatattcgactagaaatataggaggtgagccgaaaccatgtattatgtaatagagtaaggttcggttgtcatgttgtcctgtatttaaagacctctataccacgacgaggccgacggtggcttcgactgtgttcttccccccattttcccaacccacatctcttgttttccgcgcacacttttcaaactactaaacgatgtgatttataaaaaaaaattctatatgaaagtttttttaaaaaaacatattaatccattttttttaaaaaatagttaatacttaattaatcatgcaataatacgagctttgttttgcatgtcagggagaacccctcctccccaacacagcctagggtgcttcgacgtggtaggtgtgcagtgatggagctctacgatcgaggttggtggcagctcaaggatgttggtcgggagctcaacaaggtcaaggtgcaatgtgctagctggatgaggccactagcggctcaggagctcgacaaagggtgtgtttagttcacatcaaaattgaaagtttgattgaaattggaacgatgtgatggaaaagttgaaaatttatgtgcgtagaaaaatttcgatgtgatagaaaagttaaaagtttgaagaaaaagttgggaactaaaccggcggcttgggagctcgacaaggctgatcataaagtcgtaacagttggatctgggccaccatcgtcaaccttctcgagtacccgtaggccgtagtatgatgaccatcttcgtcatccatcggtccgggcacccgtcgttaatttgctcccaacgcgagatgaaacatcctttcccgaccaaagccaacaatggagtgaagagctcaaccgcaatctcagtcagatctgacgctacctggtgagaagtctctcgagagcttgtgagagaacaggcttctacagtaaaatccccctccccgaccccttttccccccgattccggtggttcgtcgccggcgagggccggaggaggggtcaggccaccttcccgtactagtatagagtaggttaggtcggagttcttccgtagtcaggtcttcctgtagctcgggtttgtcccttttggagtttcgccggtgttgcttcatggcgatcggagaagacgatggtggcggtggtgtttgtggccgtggctgtcccagtgtcgcttttaatctggaccgcagctggcttgctctccacatcaagggtctgcgcggtgtccgacgcaatcccggctgcgtcgctgaagatggacggatctggggcgtttggcgtcctttccatggcgacaagggcttgcggtggtggatctggtgcagctggcctcggttcattgcttggccagagcgatggaggtggatgtggtgtttctgggccggccgtctcaggctctctgacaaggacggatggtgttggctgcaagagctgctgctgctgctcctgctcgttgg

SEQ ID NO: 38157 - DNA, 5808 bp, Oryza sativa
cgtgtacccggacttgagtcgatcctttttcgccactcacgcatttctaccccgacaagcttctaccaggctcaccgtaaacaagagacttcactatccttgcgatttcttccttttgactccacctgcaacagtgctccaccttctctcgtatcaccacagttgtcttgccaagcgaaattgaattccttcctagctttcacatcatagacttcttaaagaccatgttcaactccatctaccgtcttaaatttgacttgatctaatccatggccagataacccacgtcaccaccaaatagataaatcaaactcaccagacttgaagagaaccctttcttccttgtcgtcttatgaaccgagctaataaatctaacatccatgctttcccgcatccgtagactgaattcctaataatctgggaaaatcaccgttgctttgaatcatccgaagaaattaccaccatagcgctcactcttcctcttcagcgacgcatatttcatatatccccatcatgcaaaccccacagatcctggatatatcctgtactgccaaacagtccgttgatacccttaacgttttcacccgttgttgtccaggatttttccttcacacacctttgccacactcctgccccaccacagccttgccttcgaatcataatgcagaagccctgatgcacagttatttttgttgtcaatccatgatctcaatctagccctagacgaaatgtccatgtgagtgatcaactcggcttggtgaacgagtcccattgaaatacgtgtccaatcccagccacctagcctccgtgctgatctccacgtccatcacgactccaagttgagaagcaactccgcaaccgaatcgacctccaacagctacacaaactgtacatcatccgcgaccctgattcgatccgataccaagaacttgctgctccatgcatggacctaagcacaatgggcctccctgccgcgcgcatgcacctatggatcattacatgcatttaactaatgtaccagcatgcatgcatgcaaaattagttaaccatgcatcgctaatcatgcatgacagcatatcaccgtgccatccaattgtgcttctggcctcctctgtgtgctgctcctttgcgtgccgtcgccgcctccgctgaccggagccggcccgcgccgaatactgtcagcacctacacaacaaccacaccatgccgtgttcctgctgtccggatttcgtcaccaataaatccgctctgacctccgattgaccaccgtcaatctagttgcaagcggaagccgacaaatcgcatgtcgtctttccagtcgccgaatgacccgagcgttacgtctagccgtctccctgtcgaacacaactcatcgaaagacccgggccagccctcccggagtgttcgattccaccgaccgagaacgtcgattgcctccagcttcaatcaaccccgagcgtgtggccacatgtctccctgttgagagtagctcaccggaaagttcgagccacccgcccgaagtgtccgacccacagattggttcaccaatcgcttccgccgccatcaacccgagcaccacatctggtcgtctccttgttgaaagcaaccatcaaactgttcagactgccgtctgaagtatccgattccatcgatcaaattccgttgatcgccaccatgttccacctagcgtccatgtccgtttcttgacaccctgtgtagttgtcgcagcatggagcacctcactcgtacctctaccatggatctcccgcatgctttgataccacttgttataaaaccaaccccgaaattgacatcagtagctaaacgcagaagaaatgccataggagatccaaacacaatgacgacaccaagacacgatatttggcacggagttcagctgaggcctacatctccggggcactgattacgggcgctcctccctgattagcatatataacatatcagagttacaacgactcacggccagacgccgccggcagccgctccctctcgctatgttaagtcgccatgcggttataacaggcacacctctgtatttaagagagagatcctaggatagagtccgactcatactttagtcctaatacctattacaactccaagtcctaaattgtaaccgactttatacatataaccgacacaaactcttacagaaagtatagattgcgtggtgatagattcaggcatctctccaaatttactatggtaggtttatatctcatcctaagcttaggttgatttattttgaaaccgagagagagtagactatatatatatgcatggaaattaaaaagaaatgccatgtgtacttagaacaagtacattcaattttctccctcgttcgaccgccatgttttcaaacatggatctcacaacctaaatcggaatttctaacctgcataaagatgacgcaaattccagtaaccctcccgatcgaaataaaataaaatacagggtttgacaatatttatcacacctcgcttcaattgtagatatatatttgatgtttacgataagacttgttcaaatttttggagcttaattttaccattacttttatattagaaaaagttccgtattacccttagactttctttctctactccttggtctgctcttttttcttggtgtcagtagttgttatgcaattcttttttctcgatgatgtgatttttgttctgtcagatagtttttgtatgaaataacattggttaatttgagggaggaggatgaagatagatacactgtgtcactgctgaatatcattccaattctgactcgtcccaaaatttgcacttcatctctttttgcagctcttgtttattatcttgttatatttcgtggaattttgcatgctgttctcctctttcatttcttctttggtgatttccaaactaacaacttgaatcgatactaaactgacgcccagtcatgaggatccgtgcatgcagtgtctagggacactgctgaatgtcgttccaattctgactcctcccaaaatttgtttatttcagtatcttgttgatttatttcgtggaatcatgcatgttgtcctcctctttcctttcatctttgctgattaatctttcagtatccaaattaatcaggatttgctcagcagaaagaaaccaattagctcttgcctcttgaagcctatgtgaaagctcatgtaattttgcagttgcaaaaatgtacaactttcaggtgacaaaaaatggcatagggatgtacaaaataaacattaagaggaaaaggtttcgtgtttagaactttaaaaccaagcaatcaaaaacattttcttcctcgaagatccaacaacaaagctctgcatcaagaaacattccattggttgacagaaacaaaattaagctagataagcactgattccacgcacaatttacatgatcattacatcgtccatcacacaggcactcatgcatcgattacacataggagtattgattcgtgtgactagcttaatgaatttgattagccgatgatctggtccaggacgccgatgttcttgaggccgaggacgacgccgacgcccatgatgtggccgacggcgccgcaggccagcgtgtcggcgagcgtgaacccggcggggtcgccggtctgcaggccggagtcgcgcgcctccagcttcagccccgccgtcgacttcctgttcgccgacggcgccagcccgaacctccccgcgaacagcatcagcgtcgtcgtcgtcaccatgatctgcatcgcccccccaaataaattgcccatcacattccattcacatcaagcctaatcacgtcgttgaattcagctaattaaccacactgataaattaattcagtgtgtgtgttcttacaacgttggtggctgagccgatgtagtcgcaccggatgccctgggacctcttcttgctcatcctcaacgatggcagcgtcacctgtgattaatcaagaaccagggacaattaggaatgtgtaattgtatgcatctctagttatacttttcgttacaaaggaaaataatttgatagcattggatcatagaaggaactgaccatggacctaggagaggagtaggtccggaggccatggaactgcggcacggatgtggcggcggagagctgggaagccatggctggagcctaccttctccttctccttgcagctgagtttcgaggaaaaaaataatgtcaagtgccaccatggagatgcattgggctttaattcttggaggagatgtggaatgggagccacaaggggagcttgtggactgcagtggccactcatggataggttacagatccttgctgctgatgtggcatctcctggttagagcctgccaatgtggataagatgctcacctctgcatgcaatgttcttggatgcagctgcaaatgttgttggtggtgacttgatgcatgttctgtcaaaaaaattgacaggcatatatagtgagcaagagaatgggaaagaggaattatgtggagcagtaaaaaaaaatggaaatcttggtattttttcaaccgcagaaaaatgagtaaatgaacctggatttactgtccctgtaggctggaataagtgcaagagaatgggaaataggaattatgtggagcagtaagaaaaatggaaatcttggtatttttcaaccacagaaaaatgagtaaatgaacctggatttactgttcctgtaggctggaatgagttgcttgcatcgacactgaagtggatgtgccactttaccagttgctcctttgctggtgctatgccgagtcatgaactgaaataatcaagaacttgaagcccattgcttgcaattgcagaaatggattttgcaatgtgaaacaacgtggcgacgcatcttactgctgtaagcctacaccacgatgagattacctcacaacgcgcaaagaattaaaatagaatggacacttcaataaccatcactcgtacatatttccatttcgaattttgtatatgaaaccaacgatgacgagccaaaaaaaacagaaaatcttcccaatcaatcatatagcctaatatgagaattgcatacacaacttgtatattaatgcaacaccatatcaccaaccctccctttcctatgtacatttcatgagtatggaaaaccagggtcagaagagcaacccgctcctgatttgagaaaaagaaaaactttaacacactcaaccacacccatacacaaaagctgccacgctccaaatcctataaatattacacatcctccaaactaaacaacttgaatcgatactgaacaaccttttctaatcggtttcatactgtaagttatatcaggttggcaactcgatcttcatgcttctatcttgaggagtgagttgagagatgtgctgttgaacttttgagcaagacctctaatcaccagaatgatgacgtctcgcatgtgccgagtttgcaccatcaagtcaacttcgctctcaccatcaacaacaatcttgaagcggtgctgatcgttgcgatatagctcaacctgaaagattcaatgaacagttagctttagttataaatttgcgtaggacagggattatacattctaaaatgaacattttattttccaagttcatgcaagaatttacatggaagggtggaacatatgttcctcgcacttctgtagttgggaatgatgccttggatccaggctttacaactttgatcctcttcctattcacttctaaaattcttcgctccaaatgtcccatcacttgtgcctgttaaattgtttgtttttccaaaaaaagaaaagaaaagaatgtaactt

SEQ ID NO: 38158 - DNA, 19656 bp, Oryza sativa
caaaacctgttcaatgcaaattttatgcacttgttactaaacaaagtattaattgttgcaatgataacaataaaaaaaacattactgtgaaggtagcccatttctttagataataaagatagcccaagtagaaatgtaattatgcttgagacagttactattgactgaaataatcactctgctgcagaattgctcagcactcaaatttggaaacattagctgtgcaaataggaaacaagtatgctctccatagtttgacgaataagaggcccagctatccatgacagtgagacagtccagtagtctaatactaccaaaaaggaactaacatcagtattgaaatgaatattacctcaaacttgacagatccatcatcaagcttctgcttcacctccttgtaaatttcaggctctgcataagaaaaaaccaagcagttaatagaccaggctgacaaccttaagtaatgctctgaagattaaacttaatagtgaataaatataactatcgcagaaagtaaactgaggctagaagaaactgtttagctaaccgctgccggatcaccaaaaggataaaaaactgagatgatgataataataaatgttagtaggcgacaagataggtgaatggactataccaactgcaattggctccgttgaagcagagataggttgtccctcaactccatcctctctcacaggtgtataaatgataacaagtctataacctacatcatcaacattggcttcatatgttcttccaatttcgcctgcacaagaagttaattgcaatataagaatataagtaccaagaattgaagcaaaaataagtgggcatcatcttgtgcccattaggatttaaaagtggtaaatattatatcatttaaaaaaaatgtagaattcaaataatcataccaggtatagagataagatctgggcttccaaccatagacctgagccattggattttgctcttgccttctttgcctccagaataggtaccccgaacagcatacaggttagtgtggaaacctcttccttcaatctccagtttttcaattttaggttttcctgttaaaatcaaacatcacgcttcagtggtattgcaaattttaatgatttgcatgaggatggatatcagtacggtcatcaagcaaacttggcaatagagattaatccaactagccaagcctcttttagtagtatatacacaagaagttcaatgaagatgacagaagtacacacttatgcaccaattgaactaatacaacatgatgcatccaaaccccaactgcaaagagggagtcaagatgcagaagtgcaagcctatggactgatcctctacaggcctatccattttgaaataaataatgaatattttgctcaactaaaatatccatcagtttcacaaagttacaatacgcatgctgatttaatcaataagacataagcggtagacaaccaacctggtaagatcggagcagtcacaatggatatcaattcgctggatcgtccaaatacatcagagactgagcattcacatttcaggcatcggccaatatcttcgaaacgtactttgtatgagcgagagcactggttagccagtggctcaaaagtctgatccacttcagatccactggaagcaaacctgcatccagagatccacagcaagtgttatatgccatattgaacaatgtgacaaagtcatgactcacgacatacacctctttgcattaccattgatatgttatctctttcttgtagttactccatagatgttgttgaactgcagtgcttggaatttgttcaagaacagtcagtgtctctctctcaacctgatttcccttgaaagagagtgcttcgattttaagtcgttctggaaagaaaaggagaattaatacatgtagttgcatggaaaatgtgaacatagaacagtatgtaataggttcagatattaaaattaccagggagaattatatcagatggctcagagagcctttcttctccaatgatcccatcagaacgaacgggaatgtacctatcaagaattacaaaatatcatattccacaaatggaagcctgatcggttatgcagtaacacaatgtaaccaagtcattttaaatgtgagcaagaccagttcaaaatagaaaaattaaagtgccttacccaaacagtagacggcggctataatctgcatctgtcacttcatatataattaaatcagcaccatctatacaatgcctggttccatcactagattccctgtaccacttatacaagcttgacccctcatatccaccataatagactcctgttccgctatacaacaatgaacttttctgcttcaagtgaacatccgaaacagatggaaatgctgcaaggttggtaaaggactgaggatgtgcaggcagtagtagtaaacacacaacactggcaaggaaaagatcaatgggcaacctgccatgacagggtcactggtaacagccaccaacgggtcaccgatctctccatcatatcgtgcaggaacccagtgaagaatcaagtagaaaccaacatcatctaacgaaggtttgtacatcctgacagcattccattagatcaaagaggattagttcttaacctaaaccattcaaaagtaacaagcttgatgaaatcagtaggagaacgcacaaatttactccaacttcagaacatgaagccaccagatcagcctccaagttgtcaagcttctctttagttcggtaccatgtatattttccagtgccttccttaccaccaaagtaggttttgattggagaaatttcattgtcttgaaaacactctggtagaacaagatcaacacccttggggtcccctgtgccaatgatggaccaacaaataattaatgacatcgattataataatattattaaattatggatgaaatatgcccaaaactttttttttttgaactagagccagaaggctcccatttcttttactagaaatgataggctagtaacagcagtctttacaaaagcaaagagaaaagattagaaactaaacatgagggtcactccagaatctgccggccctagttcagaagattccacaaacgaaatgctacccctggaccattacaggcttgtcaaaacaaaactaggacccgcaacagcaaacataagcaggcatccatgcttatgtttagttctggtcctagcacaaaaaactaggacccgcaacagcacacttatgcttatgctgaaatatgcccaaaactatattcatcttatctgctttggtggacaagatacatactgacataaaatattcaggtcctagcgcaaaaatataacattctgaggaaaactaaccaggtagaattgtatccgatagaacactcttaggtgacccttgtgatccatcatctcgtacaggtgtgaatataagctcaatgcgcgaatcaacatcgtctagagtaagatctagacattctattaagatacaaacaatcaaccattagtttgctatgcaaagagaaaagaacaaacaaacattgcagctgtgtgtgaaagatagatactatacgcatgccatgaaagaatgcttaatgtaaactaaccatcagtagacaatttctctttgctgccatcagaatgtaatctgaaccattcttggatgcagtctcccttgaaactagaatgataagaaagaaaaaaaaataatgtcatcaaatgtgcggcattagacataatctaaaacggaggtaatgtatctcaccctcctgtatactcagcatgaaaggtcaaacagccaccttcaaccatagggccagctaactcaagagataagcatgtaggtggtcctgtaaacaggtaaattacgaaaatgttagtcctccgtttagtccacttattgtttttcaaattaagaacaaacgctgaaccacacaaccaaataagaacacttatttgccaaagtggtcaagttatcagtttatctaccaggtaagataggaccagactcttctgttgacaccaaagaaccatgaactccatcacttctaacaggctcacacaagacagatatgtaaaagccaatatcattacagttcaaggtgtatgatgaacttgcagccccttcaatttgtttttgtgatccatctgaactagtctgtggacacaaaaaaagtttataaggatgtagctggtaacttggtacatccaggcagttacaaatcactgtgccattgttacgtgaaagggaagagtagtgttttaataagaggaacctaccaatatccaacggaatatggtctccccttcttctcctccccaatatcttctgctggcaaccattgtggtcccctcaatggcctcaccagttagttcaagagaaagtattgttggccttcctgttaacagttagtgaaattgaaattaaatatgatatattttatttcaatcagcaggcatctagaatatgtcataaccacaagcatctaggacatgtcataaccacaaacaaagaaaataaatccagcaataaaatgggcagctagaccacaaaagagagttaaaaggtgtacttgaattattattttttaaaaaaaatacatctttgtaacctcatggttcgtattacatgagtatatgaattattcagacagaatcctcatttatctgttcattttcccagacagccagtaaacaaacatctacagtctttcagttaaggaagaaagaaatatataactgtcaaggttgttcaggcaaaaagagaaaacaaaacacctggtgtgactctgtcctttcctgtgaaaactcttggctcaccaagtataccatcattcctaataggtacgcatttgaaagaaaggaactttccaacagcttcctttgtaacttggtattgtagcagacctgatgcctctgaaaccagactgccttcatcatcctcagtctgcaaaactttatgccagttaagaaccagtgtgacataaagaacacaaagtgctactgagtaaaactagcgatcagaatttggcattctttttctcctttctataatacaaagaaacacagctctcttgcgttctagagaaaagaaaaatgaattcggcaattcactaattattataaatctccacttatgcaaaagcataatatgtacagtgagtgttatattgctatttactgggtatccaggatttaatttagaaacaagacaaatatggcttgtacctcatgaagatgccaactaaataaactattgccttcatgtcccccaatgtaaccatatgatgctgtcaacatttggccctctgagaattcaccagtgactgtcaaaaaattcaggctgggtggtagcactgaaaaagaggacacaagtaattgaagttggtaaaagactggacagatgaatgcaaagcaagaacttctttagctcaaaagctttatggttaaccaaaatagacttactttccacaacatcagcagacacagcataggctggttcaccagtttcaccatcaggtgccatgggggtaaactttgcaacaatataatatccaacagcactgagaggaatgcggaatgtctattgcaaaatcaaaaggagaattgttcagccatattatcatgacacaaatacaccaaataaaaagtaggtagatttatcagtaatagagagcaaaacttatcataccttagaaactttagatgtagtgaggactctgagttcattctcatttaaaaatttggatgaagatcctatgaaccattgaaccctgctgaacccttcagtgccacctttgacagtagcagtagcagacaccttgcttccttctcttgcttccccaactatcttcaaatccaagacttttggaggtgctgataaaaaagttaaagcaaagtggtaacatttctattagcatactccaaaaaaatatatacaggcaactttatcccaaatgggaaaaatatcgagactattgaaacacaatgggcacaaactccactaacctttcttaactgcatctgtcatagcataagcagcttcaccctcctgacctggagaagacaccgactgatgttgatacaatagaatagaatactgatgcaagcaagcaagcaatggatggttcgacaaaccttcaaggttgatgggaacatatacaaatttgaggggccgacccacatcctcctttgttagcgtgtactccgtgctatttgatagcactagaagaaattcactgcataaaatgaaattattttgtccataattaccacagtgtatagaagaaacttgctgcacaaaaaaaaagtattgtccaaattaccacactataaaactattgaccgtttgttgtagactacagcaatagttcatccaattgtctagtagctctagttcaggatattcagtttataattgagttttagcaggcctggagttaagttcagttaccaaagcccaaaatgatccttcttaaaatggcaggaatttatattgctgccaggagctatcctggttagggatgcaagtgggtagtcccgctacccacataaaaacccacttgctagttcatttcccacatggtagtacaaaatttagaaggaaaaatgaactagaagtaagataagcggtctgaaaaaacccgcttgcatccctaatcctggtgcaagttgttaagtcggtatggccatcgaagtttgatcaaactacagtgcttgaggaatctagccatccacttggactacaattctataaataaatcaggagttattcaaacatggcaagtggatgtaaataagccttttctggagacaacataagtgatagctccgatatcctataggactatctaatattttaatatttggttatggaagtgcactgtaagacctattacgaacttatcatagtgctatcgcataacaaaccagataaaacttattgagtaacagactcagaacagctaagtttggcaagttctactgaactaagtacttcacctagaatggacaggtaatgcatggaactatcaaaatataattgcttcaaggaggacaataaatgtatggaggatcaaacttgaagggcaatctgtacccaagattaacgtttgaccaaattgtttttcttacaacccattaagaatttaagatctactgtttgcatagtagtgtatgatagagaatagattaatcacgtgttcagaattcacattacttgtatatcagaccgagaatggtttcaaacttctaataactgcaatgctcacttgcccagctagtaatgaaatgtttaaacataccataaaggtgttttatcaatactcaaagatgacaaactaatggcagtatggctcatacggtcatacccattttccttctctctaaaccagaggaatttgcttaatccctctttgccaccaaaatactttccattccctttgattgtgttatcttcaacaatgtctcccacaacatgtacactgctgactgatggtgtggctgaaatgatgccataggcaaacaattattgagaattttgaatatttcaaaagaaaaaaagaaacaacttatgaacagttttctggaatttatttcaaatggacaatgttcttttatttaaacagcttggggatgaaccatcattggttactttttttaattgaaaggccattacaaaaaacaatagaccagatggtctatattctatctacagggtggtgcaatcccagtatatgaataaaagtaatttaagaccaaaactaatgggcattggcaaccctttcacaaatatatctgaacagaagctaagataatttgatgggatgaagtactttaccagcctttacaaaatctgtcattgtacattggggctctcccttaacaccatcttctgtaacaggggtgtacataaataccaaacttgaatcgatatcatctagggttagctgatattccatcctgtcagctccatctattacaacagcattgccgttccatcttctccttaaccaactagcctcaaaagaaggtttaacaaaatcaatggtattcactagatacaaaaattagcataaaagaaattaattcatctgatagaatgaatattcatttgcaaaatgaaacatgatggaagttattaggataaacaaaccttgcaacaccttttcctggcatcccaccacaccaggcaatctcaggaacacccctgagtacatttccttccaccaaatcaccatggaccgtcagattgatgacctttggacaaccagtacctggtaaacaaaaactgatcaaggactaaaggatttggctatatcattctagtgcataatttaatttaggtaaatgggtgaaatatccatatatactataaaaaataaatgttgcgctgtatctatcacctccccagtccccagcataaaagtagggctagaaaacatatgggaaggcaaataaagtttcactgaaaaggcaccataattttagaatatatcttttatccctacctactgcttgcaatgtaggcatacatcaaacaactaactagacaaagataaatccggcttacaaagtactatttatactttatatacaatcagttgttcaatacctggagaaacaggtaaggaaacagcaaagatgggcgggaattcagcatcattcaatattggagtgcattcaactttcagacatcttccaacatcttcacgctttggccagtataccttgatttacaaataaccaaagtttataacttgcaaaaggatgtggcaaaactcatcaaattataacagcagggacttaaaaacttgcaagtgatgcaaaccacaaattcaagtagttctaagaaatagatagataactaaccaggcaaaagctctttaagtacagttaaaagtgtgttcaagtaagtcaaaggagtgttctacctcacttaattcttcaggaagaggcacaaaatcagttggtgtcttgtcacctataaaccactgatatttgaggactagttcaccctcatcacactgatttgtgaagctaaaatggcaatgacagggatcttcttcaaatggatggtcaacatgagctttcttcactatcaaatcttgcggcaacttattcttccattgctcaagtaggaaggaaaatgttgaatctgtccaagcaagtaggaccataagtgtgcacttagaactcaaatggatactcgagaaccaggaaacaaacaaatcattcaacttcactttagttcatgcgatcactttatgtttgtatatgagaagagaactaaaagaatctaatactgttgaagtaatacatcagcagattcatttacgaacatgtaatcagtaggaaatgcgtcaacaacaataaaagaagtcaacacaaaatagcagtttttttctctccattaaaaccataccagcagcaagttcaggagagcaaaattcccaaccatcacgaatgcaaatagctgtatgagcaggatattgcttcgcaacttcagcctcaccggggttcagatctgcaacaggttcccacttaagaaatatccaaaaccataaagtaataagatactacattctggttgcatcaaacaattcagtatatttatctgaccagacctattaatcaacagtatcaactcacatgatagattaatttatccaaaataaaatctaggcattatgatggtgtagatactgtaaagctccagaatatgcgctcctgtttcatattctcaatcaggcccggccctgagggtggagcggccgcactgagcccccaaaatgttggagcccccacctaccctctagtgattacggatgggattaggcagttaggattagagctgccgccgtggacgtagctagcaaccaatgttcccgattccacgatcaatcaaccactacgcgagtcatgtccactgagacaccgtgtgctgcctccacgagtatgagtatcgatccgccacaatccatccacctatcgttactcctcactcgtaatcaacaaattaaattggtatatgatccatatctgtttgaattttctgttatctgctgctatcctggccggtttcttgcctcttctctgttgtgggttcctgctgaactaatgtctcatacattaacatgcaatctatttacacgtttgcagaagaaagatttgttagaactaatccatgcttttactttttgtaatctatgagttcgaccataatatgctaatattttcaatttttagctctttgatatcatgtcatcaataaattaaacggttgaatttgacaactttatgcattaagaattgctagatgagattgatattgataccatcatcaattactttgtatctagaaaagtccaaagaaatatttaagataattttcataaagttctacatctaaatattgcttttgaatgcactttaaatatttattggtagcattttacatatacatgtatgtattaattcttatttacatataacattaagggcccttttttagtttcgccctaggccaccaaaaccttgggccggccctgttctcaattcttactatatgtgcaggtgaagtatttaaagtgaactcactcatttctgagcatttggaaagtcattctagtcctatcagaaccttaataggtaagccgaaagaaagaccagaatgcggcttgtctatatcaagtaccggcgttattttcatttccatcccattaatagtctgaaagtaatcagattcgatgatatttcaacagcgataagcttaagataagccattgtgatggatattattctatactaccatttcagcaaatcaaatagtgatcagcgatgcaatgaaaagcatgttaaacataccccggtcattgaactttttcaaggtagggcctacaagcagaatagaagcagcctccaagtgtggcatctcaagaagtggattatcctcaacacgtaaatgctgcagacattttagttttgccatcagtgagcaaattgcgttaacacttcatgtgtcaatagccttcattaatttaacatatctcttcaaattcaaatatatctatatgccacagtggactggtaataactgatcatggatggtatgaattgcctgtttcatgcatataaggtctattctgtaacatcagacattgagcaacgcaattgattattaccagcttcaaacttccaattaccaaaatacttattatttgtactgcacatcatctattgtttgttcattatctagaaaaataatctattgtttgttaagcaccatccatgagattcaaatgcttttagaaatagcatcgttcaacaacataagaaacataatgagtaaaagcagacctccagagaaggcaaatgcggaaatcccttcaaaactgatattttgtttctgctggctgctagtacctacacacacaaaaaaaaatgcaaagcaagttaagggctaactgatattttgattatgctcaaggcagatacaaccagcatactcacttgaagtcgaggctgactagccatacagagtgatttcaacctattttgagcaacagagagaaactggtgcagcaagagagataagaaaaatagatttagcattgttgacataagtaaagatcaactgctaagactagtttggtaacattagcatacctccaagttaggaagctcgggaagggtagcaagggatgttatttgatttccagcgagataaagttgctacacaggtcagaatacaaaagatagttcataaaaaaaacctccatgagcatagtcaatactatgaggaaagcacaaacctggagaagtttgcaattctcaaggggctcaaacccagggagcttaaattcattaaaactcaagtcaagaacctgcaaatatgaaggaggacaaaaggcagaaaaaacaaaataaacacataatcaacagagctaggccacaagaacaggaagtgccaaaatggaatacatcccaataaaaaggagagaggtgataccttaacccctttgagaatctcaataccctccaaacttgatagacgattgtccctgagataaacaaactacagacagaaactatggtaagcacttcagcagacatgtcattcccaatatttcttaatcatgggctatgctggatgtatatatctttcccaaaatcttaggtgttgcaacttgcaaaaaaattaacagtgtcatgtggcttgagttattgcagaactgcatagataaaaggagaacctgactgcacttacttcaagtacaggtgttaatctcaactgcttcagagttcgtaccctatgacctcttgaatcaagtctctgcagaagcatgaaactatattgaatggaagaaaaaccaccacatgatgaaagcatcaagatcatccacataaatgaagaactttttcaacactaaccacttcatcactagccttcaaatccacctggggcagcatcataaaccgtgaatcacggctatcagcagtcgagctcttcttccgaataggcatggaagaacccttgtccatcgacgatgtccgagaacccacttttttcgtgacgctgcttgtcactgaaggtgaccgtggtgagttgagagtagcatttgaggctgctctcctgaagctgctgctagcgctactgctggagttctctgtcagtgatgggactttcttcagagtagaaattggtgatgacttaacagcaggcttcttcatcgcatccaccttggccctctcagactgcacagatgacttcttttccagtgatgattttgagctgaccatggaggctgtcactggtttactcttcttcaccccatctgacagagaaggactagctttcttagcaacaactgagctcccattatcctgttgcttccccgcacttcctgtgctgcttcttctctgaactggagcagcattcatagacgaggtagacttcgtcaacgatgaccttgacatccccaactcggctgagggagcaacatcagtccgcttcttgattgaagaagctgtccccaatgcaaacctgccggtgggcacagacagccgggtctttgacggtttagcctccgccggctttgaggtctccggtggtgcttccattcctgacaaccacaatcaaaacctcaagccgtacaccgccagtctttgctttctagtcaaaccaggaacctcttgacgattgcacacatgcctgacctggatagccaggtaaacaaaccaaattatcaatgtagcacttacaaatatttgggaaatcaccaaaagttcgatgcaaaggaaaaattctcagaatttgcagcctcatacgaaaactgagcaaccaacaacgcttgtacagaatttttgaattgctcgcagaattcgtcaacgcctagatagggaagtacaacgcgaggcggtaccaaatcagacggaattgcggaagcacgaagccggtggatatggcccgtacaaaaaagcgaagcattaaaacttgacaaaataagcacaaaaaatttatttcatcataattttttttgtcaaatgtagaaacagagcaggaacccatcgttttgggtcggaattcaaaaccaaaattccagcaaagtcgtcggtcaaacccacaggcaaactcaccacggatcagaattcatcacagaggatcaaaaccacacccgaaaaatcccccaaaaatgctcgtaaaaccctagcaccatccagcacataaaccccaccgcattccgcgagaacccaccgccaccgccacactacgagcaccggagaaatcccacccacacgcgcacaaatacacacacatacaccctctccaaactcgaatcgatccgaaatggagttcaaaacaaaatccagaacaaaaatgcccaaaaaaaatgaaatcaacacatcgcgcagccacgggggggccggctcgcctcccatctccctcacctccccccgccgcggcagccggatccgagcccctccgccgcctccaccaatgcgggctacgagcgcgcgcgaggagtggaagccaaccagacactggagcagaagcagcagcagcagaagaggcagagaagaaaggggggagaaaccgaaacgcgcacaagtatccgagaggcgggggggcacttggtaaattaccggaattcctaggggcttaggtgtaaattcgccaaagtttcgctcccgcccgcgcttttgcagtttcggttttggtccaaactccaagaaaacgaaatatcaggggtttttttcgtttaagcccttggtttttgtggaaatgtgacgggaagggccgggggtcggtgcgcagaggcagcgcacacgtcgccggcgtggaatcgccgtggggcccacccacccggggagttcgcttctaccgttgtttgtttgtttgtttggcttggtttcgtgagggtaatctcgagattaagtgccgtaattaacgctgatcgcactaaacacaaaagctacgctcgtactacacactaacgcacacgagtgcagccttcaatacacgcttaaaagagataaatgccaaaatatcatacaaattcgatgataaagaggtgcatcgcgagcactgagtttatcgtgttataacttttactacacatctactttgagctactttaaaggcaaacataagagagaaaatatacgaagacagttgtgttcttttaaagtgtttggcaaccagcaagtgaaatagaacggtgaattagcgtataaattaattaggtattaaaaaatttaaaaataaattaatatgatttttaaagtaactttatttgcataaagtttctagaaaaaaaaacactctttagtggtatgagaagcgtgcacatggaaaaagagaaagaaaatgttggaaaaatgtaatactggccgcagccttgaactaactttgaagttaattaagtcctaagttaaaaactagtaaaaccttggctctaaattctaatgtgcaagtccactgctatgtacgtatggacaaaactttaggtttgcaaacggaatgcaacaagcagtgcaaacaaaatcgaccattccagctgattgaaccctcctcgattgcatcgaagatttttgtttcgagacaggaggatgcataacacatggacagatagatatagataaatctagcaattattagggatgcaagcaggtaaacctgcgagttcaaataaatgataattcataagtttttgtgttgtggtccagtttaccgcatatagatatgcaagtgggtcaatccataaacctatttataggtcaaattaatactttctccattccaaattgacctacatatagtttttttttgaggttattcctaaatggtctacatatttgtgttcatccattaggtctattcattatttgtgtattagagtaaatggacattgacgcatgcatctatgcacacaagcatttatagcccatatgtaatatcttgatttgctattggctatgaaatagtggggatggtgcatgcattgagtttgttgctagagtaaatatagtataagagagttattagcttttcttggtattggtgtacctttgaaatatgtagatcaatttgaaatgaatggagtagttaactagcgggttacgtactaattttacctataagcaggttcacggacaagcccgcttgcacccctagaagttacgtgagagtaatcaaatcacaaaaattggttaattacaggtagaagtggtaggtgagacagacgagctagcgttggagcgatggataagctcgccatcgccagcgacgtgccggcgaccgctccatcgaaagccaatcaaggcactagtactaacgaaacctacctccccttcctctcgctgacatgtgggcccggtcccacctgtcatcctgatgcgatcatcctgggcccaccagtagctaggaggcaaagcccgtgggaaacggggccgacacggcgatgaacagggagaagattaattgttgggatggccttggattaggataattaaaaggtttgtgtgctaaataatgatgggttttaatttgtccttgatggatcatgcacggccttgaatggatcgatcgattgatgtgggtaattttaattaagtgcaataaatgacaatgatgattaactcgatcaccgtcgtcctagctaagcttgtgtactggatatatagctcagtgccaccgtctgatcacggcataatcgtgcgtgtgcaaaccattaataaatatagttgcacggttttatgaaccatgctacatccgttgcaaaatgcgtgcagccgtagaaatccgtgtccaacgtttcaccgtctgtcttatttaaaaatttatgagaaaattagaataaattagtcaaatataaagtactattcatgttttatcatctaataacaataaaaatattaatcgtaaaaaaattataaataagacgaacggtcaaaagtgagatatgaacagtgtaaaactgcacttattttgagacggagggagtagattggttaagcacgctaaattattatgcagtacgtgcattcttcagatatcatcagatgtgcctatagatttatttatgttgattagggctttattaggagcttgtttaattttattgacacaaatttaatcatcaagacaattattctccaaattccagactagctacactaatccaattaagctataatgcctatatgtaacttaattaccccccaaacaaatatacactgctacatttctcttgtccttatggtatttatttaagtactattcatactatgctcaaagaggaacctaaaattatactccctcggttttaaaacgtttgacgccgttgactttttatcacatgtttgaccgtttatcttattaaaaaaattaagtaattattaattcttttcctatcatttaattcattgttaaatatatttttatgtaggcatataattttacatatctcataaaagtttttgaataaaatgaacggacaaacatatactaaaaagtaaacggtgtcaaacatttcgaaacggagggagtacaactcagtatttactcttcaggcatgaatccagtgtagtaccactgtaccatgtcagatagtactagacaaagtatcatgctgctgtacatattgcattattaatttgtcccttgctactggtgcacaataactgtataagcatttgcaggtgactagctttagctatagctgcatgatatcgatgcctctactcttctccaatatgagtaggagtacgtgacaagaccagcatccttgtcacgatgtagaggcttcaacaattcaagagacacacctcttaaagagcttattctatcagctatagccctcggattgggagatgcaacactgatatttgtatacatgtccatatatgcatactagtgcatatcttggaccctcgcgttgtagtgggactttagaacttctctacagaaaaaagcatgggtctaactcaacacttcaatctcataatgattggcgtagtttgatgacatggctaaacataagagttcttttacggcaattaatgatatagcagtactggttgggtagtcgtgtttttcagtctactttatctacttcaaatcttttgatttttacacgcttcccaaaaaactaaacggtatgtttttataaaagaatacaagaaaattacttaaaaaaatcatattaatatattttaagtttattttagttaatacttaattaatcatatattaatacgtgcttcgttttgtataccggagaggagaccaacccctccttctaaacacaactttaatatgtaactatatggaaatagaaatagtgggtgtgcacatacatataaataagtttagctagcagtgttcatggctgtctgaagaatgcatgtgtaaagttaagtgtaacatatgcaagagtggctatagctacctaattaagtgcaggaatccactgatcagtcagaaagttcacctacaaaactgtcatgtatacccagcacacataaagataaaaaggggctgccaaatcaaaggaggaaaaggagttaagtcaaataaatctactcctaagatttccctttaagaaagaatcaggatggctcagaagcaaagagagctagacaaaagtgaagaggaagctagaaacataaagaacagataattaaactatctgtctgattaactattccatcaacaaaagctaattgcaaagttgtgatgcaaaagggtggtaggatgctagtaaccatcaacacaacgcatcaattagtctcttcttagggcgaaaagatatggttgctctctcctgatacatgcttatgaatgggccacacgagctagacgttgcagcaaccatcaagcagatatatatacaagtctccatagctaattaaattaatccatgcattttctagtgtacaacttgcaagattttctttgggtattatgggtggccagctcatgagtcatgaccactaatacacaaacattatatatgtaatattagtatattactaatcatactagtatctggtagagcaaagtatgttgcaacttaaattagacctcgattagtctagctttcgtttgtttttagttacaagttcgtacggattaaagtggttagccaacttgtggcacgatgagaagacgagaccaatcaatgatgacagttgagaaaagatcaaattaagaggttgttgcatatgtacaaacatgcatgcatggtactagtatatacgtgtagtccgttccaaaaagaagataagaaagaacaaagatctttttctttctttctttctttctttctttctttctttctttctttctttctttctttttgttttgtttttgctagaagagaaagaacaaagttgacaacgcataagaagaaaagagcaattgaatccgattcggcattatgttggtgtgaatgtgtgatccaagatggtggtttcttttaatttgattatctaaattgaatggtcaggtatgtatcgactgcttaatcaagatagattgggatgatttctgctcagaggggaaaaaagaaagaaagaaagaaagaaaggtaagccatatcgtgacttcttgagtgacttttgtttgggccttttataaaacaaaaagggccaggcccacacactaactgtggcaccggcccacacaagggcccactgtacacgtactagtgatgatggattatggccgtagatgggccgaaaggtcaatgtttctcaagcggaataagtccactttgaatcctttagagatgtccaatctaattcgaatccctcatagtagcagatatattgacccctgaactattagaactgatgcaaactaacttcctaggtgttcttttgctgacgtggctagttggcaaagtccaacctgttggaagtagtgcatacttcgccattaattttattccaagcattattatttgagagcatatacagtaagcataacctacttgcgacatgataggacaagaaaaactcataaattctatcatgctagatatcaaacaagatataaataaccaagccaagtaggtcattaggctaatcacaatggtaatctagccgcaatattttaatctagatgaacagtaccatgcatatacaaaactcaggtacgaac

SEQ ID NO: 38159 - DNA, 1072 bp, Oryza sativa
ccggatcggctccgtgagaaacgcagccgccaaacggccacaagcgcacgttctctcttcacgtgagaaccaagtcttcagtgattgactcgatcagcagaggttgttgtatgcaagcatcttttcatcaacacatgctgatcgtgcggctaagcattaggcatttaaattgatgaaatgatcaatgtctccaagcatgttatttccatcacaacctgctgagtcagcacgcagggcccatatgtcagtgacttctctctttctcctcccctctctcctccctcaattctctctccacctcatctcctcctgcagttcccctcttttccatgacatggcggcagccgagtaggccacggggcggtgagctttggggtaggaccgtaggagagaggggaaccaagcagcaaggccgataaatttctgctactgatgcttcgtcggtgcctcttctctcttctagagctccagggccctttctccccattgtgttgctgcgagatagtcgtgtacacaatgacgactttgaaaagatgtgcattcaaaagtagaagaataaattaacaaaagaaaattgtttagtagttagcaatttaataagatttttttagatgacttgaatattttgatatcacgctaactcgcgaacacaccagattaatattcttttttatgaaacacatcaaagatttgtatattcatatgtatgcatccatccacttttaataagttttgggattatttctgctcagaactaaagcaagcgagcacgcgaatgaaaaaaatgggaacgagatacaatgtcagccatgttgtgtttagtgtgttaccaaaaagaaaaaaaaaagaaaaggttggcccacaaacagtgacacagtggctacatcggacatgaaagctctctaaatatgggcggaaaagaaaatctcacgctcgtaagctcaaacaagacaagcccagctttcttcccaacttgttttcgaaatgagttgagcccaagctggctcgcgagccattcgtttggctcgtttagctcgcatatctagcctagccagcatagcccattttgtag

SEQ ID NO: 38160 - DNA, 6663 bp, Oryza sativa
ggtgagctccgaatgggttcggtgaactcgcctcccgccgccgcgtgggttggcgaggagcgccggatgggagccgggggagtggtggtggtggacgctgtcgacggcgtggggcgagcggggccggcgggggaatgggcgagcgcgggctgcggccgacgacggcgcgggccgaagggaggtgggcggcgactggaggtagagaagaaggtgagaagaggggctgacgggtggggccctttccacgctggcacgcacggtggcacgccacgttggcaaaagtggcaaatagttaagaaattacctctctccagtggcaaattattttatgcaaacctaagaggggtatttggataattggcaaacctaaaagtggcaaatagttaaattccctcgttttttgggcacaagtcgttttttttctgggacaaccgctcggtctcatgaatcagtttagtctgggacggagggagtagctagctagctatctaggctcgtggctgatgactatatatcaatgttttaaatagcagactaaggcatttagcggttagcttctcaaacaactatagcggctaaattatacatgagactatgagaacaaatagctaaaacccttctcaaacaactatagcggaagacagcggcagtttaactagatatttaaaactctgctatatatacgtactcgccatagtcagcgcggacgatatatagcacagctagcctatcatgggtagcaccggcgacgaacccatcatcatggccgggccagtgccgttcgtcgacgtcgtcgtcgacaatgccggcggcgccgtcgccaacaaggccgatccgggcgtcgtactgccgcaggaagaagagtacgagagcttcgtgtcgtcgctgccgagcaaccccaagctgcagctgctgcgctaccaggggaagtggctgctgcagtcgtgggtgcccgggatcatcgccatccagcgcggcggcttcgcgccgcgccgcggcggcggcgacgtcgtcctcgcgagcctccccaagtgcggcaccacgtggctcaaggccctcgcgttcgccaccatggcgcgccgcgcgcacccgcccgccggggatgagcagcacccgctcctccggctcaacccgcacgactgcgtcccgtcgatggagaagctgttcgccgctgggttggggagcaagatcatggacgcgctgccgtcgccgaggctcatggcgacgcacgtgcaccactcgcttctccccgcctccatcaccgataaccctcactgtaaaatcatctatatatgcaggtgaatcatctttttattatgaacatccaatataagtatttgctttttatgtccttttaatctagtaaaaaatagtgattttttttaaatttttttaaaaaactaccattaacttgttattatcatacattaattgttgcatgtatttgttagtgacatgtggaccttttagtcctacactattattttttcttcctttaaaaataaagagttggtggaagtggttgacatgtgagttctctagccccacatctttaaaaggtacagagttggtggaaatggttgacatatgagttttctagccccacatgttattgttcctctaaaagaaagttaggagttggtagtggggttggtgggagaacaaccaccaccactactcccttttataaatagtatagataaattatgcttaaaatatttttaatgatcaaacaagttattaaaataaattatacgtagtatttttttaataaaataaaaggtcaaacaacccatgtccatatatctacaacgctacgtataaaactaaagttagtatttgtattcttataacaaccaccaccaagtaatacaacatcctctaaatatatatatatatatatatatatatatatatatatatatatatatatatatatggttctatgtatcaaattaaacgacagggatccaaaggacatgatagtttccctgtggcacttcgtgagaagaaggctaccggagatcccattcctcgaactgttcgagtctgcttgcgagggcagatgcttgagcagcccaatctgggaccatatcctcggctactggaatgcgagcaagacgaggccagagacggtgttgttcctgaggtacgaagagctgctacatgacccggctgatagcgtcaggaagctggctcggttcgtcgggcagccattctcgcccgaggaggaggaagccagcgacgtggaagacattgtgaggctctgcagtttcgagcagatgaagaacctggaggtgaacagggcagctggcctgtctcctgcgctccagcaaaacgcctacaccaatgggtccttcttcaggaaagggggcacaggagattgggcaaatcatatgacaccagagatggctgaacgcgcggctagacgccatcgtagaagagaagctccgttgatcaggcctctctttctcatgatctcggcatgctagtttatgactcgtaaataaagattatgccatctactaaggaatcatgtaaaaataaaatgcccgttgtgcagtcactagctatatttgttaatctcgtatgtactgtctaaatactccatgttatatatgttgtttatctagctatgttatgttgttctcagttattatccatgtggtcataaataatcgatgcatatctttatccaatagctacctttatctcacatgctagaaaaaaatattgacattaaatgtagtactaaaatattactccgtagactttttaagatacagttcaccattttatcttattaaaaaaaattatgtaattatcatttattttgttgtgacttgattatcgtcaaatattctttgaatatgacataaaatttgtttatatttgaaaaaaatgaataagacgaatagtcaattatttatcaaaaagtcaacggtgttatatattaaaacacagaggtaatactatcttttattggacaatgccttgattacataatgaaaatgtattattgcgccttaatttgtgatgaagtacgtgtgggactgctacacacataattaagtctatagcaccaacaagtgacgatcaactgatgggagatttcaatccttatcatatgccctacggtgtagccgtgggatagttgtgtacacacttacgaggtcaaaaagatgtgcatacagcccaaaaaagaaaagaaaatatgtgcatactaaagaaagagaatagatgaataaaaagaccatgttcagattatcagtcgcgtggcagtggggattactgctgaagtgctgatgcagtagcagtggctgacatgtggctgacatgtgaactgcgtagaatttgcatccattgtgtggtgtgcgcagtgcgtggcctccttttgtaccacaaaacagtgacacaggtggctacagcccacgtgaaagctctccggggacttttgccgaccagccgctgccactgcagaaacggagcctgggagggtgcacggtgagaggagcgaaaacggcgtgttgcgtagagaaagggatagagtagggagagatggaggaagaagatggagacttagtaggtccccatctttttttttcttgactacgataaaacgtaggcgccatgctggataaagacctagtctacatgtcacgcagtgacgtaggataaaaccgctgttcaaactacttgaggaggtaaactgattcggttttcatagtcgagggatccttcatgcctggtctgcaacagttgaggtaggaaaagtaaacttattctttgtcaaattggggtggtaagggctgttttttttttttggacccaggtgccttggaacccactccagcccattgggctccgccccaaatgggtagaaaacttacattgtccgatcagataaacataaaacgtgtgatgttttcacagaagaacttttaccatcatctacacactgctctcgacgccaataccacagccatcaccgaaggtgccacccgtggcgaggcttctgttctctacttgaaggacgctcaatctacaaaaatttctaagcgtctctaatataataatttatccagtgtcacaactaacttatccctgattctcatcttccggctcacctaatcattatagatttattgcatcttgaacgactggctactaaaaagcgatttttcatagcgttgctctagaaaatttcaaggcggagctcataagtgtccgcaagcgaaaatagtgttttcgatggcggtacgtaaaaaggaccgctgtacaaaattttttaggctaattaataaaatccaccgcgcgcccccacaccgtgcctctctccctcttctcccttggtctctccgcctatctcccaaaatccctcttcctctctctctccattcggtgggcggcggcacggggaggaggtggcttggcggcggcgcggggtggcagcgtggtggaggaagaggatgatgcgggcagcggatccagcgacgggccacacggcggcgttcggaggtggatttagcggcggatccgccgccgcctagtcccagctctctctccccctctcctctctcctccccttcccctgtcaccatcaccccctctccctctctcagatttagcgcgcggaccacggtgaaggctgtggcggggctttgtagcggcggtggcgaggcggaggccggcagggctcggtagcggcatcgtcgcggtggaggctgcggtggggctcgacaacggcggcgtcgaggaggaggcggtggttcttgttggccacttcaaggacgacgccgacaatctcgagtgcgacaacgccgacgacgatggttctcgtctattctgttgctgttaatgtgttgaattgttgatatttgtgatgctccgtatttagattgatgcttgaatgatgttcaattttttttaatatggatgcttgaatgctctattaatatccattttcaaatttttgttaacggaaaattgtgattgtgaatggaaattttttactggaaattattgatgtaaatttctgtggatttgtggatcgagcgttgacagagacggatggagcggtgtcgctccgtcattttttttaaccttggccaatattaacactggcagctggtatagtgcaccgcctgtgaaaataaattttcatgggtggctatcttaagaaaaccgcgagagaaaatgaattggcgctggcggccggctaccgccaacgaaaatactatattattattggcctttagacactgacagtgccgtaggccgccagcaaaaatagaaaattttttctagtagtgactattaatcaatgatttctttaatatttagttacgtattgattaattacttattatattaatagttacatgacctatcagccaatcaattgcttagttgtactattaatttcgtaattcttatcaattacttagttttggtagatgatctttaaattactgttaatatctttttactgttttgcccttcacactttgacgtggcaatgatgcaaataacctacttaaccttccactaaatctttaaattaataccctagctactccagcccacatatcaagtagtactaccttctaattggtactttgtgtttcaaatcgttagattgaccggaatcaatggatctcgttattttcaatcacaatagatcaagtctctagctatctataaatctcatatgtactgtctgatgattaattatgaccagtactgttattgtttatctgttgctttcagttatcatgcatgtggtcataaataaaacaatgcacatctttatccaatatagctacattttccaaatatcgcacgtgtcattaaaaaattattgacatttaatgtaatgctaaaatagacaagccttgcatatttcgagagatagaccgatttagaccaaattcttttcttcactttcctagctcaactatctcgttttctgcgtgcatgcttttcgaatcactaaatgcatggtacattttttttaaaaaaatttctattcgaaagttgttttaaaaaattatactaatatatttttaagttatttatagctaatacttaaattaattatacattaataaaggcaaaatctaattcgcgcgcgctctctgttttgccctatcgcgcgacatgttcatcggccgtccgatcccacgagcgctggtgcgtccgtacatggcctggtgatccacggacgtgagatgaatccaaattagaagccatgtgatgctctacactacgccggcttcaaaaataattttctcttaaactaatcatccgatatacgatccgattacaccgttgtattcgtaagaattgaatctttataataagatctcacatgattatattttgatgaaattataaattacttttataatatatctaaattacttttagatttcactaaattacttcttagacccataaaagtatattcaataaagtctaaaagtaatttacacacacacacacacacacacacacacatatatatatatatatatatatattatagaagtaacttagaaaaaaagaaagtaactttatcacgatattaaaagtaaatccgttacggaggtaaaaacatgagtctatatagaaattaatttaatcagcacaaaggggtgcagg

SEQ ID NO: 38161 - DNA, 1159 bp, Oryza sativa
taagaagtaatttaatgaaatctaaaagtaatttagatataatatataagtaatttgaatttttttcataaaaatatagttatgtgagatctttttataaagatttaattgttatgaacacaatggtgtaatcggatcgtaaatcggatgagtaaatctaagagaaaatttcataacaagaaaaaaacatacacttttgagtatactagatataaaattgaggtagctagttatgaacatacagagaacggtttagttgtagacacgtccattaataaacaattaccttctaagtacggaaactcgacctaccatacacagccttagctaggtggataacgactattcgcgcatgcataataaccagcaagcatatatatatatatatatatatatatatatatatatatatatatatatatatatatatatatatatatcacacatgctggaggctgccattattatacttaaccatggctagtaccagcgttttaaatctcccgctatagctgccgctatctaccgctataactatttgagaagggttctagctatttgctctcatatacaatttaacagctatagcttcatttagcccgctatagctgccgctatagctgtttaagaagctaatcgctaaatggtttagcccgctatttaaaacattggctagtaccaccaaccaacctactcttttggggccagtgccattgccgttcaacgacgccatcgccgccggcgacacgccggcggtggatcccggcctgatggaagagtacgggtggctccctagcaaccccaagatgcacctgaattgctaccaaggtgcgtgggtgcagaggacgtgggtgcccgggatcatcgccatccagcgcggcggcgacatcgtcctcgcgacactggtggagaaaccatctttgcttggtcacccaaaattcacaatagtcccggttcgaatagaaaccgggactaaagatgatttttagtcccagttaaaaactttttgacctttagtcccggttggtaacattaaccaggactaaagatcatttttagtcccggttcaaaaagttgtcgggtcgagttaggtcccagctcatgtttagtctcggttggtataaacaaccgggactaaacatagatctttagtcccggt

SEQ ID NO: 38162 - DNA, 15155 bp, Oryza sativa
ctcctaccacgtgaggccgggcggcagcggcagggagacgggcagccgagcaggcggcaggcgaggccggcgaggcggcgggcggccggcgagacgagtctggcgaggcccgcgaggcggcgggcggccgggcgggcgaggccggcgaggcccgcgaggcggcgcgcggccgggcgggcgagtccggcgaggcccgcgaggcggcaggcggccgggcaggcgggcggtgagacccgcgtggcggcactccccaggcgggcggcgaggcggcgggtggtggtgctcccggtgcggcggcgctccccaggcggcagcggagcccgaggcggccggcgggaggccggtgaggcggtggacggccggcgcccgatctctgtgatatggttttttttctgatctgtgtgatatgtgcggccgatctatgcgatgtcgattttttttctgatctgtgtgatgtgtgatgtgtgaatgaatttgtggagatgttttttgaatgatttgtgatgtatttggggataaaaatgcagcttgatgtatttggggattttgtgattgatctgtgatgtatttggggataaaaatgtagcttgatgtatttggggattttgcgaatgatctgtggtgttaaaatgattcgtggataatatgaatggtggtgctcgaaatcatgaaagcaggaaaaaaaagaaaaaaaacattagtcccggttgttaattctaaccgggactaaatctttagtcccagtttttaacactaaccgggactaagatcctctttagtcccggttattttaaccggggctaaaaatatgtatctttagttccggattcgtagttccggttgtataaccgggactatagggacgttgtgaaccggtattaaaaagggtttgtccaccattgcgagcctccccaagtgcggcaccacgtggctcaaggccctcgctttcgcctccatggcgcgccgcgcgcacccgccgccgcccgccgtcggcgacggcgacgcgcagctgctgcaccacccgctcctccggctcaacccgcacgactgcgtcccgttcatggagaagctgttcgccgccgggttggggagcaagatcatggacgcgctgccgtcgccgaggctcatggccacgcacatgcaccactcgcttctccccacctccatcagcgacaaccttgactgcgaaatcatatacatatgcaggtgaatgatttttttgctacttcctccgtttttaggttataagatgtttttgactttcgttcaaagttaaactgtttcaagtttaactaagttttttaggttataagatgtttttgactttcgttcaaagttaaactgtttcaagtttaactaagtttatagccaagtatagtaataattaaattaccaaaatatttttaataagttaataattaaatatatttttataataaatttatcttgagtaaaaaacattaatatttttttctacaaacttagttaaatttgaagcagtttgactttgatcaaagttaaaacgtacatcttataacctaaaacggagggagtatataataataagaaccactatatactacaataacattatctagtactcatatacgacatgattgtatcatatcataggacaaaccttgggtttccgtatctaaatttgaccgtccgtcttatttgaaaaaattataaaaaaaattaaaaaggtaagtcaaagtattaatcatgttttatcatctaacaataatggaaatattaattataaaaaaaatttcatataagacgaacagttaaacgttagacacggaaaccacgatttgtctttttctgggaaggagggagtatgtggcagttcgccagaagaatactacctgagctccaattccatgacgtgtttgagctttgcttgtgagggtcgctgcttgagcggccctatttggaaccacatcgtcggttactggaacgcgagcaaggcgaggccggagacggtgttgttcttgaggtacgaagagatgctgcagtaccccatcgacaattttaggaagctggctcgattcgtcgggcaaccattctcgcccgacgaggaggaggctggtgtcgtgatggactcatggacatcgtgaggttgtgcagctttgagaagatgaaaaatctgaaggtcaacaaggcagactcatctcctgtacatgtgcctcgtaacaacacatttgcgaatgactctttctttagaagaggtggagcaggagactggacgaaccacatgacaccagagatggctcgacgtttggacgctatcatgaatgagaagctccatggaacaggcatctctttctcgtgatcaacacgttaattagttgaaactctcataaataaagattacaacatcgacgaagttcctgaagtgtatgtaaagaggtatgtaaagattattattgtaagatggcacgctctatcaccagagcgactctatgaaatatatatttagatcgagtgaataagttggaaattaaacatacacacgcgtgtgtgatagataactttatcaccacatcacttggtgtgtacttattagtgtcagcaaagaaataatttgagccatcaatttataagggtacgcaagtacctttttctaactatgttttgaatattcatgtctctagtttagatatttctttctcaatattataatatgaaaaagaatcaaagagactatatcttaattgtttcatgtggttcatagttggcagtctcgcctatcactcctgaaagctatgtcccaactgacccccaaaaataattcgcagatcgaaaagctcgaacgtacacaacaaattaattaaggaatgaaaaagcaaaaagaaaaaagaaaagaaaagaaaagttacccgtttgttatgctgtccaatcgatggccaattctctcagattcgatccaattccaagccgttcttttaagaaaactcatataccacatgagaaacatttatttattgggactacctatacattttgtcgataaattttctcctaaaaattttacagatataattatagtacaatcgtagtgtaattacactgtaacttgcatgtaactacagtgtaacttatatataagtttcacataattttgaatcgttagatctattacaagatttgttttggtgaggaagaaaacaaatcatagcacacacatataaaagaatttgttcccacgacctccaatttaccgaaataacatgttacggagagatttttgaaagttacatacaagttacactatagttacaatgtaattacatacaagttacagtgtaattacactacgattgtactataattacatctgtcaaatttttgaggaaaattttgtcgacaaatatatagcaaatcgttatttatttaaggaaaaagtacgaattaccccccgaactatcgtggtcgaccgaattaccccctgaaccacaaaaccggacattactcaccctgaactttcaatactggacgaattacccccctggacccaattcagagcggttttatcctacttggcgtacgcgtggcatccagtcaacattttcttttaaaaaaatagagggacccaagtgtcatacctacccttcccctcttcccctctctctctcttcactcactctctcggcgagatcgcgaggacacagagagcggcggttacagcagcgttgtcgtcgtgggacacagaggaatgcggaggccgcgacggcgctggacactgaggccgcggcggcgtgggaagagccggcggcgacgcgggatgcggaggccacgtgttacgatcgggctagagattttggggattttggaaggaagaggatgacagagaacagaacgagagagaaatacttgagcagaggaaagagcagtagagacagagtttggtttcaagtttacagctcaaatatttgatatcctttcctctctctacctgtgcttatatacatgcacggcatacagctggcctaagaccactccggcccagagactcggacattcggccttctctccctttgaggtcgtttcccagacttcacaggattattctcccttaccggttcagatacagtagcagcacccgtaacattccttcccccttcgaaagcggcttgcccccaagccggcgcatccggaaatcgaagacgcaaagccgcagcatcttcccaggtagcctcacttgatgattgacctgtccaacgaaccaagacttgttccacagctccagctcctttcttcgaaactcgccgggcgagaacttgaacaggaaccacctcctctggtgccatggtaggaagagcacgaacatcagtcgcagtggttggtgccacagcttgtcgaagttgggagacatgaacaacgggatgaatcgagcaatcatccggcaatcgtagtcgataagccactgctcccaccttattcagtacctgaaaaggtccgaaatagcgaaaagcaagtttgtgattggtatgcccggtaagagaactctgtgcataaggttgagccttcaaaaaacccaatctcccgtagcgaactcgcggtcagaacgcttcttgtcgacctgaaatttcattcgttgctgagctcgtaaaagatgctgacgcaacaaactggagattactgcccgttccttcagccacttgtcaagatctggaactgcacattcagctgtactcgacaccccaaaatgacgaggaggatgcccataaagtacctcaaatggagacctctcaagcgctgaatgataagcagtgttataccaaaattctgctaaagcccaccaacggaaccacttctttggacaggcatgcacaaaacagcggagaaatgtctccaaacactggttgacacgctccgtttgcccatccgtctgtaggtgataagcagtacttaacttcagacgagtatccgtcaactgaaataactctgtccacaaggcgctggtaaaaatacggactctgtccgaaatgatatgatgtggcaatccataaagtttataaacattgttcagataagccaaagcaacatcaaaagcggtgaatgggtgcactaaagccaggaaatgggcatacttactgaatttatcaacgaccaccagtatgcagtcaaaacctgctgaagaaggcaacccttcaataaaatcaagtgaaacagttacccaggcatgctccggcacaggtagaggttgcaaaagaccggggtaacgcacacgttcagcttttgcttgcttacagatcgaacagttggacacaaactggcgaacggcctgcttcaaacccggccatgcaaacaagcgccgcactctgctgtaagtaacttgtataccagaatgcccacccacggcagagcaatggaaagcagacagaattttaagttgcaattcagagtttgcacccagccaaatgagcctcatataatagagaataccattcttcagagaataagaaggaaattgactaggagagagcaacactttagcgagcaattgagaagtgcaaatatcagaatcataacccttctgaacttcctccaaccaagagggcacgcaagatgacacagtactcaattgatacacctcattggatctgcaacgagacaacacatcagctgccttattctcaagacctttcttgtataccagccggtaagataagccaagtaatttggttaatgctcgttgttgccaagatgtcaccaaacgctgatcatcaagatgaatcaagctgcgctgatccgtacgaatgataaactcaccaaactgcagataagagcgccaatgatcaacagccagcaatatagcgagacactctttttcgtaagttgacaggcctctgttgcgtggacccagggatttgctaaggaaagccaagggatgtccatcctgcattaacaccgcacccacccccaaatcagaagcttcagtctcaattacaaaggtcccagaaaaatcgggcaacgccaacactggggcagaaaccaaagcagccttaagagcttcaaatgcagcttgatgttctgaagtccaaacgaagaccacctacttttttaacaaatcagttaagggccgactgatgatcccaaaagacttgacaaacttgtgataatatccggcaagtcccaagaaactccggacttccttaacattctgcggcactgtccaagcttgaacagccctgacattcttcggatcagtagttacacccgcagcgctgatcacatgacccaaataagtaaggctggattgagcgaacgaacacttagatcgtttgacctttaactggtgagtcgtcaatagctagaacacttgacgcaacagcatgacatggtcctgcaaattacgactgtacaccaatatatcatcaatgaacaccaaaactcccttcctcaataacggtgcaaaaatcatgttcatcaacccttgaaaagtggccggggctcctgtaagtccataggacataacccgaaactcataatgaccattatgcgttttaaacgccgtcttatactcatcttcagctcgcattctaatctgatgataccccgcgcgcagatccaagctggtaaacagactagcacctgacaattcgtccaataattcatcaatgattggaaggggatagcgatttttaactgtaacagcattcaggtgacggcagtcaacacaaaactgccaagtgaggtcctttttctgcaccaacagcaccggagaagagaagggacttgaacttggttgaataactccctgctgcagcatatccttcacttgccgttcaatctcatccttctgggctgggttataacggtagggatgaagattgactcatgaaggagctgagaaatttcggctggtatttcaagagaggaatctgaatcttctagaggacataactcaacagtctacaaaaccgcatcatgattcattaagccctgcacctgaacaaccgaaagttcagagcatttctgagtattagcaaccacacccttcagacagacattctgttgttgatactgaaattgcaaaatcttgcttcgctagtcaatctgcattgggctatggtcaaccaaccaatccatgccgagaattatgtcataacttcccagaggcagcaccttgaaattggattgaaaggagaaaccctgcacccaccaaaggcaatttgtcaactcccttgagcagtgcagtatacccccatccgcaatcctgacttgaatagcaggaacaacacgcagcttacagttcaacttgccagccagcttttcagacataaaactatgcgtgctgccagagttcactaacatgagaatttcttactgctgaataagtccttgcaatcgaagcgtacagacagatttcgtaccaatcatagcatcacgagaaatctgacagacttcgccttgaggttcagactcagacccaatgtcagtagttggttcaataatctcaggcataccatcagcagcagaatcagctaacaattccaaaagctcttccacaatatgcaactgaacagtaggtccacacttgtgatcgcgactccaccgttccccacatgtatggcataatccctttgctttgcgataagctctcagggcagctaccttatcttccactggcagtgtccgttcatcagctcggccaccaccaaatgtcttggaagcaaacgacggtgtagcagaacgggccgtagctcggtaactcgtcatagcctcctatcgagcagattccagtacttcctcctacaggcaagcgagatccacagcagtatccatgtccgtgggacggtgtaaaagaatagcaccatgaatatttgcccgcaacccatctatgaattgagtaaaaaaaacatggaatcccaagaggaatgatgagcgtgaaactggtgcattaactcattaaacctctccgcataactaagctaagcaccgaacatgtctgcttgagcctgttaaattgacgcactaagccctggaactcatctctcccaaattttgcacacactagctcagaaaactcactccaatccataaattcaacatgagcatttgtggattgaagccaagtcaaagcccccccccccccccccggaaaattgcaaagaagcaacacctacccacacttcagagcaaattccactcacacggaaataggtttcgcacttcattttccaggctctagggttctccccatcaaactgtggacaatctacccgagcgtttcctccgtgaaaccccgcagtaaaaccccgattcgaaccctctccaaattccagagaaaaacggtggggcaactgattagagcacgtacccttggccgggagagacgatggagaggactccttcccacacgccttcccccgtggaatcgaagcaacgcggtggcctaacggcccgtgaccttcgccacccacacttggagagacctcctcctccttgggagcggtatcccgaggccgagtcggtgtaggaagcagcgccggcaactccgatggcttgacggagagcaccggattacgggctatccgctccacttgttggcgcagatcccccatctcctcatgcagctctgtcaccgccttgtccatcgccggcttccaactcgctaactccaccaccaggggcttgatctcctccagcgatccaaccgaagtttgaatcgccgaattctgcttctgaatcgcagacatgacctccacaagttccgccaattgttgctccatctcctgggatttgagttgagctcgcgaatgatagcgtggtttctctagatactccaagattggtggctctgatacctaatgttacgatcgggctagagattttggggattttggaaggaagaggatgaacagagagcagaacgagagagaaatacttggagcaggggaaagagcagtagagacagagtttggtttcaagtttacagctcaaatattcgatatcctttcctctctccgcctgtgcttatatacacgcacggcatacagctggcctaagcccactccggcccagagactcggacattcggccttctctccctttgaggtcgtttcccagacttcacaggattattctcccttgccggttcagatacagtagcagcacccgtaacaccgcggcggtgcgggatgcggtggaggcggctgcagcggcgacagcgtgggatgcgaaggcagcggcagcgtgggaagagccgacgatctcggcgcgcacacactctctcgtcgccgtcgtcgagccggaacgagccgtgtcttctcgacagagctctgttcacgccggccacctcgccgggcgccggcctcgggcacagttgccaggcaggcggcaccgtctctttggcctgtgctacagcatcgccgccttggggttgcttacttgctgttgcttggttgcttgctgtttgaatgcttgccattgatgtgctattgttgattaatttcagctgtggcccaatgcaagccgattctctcggagctgaacgggaggatgaattagtctagcaggagtttgttagagatgcaaataagtcgtgaatcagttaatcgtgaccgagtctagcgctggcagtggcgcgggtgtgtgcatggagttcagagaaaagcggatcgtgggatggcgcgattttgcctcggattcctatttttttttgcgttgagtataagtagttctcttagctctttattctttttgtaaggtttacattcagttgaatgagaaaaacccagaaaaaattgccccatacattctcgcaagaattctttctctgaaacttctcctctgctctgtttgctgctctgttcgttgttgccgctgcagttcttgccgtgccgggcgtgaacagtctgccagcaaggtgtttgatcagagtttttttgctattgccaacaagtggtatcagagcactcaggttgagggctgatctgacaccatggcgttggttccggcgggagcgggagcggatccggcgagggggagctcggggagtgctttctcctacccacaactcacggcaacgaactacaccagctggtgcattcgggttcaggcgatgatggaggaccagggtgtctgggacgccatcgagccggtggccggggtggccgtcgacccaagaagggacaagaaggcgaggtcccatctgttgcagtccctgccggaggacttgctgatgcaggtggcgaagaagagatcggcgaaggaagtgtgggattgcttgaagacaaggttcgtgggcgcggaccgcgttcgcgaagcgcgcttgcagacgttgaagggtgaatttggtgccatggtgatggagccaggggaaactctggatcagtacgcgggccgcatcaccgcgatgagcgtgcgtcactcggcgttgggctcgacgctgggtgattccgcgatggtgaagaagctgttcgacacggtgccggaaaaattcgtcagcctcgtcgcaggtattgagcaattttatgacattgatactatgccatttgaggaggcagtgggtcgactgaaggcctacgaggagcgcatgcggaagaagaaggctgccgccggcggggtcaccaccgacgggcaggtgctcctcactcaagcggagtgggaagctcacttcaagaagaacggcggggaatcctcgccaccacagaagaacaaaccttcaggtgaaggtgctgggcgtggccagggcggtcgcggtcgcggcagaggccgtggcgcaggcggacgcggcgggacgccgcggggcgactcaggtgcaggctctggcggcggtggccgtgacaagagtcacatcaagtgcttcaattgcgaggagtacgggcactactctaaccaatgcccacatccgaagaagaagaagggagaagcacatcttgcacagacggaggacgccgggcctgccctgttgcttgcggtgacggaggatgtgccagagcgcgcgtcgtgcggcttggtcgtacgcgagcagcgcgtgtggcccaagctgctgctggcagacgctggtggacatgctggcgatgtctggttcctggacaacggggccagcaaccacatgaccggcgatcgaagcaaattccgggagctggacgagtcgatcaccggacgggtgaagttcggcgacgcttccacagtgcagatcaaggggaaggggtcgattcttttttcatgcaagaacggtgatcaatggctgctacaggacgtctactacatccccagtctgcaatgtaacatggtgagtttgggccaactaacagagaccgggcatcgcgtggtcatggatgaggatgtactcgaagtgttcgacaaaagtccatggcggctggtgatgaaggtgaggcgcactgtaaatcgtctttaccgaattgagttgaagctggcgcatcccgtgtccctgctgtccagcctcgacgacccggcttggctgtggcatgcgcggctgggacacgtaaattttcaagcaatgaaactgctggtggacaaggagatggcggggggtgttctggcaatcgtccacccgaatcagctgtgccaatcttgcctggtgacgaaacaggccagggcgccgttcccggcggcggcgcacttcagggcggaggagccgctcgagctgctgcacatagatctgtgcggcccgattacaccgagtacgatgtctggtaatcgctatttttttcttatagttgatgattattcccggtggatgtgggtgttcgtactcaagacgaaggatcaatcgctcgatgctttcgtaaagttcaagccactggccgagaacacggctgggcggcgcgtgaagacgttgcggtcagaccggggtggtgaattcctgtcaggcgagtttgcacaggtgtgcgaggaggcggggattcaatgtcacctgacagcgccgtactcgccccagcaaaacggggtggtggagaggcgcaaccgcacggtgatggccatggcacgctcactactgaaggggatgcgcgtaccgggcaggttttggggggaggcggtgcgtcacgcggtgcatctccttaaccggctcccgacgaaggcaatgggtgatcgtactccgttcgaggcatggacggggaggaagccacagctgggacatctcaaggtgttcggctgcacggcacacgcgaaaaacacgcagccgcacctcaagaagctggacgacaagagtgcaccgtacgtgtatctcggtgtggaggaagggagcaaggctcatcgtctgttcgatccgcgtcgtgggcgcatacatgtaagtcgtgacgttgtatttgaggaaaatgtaccttgggagtggacatcagctgcaggacaggagccaacggatttcgcgatggaggaggagcctggtgagcagctgccgagcccggcaacagcggccggcgtagtaccgtcgtaccaggcaccgtctcctggcaggcgcaccgggaaggaagcagtggtggcggcagaagaagtaccgtcaccggcaagcccggtggcagcatcaccgactctgcctggaacgcccacgcccggttctccatcgacaaactctgccggggtggtgccgtcaccgggcacagatgacaacatcgatacagatgatgggcctaggcggtatagatcgctggcagatgtcctgcgtgaggccccgcgtgtggatttggtggaggacgaatgtgatggagaggcgctcctagctgagtcagaagagccatcaagctatcgagaagctgccggccaacctgcgtgggaagaagcaatgcagagggagatggaggcaatcgagaagaacaaaacgtgggagttggccatgttgccagccgggcaccgagcgattgggctgaaatgggtgtataagctcaagaagaacacggcaggggagataatcaagcacaaggcatggttggttgcaaaaggatatgtgcagaaacaaggggtcgattttgaagaggtgtttgctccggtagcgaggcttgataccgttcgtgttgtgcttgcagtggcggctgatcgccgctggcaggttcatcatcttgatgtcaaatcggcattccttaatggtgaacttgaagaagaggtgtatgttgcacagccggaagggtttgctagatcaggaaaagagcatcttgtgctcaagctgcataaggcattgtatggactctggcaggcaccgcgagcctggaatatacgcctggacagaagcttgagggagctcggctttgatcggtgtacgcaggagcaggcagtatacacccgaggtagaggaagtgatggcataattgtcggcgtttacgttgatgatctcattgtcaccggagaaaatccctctgaattgaaggttttcaaggaacaaatgatgggggagtttgagatgagtgatctcggtttgctcacatattatctcgggatagaggttgatcaggatgagagtgctaccacattgaaacagactgcatatgccaagaaattactgtctcagtttgggatgatggagtgcaactcagtttcaattccaatcgatccgagatcgcagctgagcaaggatccagaaggtcacccggtggatgcaactgagtatcggcggatcatcggtagtcttcggtatttgcttcacacgaggccggatctgtcatatgctgtcggggtggcaagcaggttcatggagaggccaaccgtgatgcatttcaaggctgtgaagcaaattctcagatacatcaagggaacgatggattatggtctcgtgtatgctgcaggcactggggcactgaagattacagggtatactgacagtgacctcgccggggacttggatgatcggcgcaacactggtggaatggcgttctacatcaatcagagtctggtggcgtggagctcgcaaaagcagaaaactgtggcactatcgtcgtgtgaagccgagttcatggcagccacgacggcggcctgtcaagcgctctggttaagagtgttgctagcagaagtggcgggagtggaggagaaagcagtgaagctcttcgtcgacaataggttagcaattgcattgatgaagaacccggtgtttcatgggagaagtaagcatattgacacccgttatcacttcatacgggagtgtgtggatggcgggcaaattgttgtggagttcgtccggactgaggagcagcgggcggatgcactgacgaaaggattgccggcggcgaagctggcgacggcgagacaccttcttggtgttcgttcactagggccacggcagaattaagggggagattgttgattaatttcagctgtggcccaatgcaagccgattctctcggagctgaacgggaggatgaattagtctagcaggagtttgttagagatgcaaataagtcgcgaatcagttaatcgtgaccgagtctagcgctggcagtggcgcgggtgtgtgcatggagttcagagaaaagcggatcgtgggatggcgcgattttgcctcggattcctattttttttgcgttgagtataagtagttctcttagctctttattctttttgtaaggtttacattcagttgaatgagaaaaacccagaaaaaattgccccatacattctcgcaagaattctttctctgaaacttctcctctgctctgtttgctgctctgttcgttgttgccgctgcagttcttgccgtgccgggcgtgaacagtctgccagcaaggtgtttgatcggagtttttttgctattgccaacagctattgtgcttcattgcctgccaatcctcagcaacaatggatggcgtcgttgttcgagtagcgcattggggcggccctgggtagcatcccagtacggagggacgacgcgtcgtctaccgccaccgcgtcgcgcggctggaggagaacctgcgctgttgttgctgtacttgcacgacacaggcatcgcaatgtcgccgccacgctcacctcgcctcctcgacgccgccgggagtggaccgggttgtcccgcgtcccgtcctgccgccgcctccgcgtgccgcgccgccgtagccgcccgccgctcgacgacggagacgagagtgtgtgtgcgccgagatcgtcggctcttcccacgccgccgctgcatcccacgccgcagccgccgcctccaccgcatcccgcgccgccgcggcctcctcgtcccgcga

SEQ ID NO: 38163 - DNA, 1000 bp, Oryza sativa
acatatgcttcttatagagcacacacttcatgataaacatgcaggggtcttcgagctagtgggccgagaaaagcaggaattgtgagtgggctagccgacataggtttaaggcctcacattttatatttatttgatattatatctttcataatattagagtttttagcacggacttcattgggaaattgtaaaaagtacgaattacccccctgaaccacaaaaccggacattcttcacccccaactatgcaaaccggatgaattaccccccctgacccaatccgcggtggttttggtctacgtggtgtacgcgtggcggtccagtcagtattttatttattaaaaaaatataggacccacctatcatactcctataccactattcccatctctctcttctttctctctcttcctctctctcttttctcactctctatctcacacgcgcacggtggcaggcgggggagcggcggcggtggcggcggcggggtgcggcggaggaggcaaggcgagcggcggcagcggaggaggaggcaaggcggcagcggcgagcggcgggggatgaagcagcgaacggcggcggggtgcggcggagggggcgaggcgaggctgcggcgacagcggaggaggcgaggggcggcgggagctcacactgctcgaggcgaggcgaggtgagcggcaacggggtgcggcggaggaggtgagcgtgacggtggaggaggcgagcgcggcagtggaggaggcgaggcggcggcggcagttggccggggggggcggtgacagacgacgacgcgcggcgcgggcggggctagagtggagatggcgacggcgcgcgggcggcggggttgagatgccgcggacagggcaaccgacacccttcgttgttttttatagtgatacctaagtcatactcccaccttttagtcatgatatcaactcatgcttgagattcttgtcctatatataagaagagagaaattttaagattctctctttgttac

SEQ ID NO: 38164 - DNA, 1282 bp, Oryza sativa
tcaaacatactttccttctttaccttgctaagagtgtagctggatgggctcaagcattggcttcctttctcctttggttccgggtggaggtcctcacgttggttcgtatcttttagatcattgcgtgcttcaagtgtatctttcgacttcccgtatacacctaggaagcccagcaagttgacgcagaggttcttagtgaggtgcatcacgtctattgcatgccggacgtccaagacttcccaatagggtaactcccaaaaaatagactttttcttccacattgctgcgtgaccatcttcgctggctatgggttggcttccaggtccctttccaaacactactttcagatctttcaccatttcgaacaaggttttaccgtttcgaaatataggcttcttacggtgcttgcctttcttccggacagtgtggttcgtaacaagaaatcgacgatgccccatgtacacaacttttttacaatgtttcagatacgtactttcagtttcatccaaacagtggatgcaagccttgtaccccttgtttgactgtccggataggttgctaagggcaggccaatcgttgatggttacgagcagcagcgctcgtaggttaaattccacctgtttgtcctcatcccacacagggacgccttatttcttccacagcagtttgagatcttcaaccagtggtcttagatacacatcaatatcgttaccaggttgctttgggccttgaataacaatcaacatcatgatgtacttcctcttcatgcatagccaggggggtcgtagatacacatcgtaacaagccaagtgctatggccgctgctcatctctccaaatggatccatgccatccgtacttaaactgaaccttacgtttcgtggatcctttccaaagtctttaaactttctatcgatgtttcaccactgcaacccatcggcggggtgtcttagcatcccgtcttgttgacgttcttctgcgtgccatcgcatcaatcttgcatgctctttgttcctgaacaaacgtctgagccgtggtattatagggaaataccacatcaccttagcaggaattctcttcctcgaaggctgtccgtcaacatcacctggatcgtctcttctaatgttgtatcatagtgcattacagaccgggcatgcttctaggttctcgtactcctcaccgcgatagaggatacaatcgtttggtatcctcaagtcctagagggcagactatattctttgcttcgtatgttgttttgggcaacttgttttcctccgaaagaa

SEQ ID NO: 38165 - DNA, 11832 bp, Oryza sativa
ccagtccggaatgttctcgtcttctacttcatcttcttccattcgaaccccttgctccccgtgcgaggtccaaacattatagctcggcatgaagcccgtctcaaacaagtgaatatgaatagttctaactgtagaatactctctctggtttttgcacttagtgcttggacaacggataaaaccattattctgcttgttagcttctgccactttcagaaaattatgcaagccatcaaaaaactcttttgaccgtcagtccgcgcgcatccattgccgatccatctacatgaaaagcacaaaaatcatgaaaaattaatccacgaaattcaaaccaattaaacaatattaaaaatagcaatatataattattataaaataatacaacaaattattcatgttttcattccccatcattttaaagttgtaaacaaatattaaatttgttttacttaatttaatttaaattaactaagttttccattctttttcatataattttctatctttttctttctcatctcttttatcacaagtttttttttccaaattctaaataatcatatttgattataaaataataccacaaattattcatgttttcattccccatcattttaaagttgtaaacaaatatttaatttgttttacttaatttaatttaaattaactaagtttttcatataattttctatctttttctttttcatttcttttatcacaagtttttttccaaattctaaataataaaatttgattataaaataatacctcaaattattcatgttttcattccccatcattttaaagttgtaaacaaatatttaatttgttttacttaatttaatttaaattaactatgtttttcatataattttctatctttttctttttcatttcttttatcacaagtttttttccaaattctaaataataaaatttgattataaaataataccacaaattattcatgttttcattccccatcattttaaagttgtaaacaaatatttaatttgttttacttaatttaatttaaattaactaagttttctaatctttttcatataattttctatctttctctttctcatctcttttatcacaagtttttttttcccaaattctacataaacaaaatttctatattatttcatccctacacaaactttctctttcatcatctcccattcccaaatttctagaggcaaaatagtatacaaaacatatctctaagtacaaatgcttatcacaaagtagaggaggatgaagttgctaacctttaactccttcaaattttatattttcaccaaaacaaaatcaccaaaaattttggcagcacctcccctcaaactcaacaaatttttgaagccttctcgggctagctggaggaagaagaagactttatatggatggacttttagtcccggtttgtgttaccaaccgggcttaaaaatcgccatgatctttagtcccggttagtaacacaaaccaggactaaagatcaccgggggcctaacacaccctgacaactggcgaaccaggatgaaatcttcccgttgaacctataaaccgggactaaaaattgtttttagtctcggttttttggtgaaccgggacaattgtggtttttcccctacccggcaaagatcacttctccagtagtgaaaggaccacagaaatgttgtaaaatcactggtagcatcatacagtataggagccatttcatttcgatattactccaacaagtctgtcagcaacgccttcgatctctaccatgattcaagacactacaaggtgttactgtttcttggatgtcttctaaatcagtcgtcacccatttgtgatacttttgatgctgttagcttgtatttcctagcacctcccagtcctagatcgatcaacgatcgatactcctgctatagtttgatgagacatgtaggcgtgcatactagcgaaattgatctatatatacgtatctgctagctaggtagaatgtacgaatgagagataattaatgttgctgccatagttgaattgattttacttacttgtttggccgttgggacgatgcattatatatatacacggtgagaacttgtcattggcatcatatttgagcaaaggagaagggaaataacttgtcattggcatcatgtttgagcaaaggagaagggaaataaacatatatgtcgttcattattttattttttttttgcattttaatgtactcaatttcgatcgtataccatctctgttatgataccggttattaactgcatctagtcagcttgagaagcctagctaggaattcagaacagagaattataaggttcttgagtactaagtacaataggtaactacacatgtgcagaacaaaaaaaatgacatataaaggatcagcagagcgcctcatgtttcccctttctattaattctactcaaatgatctattttatcttaatatgaggtgctctgctgatcctttatcaggccaggtcctttgatcaaacgcttgtgttaagaagacgcacggactaatcaggtcgttcaacccaggccttgatctcatagttggcttgtcattctgcaatccgataatctactcaaccatgttagtgttgtttctctgcatgacaaggtgcaactctgctcatgtacacatgatgttatggctcagtagttccctctgcctcccaggcctagctagctacatgcagttttggtatatctaaactgtaatgttcatgcatggctactggacaaatggacatggaggatgctgcttgatatagataaaattcatcgagaaggaaacgaagtagttggtctggtccatccatatgtccacctaaggtaattatagaccactcaagaggattttcgggcaggctcttcatcctgcactgttgtcatgtaaagtactcgttctgaactagctagcaatgcgcgacatattccaacaatttttaggatgcaactttcgaagtcttccactttcagactatcaaactttagcaatacaacaaaaattacattaatagatttatcaaacaccaaacgctttagaaacagtgttttttctttttactgtgatgatggttcattcagcattgaattaagcatccgaggaaaataaacttatgaagataaatagagcaatgtgcagatctatgttccggttaatgctaatctagtcaaataacatgaaattaatcaattctaagtgaaatgtcttacttgactagtctttgatatcagtcattgctgctcgccccaagctattcaacctagactttcagttagatcgagtcattgatctcatcaacttccacatcaaagctttgttcatgatgaacatcgagagattatcgatcgtcaacgttcacattgttcctgagtagttcaagattgagttggattgaatcggttcaaagatttctagtaccttcttgagacccttcgatggtttagaggtcatgtttctttttactcgatatccacatctttcccaatgcctcccatgccaacattgcagatatgtatgtattatgtaaacaaactaagttcatgttcgggttaccattttgtatgtaagagattaatagatgtgtggttcttaagaacaagaaactaaaaagttgactggtatgcaactagctagctagaaataggtatatggctatatgcctcgacagtaataaatgtgtgatttcaatatttgtctagcatgtttatgttagagagattctagatgtttaagaatgagagggggaaaaaaaaggaagagaaggatggaggagaaaagagataggggactaggaagaaaaattgttggggagctaggaagatatagcttcagcattttcttcagaacaaagaatacttgggttgtattctgtagcttgaaagttaattacatctagttgggttggaaggatggaccatgtctactgtgtaggtaactacacaagtgaacaggaaaaatgatatatatgagcatatatagcacaggttgatatggattaagtgtattcaggagcaagtaattggtccaaaatgttgcggtacaataataattatagtgcagtcaaaattttcggttagggtactttcgtgtaaagtaatcgttcttaacaaacaagcaatgtgcaacacattgcaacatttttatcagatttatcgaagtcttttccacttaatttgcagactaaaaaaataatccaataaaaactatattatctgatttgtcattattggaaacttttacaaatatatgatgtgtttatctggttcttgtgaagtgcatgagacaatgagttatagcatcttcagaggacagtaaaaatgtggcacaattactgccaaccatctttcttgatgccggacaaagtgcagaatatacgcagagtcattccatccaaattttgatacagctatactactccttcaacagacttgatgcgatcttctttaccatgattctactgcttcagtaaatattttcagaaggtgtacgcaactcttgttttgcagttgggccgatgcattacatatatatatatatatatatatatacacggcgagagagaagttatcatttggtttgtgcttctattttcctttgttctcacccatacagaggacgatcaactcgaacgtatagcattagactgtcccattatggcaaggtcaaacatctccgaggacatggcatcatggatccctggttcactgtgcctccccttcctagctagctgatgttctgatatgtacccttgctgtataactcgtgcgtagtctacaccaaggtgaagttgtgggcctccgccatgtaagttgtgagctgtcggtgcatcgaccactaggagatatatgatttttaatactggttgtcaacccctgttaattctgattgtagcaattgagagaagaaaaccgagacaaacaaggaaatggagactaaagttgttaatttttagtaccggttgaaggaactgatactaagatatatacaagtcaaaaatatgtggaatgtgggattccaactcacgatctctcatctcagcccttaagagcgttaccatcgcacatactacacacatctgagttctctagtagtggactcttaaggaaggggtcattgtaccagcccaattcatttaaagcccctgtattagtggtgtggttttggcccaagtgactgaggtgtagatcgattagtgacatacttttgctagtttcatgagtcgtgtgggcatgaattctagcaaacattatcagcctcatcttttggcttatgcttatgcttacgcttataagccaaaatttaaatttttaaccttaaatttagagttgattttagggcttttttatcgtagtttatttgtcagcctttgcttttagatcgctaagaacacgtatataaaagttttatttataaatcattatccgtttgtaaatatgccgtttcgcttatttcgtcgataagcgaaacgccggagtcctatcaatatgtatatggtagcacacattccaacaaatttctctgtaaaggagttgtactttgaggtttccgaggaaatgtttctaatttatcaaatgcaaccagcctacgagctttagatatcggactacgaaaatacgatgtttttctatggttctttgggtgtgaatgtgatattgaattagatgaaatatataaatgatgtaatgacattgctaataatcatgctaactaaaataatcgaaatatatagtaaatgcacaacacaatatcatgaacacaagtacattgtacgaccctatgccacaatattctcaaagccttctctgtccgtcgctgccgatgcatgaccattttggccccatcgccttgtatttcctaggtccgcccagtcctagatcttaattttttgtggcatgcatctagagcacatgtttattgatcttagttttggaaaccgtagtactcattcttcaccattgtaccactcttgctcgactcttgggacaatgatttatatagctgaaaagtttagtccggctttattttttgtgcaaaggaaaatcaatatcaatatcatcacttgttaccttctaaagtgctcattttttatactacttgtagagttacttaaatgaacctttcatttaacagtgtttttgattaatatagcttgacttagtggtggctgactgctacttaattatctctaaaaattacaagtgctttgagatttgtaaaactatacttggagaatgtgagagcatcattaaagtcaataaagggccagccaagatatgtgtaaacgtcgggtgaggatcctctaacataatatcattatcattacagttactggtatgtagatctcaccctcctattgccccacatatcattgtctatattttttttaggaatgtcagtacctataatggtagtgacattatggtagaggatgtgaacccgtaaacatcatagaacttagctatgtttacgtatatttgactagatagtggttaaatcctacgcttttcgtatcaattcctccctctttcctctttcaacactttagcctttttatcatataattgaattgaattgtcttggcaattagcatttgctctcttctaggacctaaaagccccgatatatcctactaaacatattcccaccataggtttagttctttctgtttgattctacaaatttaataaccaacttttgatgaaagtcttggaagagatatgttgagaacaacagagaatgatagcattatagctcatcaacataatgcaattgggaacaacataatttctagccatgaattcaaattttatcgtacaaggtgatgattaagtaatagctcaaatccggagtaatactcccttcgggctgacaatattagtcgctttgaacaagggtaaagtcaaactttgaaatctttgactataaataatttccaaaatatttatcttaaaaatatgaaaaccatatgcgtagagtagtgttaaaaaatactttaataaaatcatatatgttttgatatttttatatattataataaaaaatagttgttcaaaccacaagtattatcaacccagaaagagtaaatatactagaaaaaatctgcgcgcctagtggcacgccgataaattcatagcatgtatatcttattttaggactcatctacaatatagaaaatttacctacctttttttaattatttgttactctagcaaatttcacatcacacaagaacttactgcaaattaccttgttatgctcattaactatattttaatagtattaaaagcaatgttaactttgattaccagttatatgtggcattaatgaaaggtgcagatagaggatcacaatctaaaagttgaaatgtcagaacgatatgtaatttgatacggacggagtaatatatttttacatgagtaagtttcacaccataaaatatcattcaaaagacaaattaatggaatttaattttgtgtttgtcccagaagaaagaaatttaattttgtgtttatcctgtaagaatgagaaaaaccaaagtacgattgtaattagtgattgccaataactttacttgtgattagatttgctaactaaaaaattaaagttatgtttcctcaaaattgttgcgatttcattaaccaaaatattatgcatatagtatcaattgtaatatagtattggaaagttttcatccaatctttcaacttatttctgttatttagtttttatttctgattattatttatttgtagaaatatataatatcaatatgtatggttaggtacgcgactcagtttcgagttttcaccataataaattttatttattcagatggttttgacaaaattatttatactttttttctatttttaccttgttttatactatttctgcttggtcctaactgcacaattaacctgacaagacaacaatgcaaatgttggcctccggacaaccaggcctagagctgactgggctgtgcaggccagcatggtgtgagccggtgcacacgccaataggcaatagcctttttttctttcacggtgaaacggcaaagccataacacattcccaaatagctactacctccgttccgagatatagctatttctagcataatgttttatcataaaatgaagctatttttacacctaccttgtcctgtcaaccaatcacaaccattcttctcacctacttcctctttttaacaaatcacccactttctctaatcattctcacctacttttttaatacccgtgccaatcttaaaaatgactacattttgagacggaggaagtaaaaaactagtccagagttgccgtgtggaccaatgaaatgctggcagaacggccggctttggattgatagatagatagatagattaatatgtgaaccaatgaattgttatacacatctgcaccaaatatttgtgtatagctgataacgtaggttttaggtaatatgaggtgatgttgatgatcaaggagtaaacattattgtgatctcagaaagtacgagacacttcatccctctctgcagaacatcgcccacactttcctcatgctttccaagccaaaattgtttgtctcttcaaaattgggtgtcttattgatcagctgtttttagtatgtagcagcatcagagatgacctaagcgagaattaggacagagcaagagtgcaaagtaaagttgtaattgttttatcaatgtgttatcactgtcttttcttactgatagttaagatagggttcgaagatagacagtagaagctagcagatggaaggctaaagaggaaagctttggcgaggcaggagagaagaccataagagacgatacaagtgaatgaaagggatcggttgttttggtcgtgcattgttacaccttacagctacaccatatatttatgcatggtcttaagatgtatccataagaaatagcctaacagatactcctaaccatggttaatcctggtctcttcttgtaaaaatgaaatcattgtgtctacagatatggtgttaccatgtattcttagtttgtctagaggatggaaattatacttttatttttaaaagaaaaagataacatctaacaagatcgataacactaagtataagcattcaaaaaaaactaaaccaatcgttcatgatattaacagcagtcaaaaggataccaatttcagcatacttattttcctgacgcaaaaacagagttaattttcagtggcgcatgagtaatttaaactcactatgtgacaatactcgatactgtgtatgtcggtcaattatcccacatggctaaagtgtaaccgatgatgtgaacacgaagagaataattacagttcatatcagagttgtgttccaatattcataagctgataacagtgagttctctagaaacccaagtgttgcaagtggagaagaatgacctgatatcctttgtgtttttgtttgatgtccacgacgaccgagcaactagctatctcccaatgtcgcccaatccaaaattttcatggtaccatagtgcgcagcaacgggaattgtcgtaggctctccggaccttccattatacttgagagatgaaatgaataattcaagtcatcaaacaagcataatgaaacatccgacgcctcgagagaggaatattggagacattgctagtcctttagcctgccagtcaacttcagcctgagatgtgcccctcaaaccactcgaaggtagcgaccagatgtgttatacattcaggagacttgacaaaaatggctaaagatctacaacatctcaaatattcttaactcatactcatgtgaatctagttcccaggatgtgcactagattcacactttcatcttaagcatgattatacatagtaaacacaactaagatgaaagaaacttaagacttacaacagcttaatagatacataggccgaccggccaaataaacttattagagaacgccggaagcttgactacccaaacacaagcacaccgactaggggtttaccccattaagttctcatcctagaagaagcaatcggaacccgcatcactcaaagactaagtctaaacctgcaaacaaagggttatatcaacagcaagagtcagtacattaaacaagttaatgtactagcaagcacaatacaatcctaatatactacttgtaagacatatattaaaatgaaggcaatatgtagttcaatttcagcataaagcaagttttatttcgcaattcttttgtaaagaagttgatgcttcaattaacaaaacaaattttaagtttcaacattaaatccatcataattccatcataatcaatatcttgttgtcatcttttgacaacaagtaataatatatcaccacacacacaactcaacacatttatcaatttcaaaccaaggtcacatgttcacattttcaaacatagtctatactcatgacacttcaccaaagcgctcttgaccgtgagcacggctaatcgattagtttaaagaactctgcagaatttgtacacctttacccacatgatgtgatagaagcccggaggctacactctagatggttcggtgccggccaagcaccccacactctacattatgagtgcggactagaggtcacaacgaagcctttacactacttagagcctagccttgcaccatcacgatacgttttcctccatcctatgcatacttagaaatatgtctagaaccgttaagtggtgggcccacgccttaaacccacccacgtggcacaataccgttgtattggacagacttagtcacctaaactaccacgtcggggcaaataggaagttcctctgaatcatcgactaattcctcagaattatcgactaactcatacacaccggcctaccagaatgcaatgctagttctaaatagattaatcagcttaggccatcccatactagtacatgtggatgtacgaataactttaagttggtgacacaagttcggtccttacggtccttacggacttgggcaaacactccccctatcggcatgtaactaacaccatatgcacaccacttgccgcccaagtctaaaatcacattttacacattttagttcgtaaatacccatcatattcattttattccagcaaaggttcacatatgaaaatcacattttaaatatagatggaatgagcatttgcatatttctaaatatggctaagcaagtagttgcacatagagcatatataaacccatttgagcacaaagagtgtgctctaaccatttctaggggttcaaacagcaagaggatcaattattcaaggtagggaatgcagcaaataggtcgtaacaccttaacccaatttcaaataccgatataatctaattcacgggagacatccctctgctctagacagagtagagctagctcgagctcgccggcggcaaacggtggctcgtttgaggttgaggtcaaaagataaaatgaagagaaagctctcgcgattccattcctctagttttcttggttaggggacatcggagtagcgccgatggcgagtgtgagcggaaggtgttttcaggtgatggtgcatgtgcatctacagtcatgaattggttaagggggtgcatgcatgtgagtatttgaggttcatgggtatataccatggtgttggccggagttgatgaggtccggacgatggcagcagacacgaaaatggcttggcgacagcgcttcactccgggatgacgtcgacggcttgatctaccaatccaactagcatgcataaggtaatacgttgttaatcgaggtctcacggatgcttcttgtgcaaagaatc

SEQ ID NO: 38166 - DNA, 4962 bp, Oryza sativa
ggcgctccggtgcgtgctccagggcgtcgtcggcgtggttgcgttccggtggctgtgaagcacaaaacgggaggtggtcaaaagagaaatggttcggcattgtgtggagagaagggaacgcgaaaaacatagagatgacctcgactcaatcggcgttggcgaaggtcatcgtcactacgaccggcggcgaggttgaggatgacggagaagctgaggacctctccctcggcttctttagctccagactgatgtgtggagttgggcgactcggtctggaggagatggaggcatgactcagtgacttgaaggcatcgacacgtcgtcaccacgcgtcgacgcgtccacgactcggttggttctcgatctctccctctctgtgtttcttggtcggctgaggatgagggacagaggaagggcgagctggagaggctgccaggtggggccaagtcgatggaagctaggctaggaagagaggtatgggtaggagtttgggtaggcttagtttttggataattttcggaattatttcttccccctaagtttgcaactcaatatcttaatatgtggaccagaagaaatagtgtaaattttactggtggcagatgtttatatgtagattccattttctttggttgaacttaaaaataatgggtagactgctcacagaaattaaacaaaaatgggctataagaaagctagattgaatttttaggaggcttaaacagaggaggaaaattctagaaaaattacatttattcatgataaataatctggtatttcaatgaattatttcccatgttcacttatgtgcagttaaatgttcttttggatgaaatatggttttagccgattaaaatttaatttcatttcttttagttgtctactttgactgataaatttgaggtatccacttgagtgttaacatttgacaaaaattacagaggataagtttgtgctaatcactatctacataaattttttcatgattttatcttgcacaaaatattttagagaattaggatgacctttgtttgtatatgtgttcccacttcataattgcatctaatattattatagggattacattaaacttcttttagactgagaagatgatatttgagtttaataataagtccacaagttatcacccaagattaactataggtttgtttagtgaaataattcttttagattatgctcatgggacctattatgaaatgcaagaccaaaactccaaatgcacaaagaactcgagcctaggcatgcattatgtacatgtatgctcatatgcttggtgacatttctagtctaatgttgggaatgaaaagattttattttgctctcaaattttattttgctcggatccaggcatgtttttcttttattttttcaccgttattttctaatttttttaatctttcgcacacctctttacaaatgtagagttgaaagtttttaattttgacttgaaagttttaaaattttgtgttgaaagttttaaatttcgagttgaaagttttcaattttgtgttgaaagttttcaaatttaggttaaaagttttcaaatataggttgaaagttttcagaatttgacttcacgtataaatttcttttcaatctattacttaaaaaaatattctgaaaagaaaaacaaatcttatcttaattatctttactatctgaaactaatggatttttttacacgctaaaactaatggattagttacgcggtaggaaaaaaaatccgaaaaaaaatcgcaccgatgcgctgtaccgtgcgtacgcgtgggctgtgggcttgaagtgtgcgccggcgacgcgtatgcgcgaattaggaattctgctcactggaggctgatactagtcaatgctgatgaaggtgctccaagcgtggtacataaatagtagtggtgtacgaggaacgagggtaaaaaggaaaaccttacattgagatggatgatggaaatgtcagttgtagttacggtgacaggtagtccataattgattgccattagtttttaaggcttgctttgcaagcttttaggtcagatttttgaatgacaaatgaaatttaaaactgaaatatattgtttatgacaattttagaatttttgatgaaaggatgtattcaaaatcgtaaagttgaacaacaataaactgtatgccaaagcccattttgttaagaggagaaaaaaactcagctatgagtctctgcatatttcaaaagagtaaagtaaagtaagttgagtcattagtacatgattgattgaatattaattatgcaaaattttataaatggattagtctggttttcgaaaataattttctatataaatttttgcaagacacaccatttagaagtttagaaatagcgcacgtgaaaaacgagagaaatattctaccaatcggccggagccaaacgtggccttactgtaaaatcaaagtgttttttattcttactgtacaatcggcatcggacattattgtttttgatatttggagattattaacgaagtggttttggagatgattgatttgcaggtgatgaacagggttgttgtttttgtcaagaccagtcagatcgggctgtgcttgctggtcagaccagagttatgtgcgcggtcagaccggccagcccacggtctgactagccgactctgtgtcggtttcggttttgggttgtttgtttgtatatctgtgattgtttcatatttatggcttctagatggatactatgcatatgtaatactgttgtttgctaacaatgagtcaagttggagatagcttggtctcgaaatatggtttctttgtttggctcatgtgtaggtgatggatcgggagtcgacctggggataaggcgacgtccgtgacggtcagatatcgtgcgggatacttaagatagagttcaatgcacgtggttggtgaagattccatatggcatacgatggaggtattgtgtacgtatgggatgcggagtcgaattagggaggagttcaaatttggtatgattggagtttgtaaagtttgtttcttgtatgagaaggtttcctaggtggattaggacttctagtatgagttttcttcatggctttaggctgcctaccctaccctcatgtataaatagagagggagcgtgaggcttcctagtatcgcttttgagagcattgagttgtgaataagttagggtttcgagtgtagtcaacattttcatgaggagtgttgttgttgcactttgtaaatacagagagaagtaataaagttgtgatctacattgagagttcttcgattttttatctcgagtgcggcggtccaaccggcgagttactagcggtcagaccgacggcatctggacagtcagaccagtggatcaacggtggtcagactggcagcggcgataggaggcagcgacaggttttggcgttagaccgggtgatctataccggtcaaaccgacgactcccatgtggtcagaccggcgcatctacttcggtcagaccacaatccgtcgaatttgagggtaacttttaattccgcaaaaagtttggggttttgggtataccaaccattcaccccccctctggttggcttagttcttgtgttttgatcctacaagtgatatcagagccttgttttcttctttacattttaaccgatctagagttgttgccatggctaataagcttacaactaagccccatgttttcgattaaacggattttccttgttggtgtagtaagatgcaatcttacattatggctgaggatcttgatatttggagaaaagtttctaatccttatgtgattcctgatcaaactaataccgctgctttaaaaattgaatttgaaaataatttcatatctcgcaatattcttttgagtgagatttcttattcggattttgatcatatttcacatctccaaaccgccaatgagatttggattactttgagaaattttaatcaaggaactaccaatattaaagaacttcgtcaggatctttttaaaaaggagtacataaaatttgagatgaaatctggagaagctttggatgactatctttctagatttaacaaaattttgagtgaccttagatcagttgattcttcttatgacacaaagaagtttctcgtcactttttgaatggtcttgacatgtctatttgggagatgaaagttacatcaattcaggagtctgttgatatgtgtactttgactttggattctctttacacaaaactcaaaacacatgagatgaatattctttctcgtaaagttgattctaaatctagtgctttggtttctttctcgactactttgaatgttggtgcttcttcatctaattctactcttattgctttaattaatgccatctccgatgagcaacttgaacatttcgaggaggaggacttggctttggttactaccaagtttgcttgagctatgaacaatgccaggtataggtgaagaagtggtccaaactgttgctttgaatgtgatgctcttgatcacattcgatcacattgtcctatgcttgggagaggcaaaaaggaagacaatggtggagagaagaccaaggagaacaagcccaagagcacgttcaaggggaagaagactaaggagattctcaagaagttgtttgagaaagtctataccgcttttgagccattaagcgatgtagatggagaaagtgaatatgaagataagggaaagaacatctccgatgtttgcttcatggcacgtggtgaatcggattcagagtgtggagacaatgaggctttggtggcgaggtaggagaacatgtggatcgtggattccggttgtccgcggcacatgaccggtgataaaaattggttctcctccctcaaacaagcatccaagatggaatcaattatctttggtgatgcttctactagtgcggttcttgctacagttttggtcaaggtaaatgacaagtttgaattgaaa

SEQ ID NO: 38167 - DNA, 10883 bp, Oryza sativa
  unsure (1)..(10883): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcttcaaatatggagttttcgcgttgagtgtttctgttcacctagatgcttcggctttctggccgctgtctcacctagacagtttgaagacgattatatgtaaataatgtaatcttctctcttcttaataaaatatggacggtctaatctttcggcagtcctagaaaaaaggacgtgacaatgatgtctttactccatgtatgggcaccgtggatgctggtcatattactgctcagagggaacttttgccttctaacagtggcgagccctattaaggttacctacgaaagttgatgcgcggccagcccgaagaagactttagtctgaattcctacacagttggtgcttttgctctagtttcctctgatgtttcctggtgctatgagtatagatgaagcagtttgtaccaaacaaactctgtaaaacatctaaagaaaggttaattagttaattttgtgtaaagtgtttttctaatttggttaactaggattattgtgacctgcaagttatgattggaaagaacttacagagataacacaaccttttctctccacgtctgacaccattatctattatatactaaaatccattaaacttcctacaaacgctcttaaaccgcaaagtggcgctcctataaatactcttagatcgtcacatgacactgcttaatctcaccgtcgattttcacttaaattggtggacccaatattttagaccataagattagatatattattttaaaaaataatactttcctcctatgggccggaaaaagaagtattcaatacgtacgtacatctgaaagaaaaacattaaccttaccaactgttcactggatgagagaggaaagaccatgtacggcttatatatatatgatgaaaggttatttttaaccgttagattatatctattttttttaaaaaaaactcacttcttctaatctcccgttcactactgctcgtaaaaaaacccaaaatacaaagtacatgcataacgtactataataaaagtagattaaagcaaaaaaaacataattatatttgtgataataaatttaaaataatttaaaaaattatatacataattgtattagtactcacttcttctaatctcccgtacacaaattatatacatcaatttaaaaaatacacccacttccctctcctttccactttttccatgtatatgtgagaacataattatatgtatctattatgtaagtaaaagtccattaaactttttacaaacgcttctaagctgtcacgtggcgttcctataaactctcctagatcgccacatgtcactatttaatctcaccgttgatttttatttaaattggtggacccgttattttaaaccattagaatagattagatatataagtaatatcttcctcctacatacagaagaaaatgcgtacgtgtgattaattcggaagaaacaataaagcttaggaacgataaacacctgaacgttccatcacagcaaacagaccatctttattgggtacatcatgcttggtggagttaatgatcaggagcagcatgcccaccaactaggtaaattacttgaaacgtttaaagcggcgtgagaaactttctgttctttctgcttcatttcatcctgattatcttattaatgattcttttagatggttggaaaatcttcatgatcatctttgcggtttacttaacctggatgttcaatcgtttaatattctaatttctgcccacttgtattatgatttatgacccatggtccttctgttgggtcacggagtatttgtttggagaattttgtattatatactgaaattctattaaacttgctactacttgctactaacgcttctaagtcgtcacgtggcgttttctacagaccactctcaattgtcacctgacactatctaatctccccgccaatttctcacttaaattggttgacccgttattttacaccattagattacatatatacatatcctcaattttcttttaaaattggtggacagatcattagattagatatattatatatacataatattttcctcatgtatacaaaataaaatacatatcattggatcggaaaaatagtacatatgatttgaaagagacaataaagctttcgtcttaggaacgataaaaaagataaagccgggtgtaaaaactaaagccaaaaaaaatacgtacatagtatcatccaaaaaaatcaaaaatataattttctgccatatacgagaaagaaaacaacccatacgtacatagaaccattggaagaaaaattaacgatctttaaaatataattttctacaatatagagataaaatatattattccactaatacacattgttaaactagatctatataatcggtctataaacattcacattttaaaatattttaaaattatgtatctaattagtgatctttgttgtattcctttaattaaatgaatattataagacttataatatgtcataaatacatcacgacacgtggggccgacaaataataattagtgctatgatgcgtttttttaataatttcacgttatattttggtgtaaaaaatccttaacaaatatataacgctaatttaaatctacatatgtaaaaaaacataaaaaacaacaaaaaatagttttttcaactatctttaatttaattttgatttatttgagattaagattctcaaagttttttttgaattttttataactacttgattggtatttgagaagtgagcagcacatgatacatatatataaaaaaatattttcatccaatgatcttgatataatagaacaccttaatccatcatgagtatgatcatatatgtatgttttattctctttgccaaatagttttgataacaaatcaagtaatatgtgcaacatactactaatcatgctatatttttttatagttgaggaattccatcatgttatatgtttttatagttgaggaattccaacatatgagacataattgatggatgtatatcagacataattgatggatgtatgcgatatatcccaccgacgtgactataagtattatctcacaaattagttatatattgtaaataagttttgaaaaaaaataaatacattatccaaatgattaaaggtgtctcatgtgattatcaacgataggtgttgaaaagaaaccaaacgctaaactatagatatttgttaaaatttaaataataagatagtgctttgaagattatcttggtggtatgtcttcttagctataattttttagtaccaccgaatgaacctcggtcattttttaaagagaatattttgtttatatcatacttatttatgaagtaatagttaacaccataaataaatggtgtttactctataccataaatctactcgaaaattaaaacaaaaacactattctgatcacattcatcttctctttgtcctttactgaagggcaccaagcatagacaacagagtttgctacgctaacataagtatagcaagggcaaacatatggctaagttgaagtgtgctagacttactatttatcgatgccatactccatgagggtgtggtgtgaattaggcattaaagttgtgctcgagactggtatggaggggcaccactatatcgatacaagacccatgtttcaaggaaacacacagaaagtaagttttgctgctacaatcgacttcacccagcagagggacatttatatttcactttaacgatttggaaaataagtcagacatgaacacttaggtgcagtggataatttagtgtattaatgatctattagacttattttattggtatatatatgcagttttatctattaataggtacttagcttctaaactatgataatgagttgaagtgacaacccagacaaagtgatatgggagacatccttatcatttatatataataaagtctacagtttgaagtgacaaccaggacaaagtgatcttttttaatatgggagacatccttatcatttatatatattaaagtctacagtctatttcacagcgtataaatgatgcgatataacttatattaacatttttttcattaaactataaataagataatgatgcgatataacttatattaacattgttttcattaaactataaataagatacccgcgcatctgcgcagacttcctttctagtttagctaaagctagtaacacattcatcaacattcacaagagtttcagccttccatgagaatatataactactagagaaccaatctttactcgataggcaaaaatagaaaatatgtcagatgtttaacgaaccagttctaaagaaggtctttagcaccggttaaaacacacaacgacacatcgctatcttttttatcggttggtaacaccaacgggtactaaacaccatctttagtcccggatcacacttgtcagaacatgtcaggcctcccgggatctttagaaccggtttgtggcaataactgatactaaagatcactactttattaccggttggtgatacaaaccggtactaaagataattttgatctttactactagttggtgttaccaccaggtactaaagatcgttgctttttatactcttcttccttctccagcccgagccattgttgcaagtgaaagaaggaggaagagagaagctgccaactttttttttgaaaatattttggtgaaattatacgaatcgaagagatttaaaaggttagcaacttcatcctctatcgatgcatggttaacattttacctttctagctatgtttatatacattattatctcaaataggtatatggaaaaaagatgagggagaaaaattgtttagggaaaattagggtacatcataaaattagaaacatttgtatggaaatgtttaaaaaagacaacaaaggaaaagtatagaaaatgatgaaaaaagaatagaaaactaagtccatttgaaaatcattaaatagttagaaataagtagaatgcattaaaaatatgtttagaactttaagaaaacttaaaaataattgaaataaggataatacgtggaaaatgtatttacaatttattaggacagataaaatttttaaatagttaaccatgactctgattaagtccatttaaaactcgttaaaatcaatagaaataagaataatacactaaaaatatgtaccgtctattctcagtttagttatgatgttttacattataatattatgattgaatgagttttactttcatggacttcctttacatttgttatctcccgatgcggatgaattggcaatggtgtacaccgtggaccaatggtcgaaggagtttattgatggcgtgcattattttttgagtgtggacaatgcctacaagtctaagggttttatatgttgtccatgcacaaggtgcaaaaactagaagcattcttcatcaacagctcttaatatccacttgatgcaattgggattcatgcctagctataactgttggaccttgcacggagagttaggggttgcaatagaagaggatgaagaagaagacgataacatttcggactgggttcaatacggtggatttgcagaaaatacaataggcgtggcggacagtgctattgaagaaaacaagggtgcggatgatcttggtcggagttgtgtgacgtaaagaaggactacgaaagtggaaaggatgtccaaaaattgaagcgtatgttagcggaccacacaaaatgtcattgtacctagattgcgaacaagggcagaaaaagttgggtaccatgctgaaattcttataatgcaagacaaaaaatggtgtgactgacaagacatttggcgtgttgttgaaactcataaagaatattcttcccgaggaaaacaatttctcgaaacaacgtacaaagctaagaagttagtctgccctttaggactagaagtccagaagatacacgtatgtccaaacgattattgtaaaatcaaaggtgtatttgattattattctgtgatgaacaattggcatcggagattattggttttgttatttggaatttatttgtgaagtggttttggagatgattggatttcacaggtgaatatacaggtactgctgtctgttgggaccagtcagaccgggcaggtgttgccggtcagaccggtgcagcccgcggtctgaccggccgacgctgtgtcggtttcggtttcgggttgtttgtttggatatcattgattgtttcatgattatggcttaaagatggatactatgcgtatgtaatactgttgtttgctactaatgagtcaagttgatgatagcttggtctcggaatatggtttctttgtttgttccatgtgtaggtgaattgatgccgggagaatatttgcggtgatggaccgggagtcagcttggggataagacgatgtccaaggtggtcagagatcatgccgaatactaagggtagagttcaatacatgtggaaggtgaaggttccatatggcatacgatggaggtattgtgtgcgtatgggatgcggagtcgaatttggagggagtccaaatttggtataattgattatgtaaagtttgtttcttgtactagagggtttcctatggggattaggacttctagtatgagtttggttcgtggctttaggctgcctaccttgggtataaatagagagggagcgtgaggcttcccggtatcgcttttgagggcaattaagttgatagttgagttagggtttcaagttttgtcgaaaattttgtaaggagtgctgttggtgcactttgtaaatacagagagaaccaataaagtcgtcatccactttaagagttcttcgatttgtgtttcacccggtttcggcggtctaaccggtgacacaccggctgtcagaccggcggcatcacgacagtcagaccggcgggtgacctgcgatcagaccggcgtcggcgacaggcgacaggagctaacgtcggcggtcagaccggagatacaatctcggtcagaccgacggcaaccaggcggtcaaaccggtgcatctacttgagggtaacttttatttccgctaaaaattttggttttgggcataccaaccattcaccccctctcttgttggcttagttattgtgatttgattctataattatatcatttattgcggcgtggagtacgagaacctagttgcatgcccagttcgtaaggcactacgatacaagatgactccagtgatgttgacggaaagccttcgaagaagagagttccggctaagatgatgtggtatttcactaccacggctgccctaccatctatgtctggtcggctactctccactccatgaattgcactatctgcatgcccttaatatcaaggtgtctccaaatccatgctctttgactggtgaacataaacaacatgtggctggaaagaaacatccagaggaaaaaaacatgtgtgccactatacaacacatctcatcatgaccttttctttaattagagaatggaataaaaataccaaccaaagacataaaaaagaaattaatagtcacatattattaggtttccacacaaagtggaattaaagaaggcatacaacagcatttgcagcagtgaatgaaatacaaagttgactagtctatcctagggttggtttggtcgtgtatcaccttgtgtgatgctatctgttggtgtatttttgttgtatgggttgttgaatccttctcaatgaaatgaagcgtaactctctgttcttcgggacaaagagaaacttgagagcatttgttctttcaatgctcatttgccaactcttgctggagttcgattgattttccctgggacaccactcctgaatttcatcggatgattcaataccagaaagcttcttttggcgccacctgttttatggaaatctttctggtagctacttggctgctttggaaacaaaggaatgacctcattttttagggtgtgcagcccaccctgtctaggtggaatttttgtttaaagaaagaagtaagcctacatttacttaggcttaagctagtttctagaccctttctccaatcattgattaactctttgtaattttgtaaagctcttttttgttatatatgaaaatcaccgtgggggctcccccactttttgcaggtccaaaattaaaaaaaaaaagaagaaatgaaatatcatattttaaatataactacacacaaatgttagacctccaaaaccattcttgttgaatgtatgtatatagctccatgaaaaacttctccaaagtgtggcttgcccaacatagtcatcctccaatgtaattcctctcaattgggaagtgactttggtgtggtggagtaatcgtggagcaataaggttcaaattctggagtaacaaatatggctggtttgggagttatcaagaaaacagaatcgggttaaaagttgagaagatggactcccggtgaggttgcatctgcgtccattatattgtcattcacgcttgctgctagaactcttgcggacaatcgaacatagcttgtatgatcagcatgtaaactccactctcattgtggctgttatgtacgtgccatctatcctctacgaacaaatcaaattggagatgtgaagtacgtatattgtacaggttgaggttgtctttgcgttctggtgggtaactcagtagttttcaatgcattgcagatcagcctcaattgcgatccaagcatcaagttttaatcgaaaattgatgaaactactgtttccgaactcagaagcaggaccaagatttttttttcttttgttctagtatgagatccacgattatttgttctatatagggtttctttaaagctagcatacgtacatacctctgcacataagtttgtcattaacgaaactgcacaaggaacacaagcgtgtatcgtagttaagtactaaattaatgtcatcaaatcaataattgaatatattttcataacaaatttgtcttaggttgaaaatgttactacttttatctataaacttggtcaaacttaaaagcagtttgactttaaccaaagtcaaaacatcatataacctgaaacgaagggagtagatagttgtactctagataatattttgagcaggttcttgtaaacaattttccggttgcgacatggatatattaaaacttgtgcttcgaaattatattagttccagctaggtttgctgctaattaattaagctataaagctcagaaatgtcagtgggatgcatttttttgccctgctaaacagttgtgcaatagctctattcatctgaagcaacaatcatgccctttcttgtaaaataaaagtgtggttaattgttattttgtgatgaacaattggcatatgagattattagttttgatatttgaagattattgaaaaagtggttttggggattattaaattttcatatagtgaacaggaacgtgcgatcagatcggccagcccgcggtctgactggcggatgatgtgtaatactgttgtacgctaacaatgagttaagttggagagaacttgtgctcggatatggttactttgtttatacatgtgtaggtgagtcattatgcctcgggagagctttatcggtgatggatcgagagtcaagtttgaagaagatgatattcggacgatcaggatatcatgcgggatgctagcttaggctaaagatcaatacacgtgattagtgaagattttatatggcacaaacgagggagatattgtgtgtgtacaggatgtagaatcgaatttgcaataagtccaaatttgataaacttggagtttgtaaagtttgtttcttatatgggaaggtttcttagggcattaggacttcttatacaacgttggttcgtagctttagactacctgcctcgggctcttggtattgatctaaaactgaaatctgccagtcacccatctcacttctctattagattatatggttgttagagtcatatctatctattatatactaaaagtccattaaacttcctacgaacgctcctaaaccgccacgtggcgctctacaaacgctcctaagtcgccacatggcactatctaatctcaccgttgattttcacttaaattggtggtcccgttagtctacaccattagattagatctattattaaaaaataataacctcctcatgatctgtacgtatgtgtttgtacgatactactgctgatctttccatacgtacaaacgtaatgtacattatctttcctaatcttgctcgaacccaaaaaaaaacgtacacatgaaaaaaaaaagacagaaaaaacatacttccataaaaatcgatggttttaaaaatatgattttagataaaatatattacttcacaaatataaatatatttagttaaataatgatctatataaatatccaatcaatgttctcaaaaccatattctaaatctatctatctatctattatatactaaaagtcaattaaacttcctataaacgctcctaaaccgccacatggcatgctacaaacgctcataggctgccacttggcattatcaaatctcaccgtcgattttcacttaaattggtggacccgttattttataccattggatcatatctattattaaaaaattccaactttctctgtatatgatttaagagcta

SEQ ID NO: 38168 - DNA, 6278 bp, Oryza sativa
aaaaatagataactaaagactacgacccgttggaatatgcctcagaaaaaaatttccgtcccttgtcctgctgtacatatacctcctttgatcctctcgccttattatttttaactaacaacctaatatttaaaaaacatagctaaatgacttataatttctaaaattatattttatttttaatttgttttaactattgttttatttacagttaattaaataattcaatatccattatagttgtattttactatatagaaattaaaatactcctatgcagggcaactgaatgaaattgaaaaattataacagaatgaaaacatgtattattttatattaaacaatctacgcaataaaaaccaattaaagacctttagagcacacttaagtcaccatatgtcacattttaaaattataaaatatttcatttaaatcgatggacccattattttcaaccattagatttaatttacgaaaaatcttacgctgccacgtgtcatgtcctgaaaatcataaataatcttaaaaattttgagaaaaaattaaacctatcatcattggttttaagttacattatttggagaagttataaaaataaatcgcatctacctcctcgcccccttcacatgcgcgcagaccactgccaatcccatccctatttttgggtaggagtaaactaaaagagaaataatcaatatgttaaaacaaccatagtttttaagctacatgtctgatttctaatataattattgctctatttataattaaactaggaatttaagatccgtatccttatattttcctatatacaaaatatggcattcgaccacattgttgacgacgaacccagaagtaagatttaggatctgcactggagttaagcagatctcctaggccagtgtgtgtttttcacatcaacacacattcagcccatgtgctttgcataccatccaaatatgattcaaataccttaaacaagttggctgcacatattacatcactatacatcattctgcaaacatgtatagctaaattaaatcaatagttatccaaacaaaaattacaaagtgaactatgaaacaatttttttattaagggagaacaccctgcccttttacgtgtgatttgaattgctgtaaaagaattacgaaataatccaatacaggttgcatcatcatatgttgtttgtcaaacatgcatagctaaattagatatacattgtctcagcaaatacaactaactaaaatatgaagtccaaaccaccaatgcatagaaaatccaatggctttagttagagaaaatccgattacttcatgatttttttaaaaaatatgtgctaaaataatccaagcaagctaaatgatcttccgtgtatttgctttaaactatgttaccatctaattgactttagatggtgcttaatgcacttttagtatatcattgatatatgttcaagcgtgttgttttggccttctaagcattctgggtaactccgtttattttctttgctcatagaccattcaaaaggtgaatcatccctatatataaacattaatcatctgcaaatatattttgttgtatatatatacttaaatgattaactttggagtccatttagattttatgatataacaagacatggaaatatgagtaactaagctccaccaaaaatgtgatcacaactgcgatgaatcacaaggcaacctctgtaggtgcaatgaccacatctcaacacggtgactaggagctgcataaaaccgtatggcgagggaaaaggaacaatgaatttagctaggtcttacattttcatcaatagggcccatagcattcaacaaacaaagaaaaaaaacaccttgcttttaattaaataaacatgttttctaaacaaactaggtctaactcctttttagatgatgatgaagattatatataattgcttatacatattaattaaatactatatagtatatagcatagagaaattatcaaagtgatgcaacgaagaatatttgctgaggaaatgcacttccaaaacatggcggaggctctctgataaatatgatccgttttcaaatacagtgcacgatacatgcccgcgcattcgcgcgggctaccttcctagttatgataatattgatttatatcaaaatcttccataactttaacgctttcttatctctacgaatatatctcctatatatgtacgtaccgccccccagacttatacaacgtgtctaacaattcgcattgtatctctcaccctaattaggccccaaaagattcaaacattctctgcacctacgttcatccctagtcatgcaattcaagctagtttccacgatcagttcccttcatcggaacaagcattcgccaaaagagatagcactaggtgcacacacaaggtgcaacgttttccaaaagacaagatttctgcgcttgttagggctgggagacatcatgaagccgccagagttgtagcatgtagggaaggttaaatccatttgggtatgatgaagtgttattcgaaaggctagacgattggcagcacatcttgctgctaatttgccattttttagataaaaaagccaagccttctaaaaggaatgtttgatgtacctagagaagtcactaccaaacagaagaatttgactgtaataacagctgcagattgatccttaaaattctgtaaaagtgctcaacgaagtggtgatcggccatgttttctaaacggggcagctggatttaatcttgcctgtcatacttgcagacaaatgataaccagggagaaagaagcaagtaattctgactttaaaggtgttaagaaagattatattgaacaaagataaactatagagtaaactcaatactctatagttttagcagagatgcacaagctatagagtaaactcaatactctataccaacgttaaaaactgtgcctatatgctttgttgtagcagagatgcacaaatttgagacattccagaataatactgcacaatacactgaattttgttgtccgttggttggaaagaagatactgaaaacagaaacagcagaagacttacaagaggcaagagctttcatttgatcactgtccaacagggtgataacactctttttttaacactcagggcctgtttagatcccaccctgaaattttacatcctttcacatcgaacatttgaacacatgtataaagtattaaatataggctaaaaaataaataattatacagattgcgactaatttctattagtgtccgaataccccatgtgacacgccaaaactttacacccatgaatgtatacaccccctcataaactcagagacattgtgccctgccattgtcctttttgattccattacattctttgtttctcagcctttgggcctgtttgggaagctttagattttgaaaagcagctgtttggtagccagaaactaagaatctggaaaagctctgaaacccagcttctccagcttatggcttcttagtgaactgtttggggcagtttctatagtttatctttgttcaatataatctttcttaacacctttaaagtcagaattacttgcttcttagtgaacagctgggacagctcccccaaaccgggcctttgtctcggtgactccacatccatatataccatatgcatagtcacgaacacatactcgtatgcttctagccttgcatcgccttcttccatatttgtatatataaattgttaggttaccattgttctcacttaattcactcgacgtttcttcttatattgaagcaaccttgcattttggcttggaagttatcaggaaaaggaaaacgaattagttcttaactcacagtactgatgtgccatctacgtccattgctacggaagcttgctgcatgcaaaagatgccctgaaaggtctgtctaacagaacttgtactatcagccataaacagctttgccttgatgattgtggctgtcatgtgcctgctatatatcttccatgaacagattggattaattggtgcaattaagtcttacatttgttgattgtatgcacaatttaaaccagtgacgctccttcgatccgtgatctgcaaattttcacttgtaaattaactggtaattttgaagaaaatcctgaataacctcagattctaagattcgaacgtgtggcttttaccagaattggccagctaattctgtttcgaaagcaggatcgggaattttatgttttgttcttgtataatttctttgagatccgaagcaattgtttaatggatgttcgtcgaaagcattcacatctgcatataagtttgacattgatgaaactacacgagcaagataacccatgcattgcagttaagcactacagaaatggtaccttcagacttaattcagtacatctgtatagataaataatattctcaggccctgtttagttcacaaaaataaaaatttttggatatcacatcggatgttttaccggatgtcgaaagggttttccggacacgaatgaaaaaactaatttcataactcgcgtgaaaaccacaagaagaatcttttgagcctaattaagccgtcattagcacatatgggttactgtagcactcatagctaatcatgaactaattaggcttaaaagattagcacttatagtttttgtttttatctatatttaatgcttcatacatgtgtcaaagattcgagaggtttttacctgtgtgccattaaaatagatgacccctgcctctatgccactaaaaagttcgagccaccctctatgccattgtcgaactttatcgcgcccttcacaccattccgtctatttttggctctaacggtgtcaaacaacgcagccaaatgacattgttgcccttaggcttgagagagaagagagaatagagaagagagaagagagaagagagagaaggaaagagagatagagagagagccgagacggcggccgcagatgccacggcccccatggcggtgagctggagggcttccggcgcctgtccggcctcgccttcgacgagctctcccggcgggaccactctcctccgcctccggcccgccacctatcgacctccccacgctcctccgcctctgctttgccgccgcgcccctccttcttcctccgggcttgtcccgcacgccgcagctcctcggctggccgccgcgccgccgagcgctaccccgcccctcggctttcccgccacgcccctccttcctcttcctcctcctcctcctcctccgccgccaccgccgctgccgccgccaccgggcttgtcccgcacgccgcggcgccgccgagcgctgcctcggctggccgccgcgctagtcgcctgcctcatcgccggcctagccgcaccggctggcctctctttacaaggaagcagacactggaagggcaagagcgacattttttgtgcccaggcccacatgtcagaggtgccaaacagttgaatccactcagaatagcgacggaatggcgtggagggcgcgataaagttcgacgatggcatagagggaggctcgaacttttagtgccattgaggcaggggtcatcttttttaatggcacacaggtaaaacctcaagattcgatgtgacgttttgaggaaagaaaatttgggaactaaaccaggcctaagagtgttcttggaaaaagcatttctgtgccaggtagatatattaaaagttgtactaaaattgtattaatttcccctaggcttccagctatttaagcaacaaagcaacgaaaatgacaatgaagtacaacattgtggacaaaccgttgtgcataagctctatttctctgaaaacaatcacgccccttttctatcattttgcccaactacaaatcatcctatattttaaaacaatatcttaaaagcttaaatatagcaaacagccattcggccattccctcgtcttcatttcattccttcaattcctagtcatgcgatgctactaattttcacaatcagttcccatggccgaaacaaccattcccaaaagtttagctctggttgcactcaattaatcagtgtgaaacattttacaaaagccaagcatatatattttcttcacttgttaggagtgggtgtcatcagggagcagcgctagagcatatagaaaaggatgaatacaaaagggtaagaagggctatagtcagcaataacaggcgaccgtataagcctaccaagaggcaataagaacagactagattttgaacgaagaggacgatgctgattgcaaaatactccattaatttcaatcta

SEQ ID NO: 38169 - DNA, 19364 bp, Oryza sativa
ctcagttctctcggtggtcaccactttaatccattactacctttccggtggtttcaattaatttcttatagagcaaaccacaagtattatcaccagtaaaagtgatctaattcattgatttataagatctagtagataacgtgatagtataaattaatagacatattccatttacattagaaaaataaaatgccaatattattctagtacgaagagattaatcgtaaaaattagttgtttcatttctcccttcttgcaacttaagtcaatttttttactagcctctaattaacaaacatgcttaccacagaatgaatcatgctatgtttgaagaccatctcacacacactccccagtgtacgtagtttcggcattttcaagcatccaagaagaaaataaatagtggtcaaccacctcaacagtagtatacaaaattgagcacattaaaagatcattagaagtgatgatatgaaaattgatttaatttcctttggatgaaaatgaccccaaactaaacctctcagtatataaagcatcgatcgtcccacgagtcgatcaatatttgtacatccagtgaagactaccaaaatagaagtacgacttccaaaacgaagataaataaagcatgttttccagtatgatgacctttcagcattaaattgattattgtgttattattgttggtatgctggtctgcatgcatgactcatcaaaatagaagggtctatccaggattaaattacgattgggaggagttgggaaatacttggtgtcttggtgatgggggtgccgaaagtggtgttccataggtaaaatcaaagttgtttttgattattattgtatgatgaacaattgggcattggagattattggttttgttatttggaatttattcacgaagtggttttggagatgattggatttacaggtgaatcgcaggtttattatttcatgtggaccggtcagaccgggccggtgcggccggtcagaccggcgcagcccgcggtctgaccggccgacgctgtgtcggtttcggtttcaggttgtttatttggatatccgtgattatttcatgattatggcttctagatggatactgttgttcgctaacaataagtaaagttggagatagcttggtctcagaatatggtttctttgtttgtttcatgtgtatgtgagtcgatgcctcgggagagtatttgcggtgatggaccgggagtcgacttggggataagacgacgtccgtggtggtcagagatcatgcgggatacttaggctagagttgatacacgtggttgatggagattccatatggcatacgatggagttattgtgtgcgtatgggatgcggaatcgaatttggaaggagtccaaatttggtacgattggttatgtaaagtttctttctggtactagagggtttccaaaggtgtttaggactcctagtatgagtttggttcgtggctttaggctgcctacctcgagtataaatagagggggagcgtgaggcttcccggtatcgcttttgagagcaattgagttgagttttgagttagggtttcgagtttagtcgaaatttttgtaaggagtgctgtttgtgtactttctaaacatagagagaagtaataaagttgtcatccactttaagagttcttcgatttgtgtttcaccgggtttcggcggtccaaccggcgatataccggcggttagaccggtggcaaggcggcggtcagaccggcgggagtgaggcggtcagaccggcggcatccactcggtcagaccggcagatcaatctcggtcagaccgatctccgttgatttcgagggtaacttttatttctgctaaaagttttaggtttttgggtatatcaacttgtcacaccctaaaaatcctagatatataaattgttgtttaattggaattattagaatttattttaaaagcctagaagagaagatctagttttaattaataaattccaatataaaatggggccagataaaatttcatgaaatactttgcttaattctataattccgagatttttctgggatttatttgagctaagaaagtatttttaataaatggaattgcatttcatgaataatttaaattgacaaaggtttttaaaagtcttcttttggctttgggccgaaagtcggcccaaaacctctctctctccctcggcccagtcggcccagtccggcagcagccgcccgcgcacgcgtccgcccgctgacaagtggggcccacctgtcaggcctgtcgtctacctccggccggccgccgcccgaaccccagcgccgcgccgccgtcgtctctttccaaattcggccgcccctttccttttccggtgaaatcaatagaggggaaatgatcttcgggatctcctctaccttttgtcttttggaatcgtcggctaaaatcgtttggaaatccgtgaattcgatctcgaatcggattcgtctctctccccgaaccctagaccttccttcgccatcgccggtcgccgtgagccttcgccgccgcctccttgcccctataaaaggacccccatgcccgccgctacctgccgccaccctcgccttcgtctctcgtcgccggtagaaccctagcaccgtgtagcctcgcgccgccgtcgtcgccgccgctccagccgtgcgccgccgtcgctccagtcgtcgccgtcgctcgggaaggccgccgtcgtggtcgccgtcgcgttgccgtcctcgtccgcccctccatcgttgctgtagaccgccggagcaccgccgtcatcgtcaagccgaaggttgccaccgcttcttcctcgacgccgtcgccgtccgttgatcttctgccgccgttttggtcaccggtgagttcgccgcgtcgttctctacgtgctggtgccctccgttcgcgtcgtcgtgccgtcgttcgccggcgagcttgtgcgcccgagccgccgccggtggtgacgtcaccgctgacgtcatcgttgccgtccgtcgtggtccagccgtggaccggtcgatctcggccgttcgttttggttaggatcgatctcggccgttcgtttccgtgagccgccgccgtgcacccggtccaccgcaaaccctagccgctgacgcaataaacccctttttccttttcaaaaataattcattattgcgtcataattcaattaaaatccacataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgttttggtgtttttgctcttttttgtttaggttccgacgtttccggagagttcgttttcgcaggagaagaatttgaagagttccaagggcagcaaggcaagtcacacagatcccaaataaccctttgaacatgttgatcccgtttaaagctattgtttctattcaactattgcatttattctcgaatgtcattgggtggaattaacctattgtttattatagtccttttgttcttgattactttattccttgataccttggattattataacttgactagttgagctttatatattggttcagctagatattagatataattacttagccatgcttagaaacattagcacacaattgggataactaatgtttcactattacttaatgatggatatttaatggtagctcatgatggttaatcatgattggttaattaattaaattgccaactaaaacttgataatggtgggttgtgagcacatggttttgatggtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatctaggaatggtgcactgtggtggattgtgttgtgtgaggggtactgtcacagctcctttccgaggtaccgtggtggtattaaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataataaaagatgctataactggtaataatttgtttagctcctggtttggaatggtatattcctggtttggagatagaactgtgcagccaggattggttgtacagaatggttgggcctatgcaacagggtatgttgtatagcgttggattaatattgtttaaattactacttaactattttattaaattctgaaatgtttattaaatgctgtttatgcaaatgaaaccctactatgccatcctttgttatcctgagcacttgcatatttgctgcgtggcttgctgagtatgtcatatactcaccttgcaatcattcatcagaggaagagttctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgattatttattagagtaataattgtactctattatcaatttgttattgtgtgcctcggctgattcctggacgagggttcacacacatgtaagcgtttggaattttggatagaaattccgggcgtgacacaactgttgtcgaaatgacaactgcatacgtcgaaagacgtggttactcaacagtggttggaaggaaacgaagtgtattgaatcttgaatttcttcctttttctcctcctcccattacatggccctaggggactatttatagtctcattacgggttcttactactagggtttaggttatacaggggaatttacatgattacccttacgaaagggacatttacaggggtacataatgttataggggctcatgggcccctgatgggccgtccggcgatcgccggccctatagcccctaggcttgatgggccggaaaggcttcttcggccctcgcgggtgcgaacttgctatggcgaagtcgtcttccttcggcagatagtcttcaccttgcacccttcgcctgagacgcctctgacctggcaaggcactagtacgactcttcgcctcacgccgttcttgctccatagcctttgccacgggtttcggcagatgtggtcgcagggcctcatgccatccgccaacaagctcctcacgggcaagggtgagattggagcttcggccgagaccgtgcaaaccatgtggtatggtatgcggcaccacctttcgactgatgctcctgccgaaacctacattattcccgcgcttcgcctcctgcgattggtggttatatattttcttttcccgggccgaacggaacagtattgggctttcccttcgtgggctttttactgtgccgctcggtcggtgggaatttaccgtttcgcctacccttgcgacacgtggcgctttattactggtgggtaggcgaacagtcgcccgggtgagctatatattcccaccgctctttccttttcaccgccacacttgccattttaccgcgtgcactctcttcctccgtttctttcttccacagcatctctccacccctcaagcgtttcgcccattctctttcttcgccaccgcaaacgcaccattctccatggcccctcgcaagccaaaccctgcttcggcgaaagggccggatcccggccgagtcgatgacgacagcaccgcctttttaggggtctctcttgtggatgacgtcgagctggcgaagctggacagctctggggcgttggttgaggggtaggctttcaccccagggaaagccatggtgccgaaacctatcgacaatcggacggtggtattcgccgtcttttttgaggcagggctacggtttccctgcaacgtgttgttgccggagatccttcgcctcttccaggtggaacttccacagctaagcccgtcggcgcttgttcggatcgctatcttcgactgggcgtgccggacttccgggtttgagcctaacgccgagctcttcggcgccatatttttcgccaccgtgaactcgaagacggtgattaccccggcttcaacgaagaagacagtgttcgggagcgtgaactttaacattcgtcccgagcggtccgatctctggccggtgaatgctgccatgtcgaagtgggaccgccattggatggctaggtggttctatcacaccatcccttcgaggctggcactgactcggcgaaagccctccattgccggcgtagggcgatcgcgcctaaccggaaacccaagatcgtcgtggacggctctatggaggtgcggttcgttctgctgcggaaggtttgctctcgccttagctgccgtgacttggtggaggaattctgtatgcttcgcatctttctcctctcccagtcatggcaagtcagagttgatcaaggcgaagaggttgacggtttgccgaacctggttcttcctgaggggacgaacagtaagactgttctcttgctatacactgctgtgctttgttatcttgccttctctgactgttaacatagctacacactttacttttgcagcgttgaccctcgaccaggctaaaaacgaggcccgcaggatgatcggcgatgtgtcggtcctcgagtatagccagttgctaacacgacaagcggctgggcgggcgaaccgggtttacaacggcgaattgcctcctcgggcaaacccccacaaagctgaccacggtgcagggccttcacgaaagcgaatgcgcggacaagtgaagcttgcccctaggaagcgaagggttcctgcttcatcggactccgacgccgatgacgaggacgatgtcgaagaacgcgacggcgaggaggaaggagaggaggaagaggaggaggccgtggccgataaggccgcgaacgaggcgatcgaagatcgcgtcgacacccccggctacaatgagaccggggtggagtcgaacactccccccttcgacggaaggatttggaaggggtgaaggccctagttgcgttctcctcgggcaaggcggcgaagggaggtccggtgcagaaggtctaaaaagaaaggacttgtcgacatcgcccgcgttttcagcgatgacaaatcttctgacgggactccaacttcgcccgctggccgcagtttggtcctttcgactcaaggggaaagaggccagggccgaggttgatcgcctcaaggccgaactggagaaggagaaggcccattcggcggtgctcatcgattactacaaccttactgagccaaagatggaggctctttgccagaaggctagcagggccgaagcgagcgccgcggaggagtcgcagcgtttttcgcgggagatggcgaagaccaccgaatccacgagaatggcttgcgaaacgctccgcctcgcccttaccgacatgggcgcgaaggtgcggggggtccctgccgtggatgcctcagccttcgacttctccgagtggacccagcaggctggcggatcggtttcggactgcgccaccgcgtacgacgattgctgtgcgagtgtatcggcggccttcacattaggccttttgcaacagttcggctgcgagcacatcgccgagttccttacctatgcgaagggggactgggagattagtgcgcagaacatttcgcccgctcttcgcgcatggcgaaaacagttctggcagaaagatggccggtccgctgccaaagcgcaccttctggagcaactggcgaaggcggaggcggcagatcggggcgaaggagagggcgcggcaggcgaagaggttggaggcgatgcccaggttcacccagaggtgtgaggccctccgccctttccttagatatttgtagttttccaccctcttttgcgtttgcctggagaggcgaatgatgtacattcggcaggctaccgccaaaccttaaaaaaggctttttttgtacatttggaatgtatgacacaatcttaactactttttgatgatcaaagtctttggcatattattatttcgctcatctcacattatgccatacctcccccttcttctgcctattcttactatgttagctgtgttttgcttttactgcactatccatcagggggttcgccgaaagtcgtgcatccggcccccttccgggagctggcgaagtcaaaacgagaaatttgtggcaatgaagggtctgccgaaggtgcgatgtccatttcggcctatttatcgcgaaatggagataaacggtcgcagctataaggttttcaaggttgccgactggctgcgggcgcaccccgggcgaaccttagaagattacattcttgttcattcaagacgtctggaggatatggctcgcttttggcgaatccatcagaagactaaacgtcaggaaacgatctttcagcgtcgttacagtttagtctgtttttcgccccctactcctcttaaggttgtgtatgatattagtagtgatgacgaacctagttcgcctgatcatgccttagggagggatagtgattatggggacaaagatgtaatttacttgtaaggtgaattgtatcgtgttgtgaattgtatcattttcgatctgtagcgttctatgtcgagagaaacacttttgcttttatgctgatcgaacgtaacgtcgttcggctatttattttccgagacaagctgttgcggtttcaacgttcagcgagcgatgcttcggccgattcgtttcgcccccctggcctttttcgctgatcaggcgtttgccttggggtttttccacaaattatcaatcacacgagaaataaaaagaaggcggaggacacagagattttatactggttcgggcctccatggtggataatagccctacatccagttttttttttctttttcctctctttcttctttttttttcttgccgaaaggctttcatagtgctgaagggcttacatagtgccgaagggcttacatgacagtatgtacatttttacaagttggcaatttgggtgccacccattctaggcatagaagcgcttgagagagacggtgttccaggaatggtcgaactcctcgccttcgagtgtcgctaggcgaaaagatcccgtcctggacttgtgtttgatgaggtacggtccttcccactttgattcaagcttaccaatcactagtgggttcgccttcttccttagaacaagatgaccaggcatcagctccgcgagttgaacttttttgttgtaagttgccgaagtgcttgtggcgtatttgtgcatgtgctcgagcgcttcgactcttactccttccaagagttcgagcgatactccgcgtccctcttcgcccccagagaacatcacccttggtgagttagcccctagctctgctggggtcattgcctcatcaccataaagaagcataaacgggctaaacttggttggtcttgtgggggtcgtccgaagggcccagagaaccaatagcaattcctctggccatttgactttcgctgccccctcgagacttttctttagtgcttctaggatcttgccatttgtatgttcggccgccccatttgactgcgggtgtgcgaccgacgcgaactgatttccaggttaagcccttcgcacatttctttgaacttatcagagtcaaactacttgccgttgtcagtaatgaactcttttggcaccccgaaacggcaaacaatgtttttccatacaaacttctgtactgctgccgaagtgattgccccaaggggttcggcttcaatccatcaagagaaatattccacagctacaattgcgaatttatacccgtttcgcgaaaccgggaacggcccaatgatgtcctgtccccatctggcaaagggccatattggcgcaatgggctgcaaatcatactggggcgtggcttggcttcggccatgacgctggcaactttcgcacttcttgatttgctcaacacagactttcaacatagtgggccaataaactccttgtctaaatactttggaggccactgttcttgcagcctggtgcacgccacatagcccctggtgtatctccttttccatttcttcgccttcggcaaaagagatgcaacgaagtaagggttaaagtaccccggagcagtaaagctaacccgagaccatcttatacttcgtggctctgagttgcaaacgcttcgcttctacttcgtctaccggaagccagccagtttgaaggtgtttcacaaatggggctcgccagtcatatgggtcttcgcccagtttctcctggtcgattgccatgacttccgagctgtccatgggcacacttggagcatgtaggacttcgaaaaagatgccaggcgaatatgggccaccacaagcaacggatttcgccaaggcgtctacttcctcgttctggtctctaggcaagtgttcgaccgttatgccggtgaagcatttttcatggatcgaatagcctccagatacctctttattccctcttcttttgcctcgaagaatttttcaacatggcctgctaccaacttggagtcagttcgaattagcaggcgccggactccctttcttaggcccaggagaacggcttcgtattctgctgcattgttggttgtgtcgaactgcagtcttgctgcgtaccgcattggcacaccatttggtgaaaataggactgccgcaatgcctgctcccctgtgcgaccacgagccgtcagagcacatcacccagaattgttcggcgggctcggggtcgggggcaagtaccggtgtccattcagctacgaagtcggctagcgcttgagacttgatagcagagcgtgcaacaaaatgtaagtcgaacggggatagctctgcagcccacttgctgagccggccagtgacttccttgcctcggagtatttcgcacaaggggtactgtgatggcattatgactttgtgggcctagaagtagtgcttaagcttgcgcgaagccatcactagggcgtaagcgagcttttccatttcaatgtaccttgtcttcactccttgcagtgcttcggagacgaagtagaccgatttttgtctgaactctgtttcttggacgagggcagcactgactgccaccggcaaagctgctaagtataatagcagttcgcttcctgggggtgggcttatcagagctggcgggctttgcaagtattgctttagctcgtcgaatgctgcttggcactctggtgtccaattaaactttcctgcgccccggagggtcttgaagaagggcaaacctctttcggctgcctttgagaggaatcgactgagtgccgcaattcggcctgcaagcttttgtacttcatgtacgcttgacggaggcttcatttgctggatggcatcgattttctcgggattcgcctcgatgcctctttcggaaacaaggaaacccaacaacttgcctgcgcggacgctgaaaacgcacttctccagattcagccttatgcctgctgtgcgcaagctgtcgaatgtctcctgcaggtcgatcgcatggtcgaaagccttgcggctttttacgactatgtcgtcgacgtaagcttccacattccgccccaactgcttgccaaggaccttgtacaccaacctggcgaaagttgctcctgcgttccttaagccaaaaggcatcctaaggtgacaaaatgtgccgaatggagtgatgaaggatgttttggggatgtcgagcgggttcatgtggatctggtggtaaccggaatatgcatccaggaaactgatgagctcgcatccagctattgaatccacgagctggtcgattcgcagcaaggggaagtcgtctttcggacacgctttgttcaggtctgtgaaatcgacacacatgcgccatttgccgtttgacttccgcaccagcactggattcgccaaccactccggatggttaatctcttggataacccccgccctgagcaatttttgtacttcggctttcgccgcttcttagcgatcggcagacatcttgcgcaacttttgttttcttggcttaatgtccggcttgactgctaggtgatgcatgatgagatccgccgggacaccccccacctcgtcagggctccaagcgaagatatcgatgttctttttgagcacctctaggatactctcaacttcttcttcgcccatgtcgccccctagtgatatgagctttgtggggttagcatcatcaatctgcacttttgttatcttgccatgaggggtaggctttggcgtgtgcttcggccgttcatgcggttcggtctcaatactgtgcactgctctgttgattatggctagatcgccttttgaaacagccgaaggatgaagccccttgactactatcacccctatcgggccggacatcttgagcttgagataattgtggtgggaaatagcttcgaacttgttcagggttgcacggccgaagatggcgttgtagttgtacgggatgtcgacgacgtcgaacagtatttgctcttcgcgtttgttctcccccgagccaaaggctatcagcaaaagtgcttggccgagaacttgaactgcttctccgtcgaaaccgtggagcgatgctggtgctggggtaagggcttgggtaggcaaccccatcttggcatatgcttcggcgaagataacatcggccgaactccctccgtcgaccaggattcgttggacttcggaaccagctatctcagctgagattaccaggggatcttgatgcgggaacataactccttctgcgtcttccggcccaaaagaaattaactagttcagatattgcggcgccacttcgcccgccgaagtgatgctgtggaccatacggttctgcatcttcttctgccgtttggacaactggcttggcgggtcggcccttgtaatcacttggattatccttcgttgtgcatcttggcgttgttcggctggaggtgtttactcctgaactgcttcgcggggtgcttccacagttgttccctgctgcggccttgggtcttgcgcgttgccacgttgcctaatgtttcggcattgctccgtggtgtgcgaagagctttcgtgaaaggcgcaatagaggtcttttcggaccttcttgcgggctggctgctgatggttgcttgcttgctgggcgtcgaactccttgcgaagggcttgcacttctttgacagccatcacagtcttgcccgcacggtctgttctgaactttctccaagtcatgggggcttggccttgccttggctgctgtccttggatcgccggctgagactggcgaacagagaggggaggtggttcggcaacttgaacttgtgcttgagcttgagcagcggcgacagaggctttgtcgtactcagcttgtatagcttgtcatcgcttggaatcctcctcgccccttgcgaacccgtcaatgatgcgaagtaggtgctcgagcgtctgtggctccttgttggcgatttttcttgtgagttcgccctcgagcagaccggccgaagcggcgtttataaccgacacctcagttatgtcttgaacttggcaccgggcttgcgagaagcgaggcatgtactcccttatcaactcccccggcctttggcgaatgccgagaaggtgttgctgcgtcttcggctcctcataggtgcctcgaaagttaaggacaaaaacatcgcgcaattgctcccatgagtaaatgctattggctggtaaattgaaataccaagaacgggcgatgccgtctagagcgagatgtattacctttgccttggtattttcgtcaccatgagccgcttcgatcactgactcgtagatggagaggaactccttcgggtcagtttcgcctgaatagcgcgggacgggtgggaacttgaactggggtgggattggacgagtcttgattcccccactcagcggttgccccttttctcctcccgccctgtttaccgcactttgcggcgggtacggtgtggcgaagggcaaaatcgcagcttgtgcgtgaggttgggccctggcattcgactgcccggctccaactggaggtacttgctgagccgccatggacaggtcaaaaattggctgcgaccacgtcgtggcagcttggattggtgcttggtttgttccgaagcctggagttggagcttgctgccgaacggttggtgcctgagcagcgttgacgaagtcggactgcggtccttgattccatggcgaaactcccaggcccggctgaatcggtggcaaccaattaggcgcaccttgacttgtattcccctccgggtgggccgatggggttgtacttgaaatgcagtggggttggttgagttgctgaaggaaagcttggagttgcgcctgcagagccgaagccccttccgccattgtttgtggtgcttggccaggtggttgatggtgtacttgggcagcgactggttgagcttgcagttgcacgtgaggggccggatgcactgctgcggccgattgctgcccggcgaagtacactggcacctgtgcagcttgtggcggaatgggctgggtcgtcacttgcggatggacttgaggtgggacaaaacctaccgaatactgaaggattggagccgacgtggccttggtccgccttgccgcctcgtatgcttgttgttgttcttgcatttggcgaagcatgtcttggagccgtgtcatcttctgtcgcatggcttccatgtcagcttcggcttgagtttcggggtcagggctgacttgggcctgcacaacggcgagcgcagttggggctgctgccggctgcgatggagcggcttggggcaccaccagtcggcttgttgaaaggatctccgccctggtctggagtgcccttgccgccacagccgcctttgccacgtcggccgcgttcggcacttgcacagaggttgcaggggccaaaggcggttgtgatggcgctggtcctcctccatcttcggccacgggcgccgaaggctctgctccgtcctcggcggccatgtccggtccggcgtcgctttccttccgcctggcaaccttctccttcacgaccctcttcggtggcattcgctctcagtggtttcactcggaggtccccacggtcggcgccagctgttgtcgaaatgacaactgcatacgtcgaaagatgtggttactcaacagtggttggaaggaaacgaagtgtgttgaatcttgaatttctttctttttctcccccccattacatggccctaggggactatttatagccccattacgagttcttactactagggtttaggttatacaggggaatttacataattacccttacgaaagggacatttacaggggtacataatgttataggggctcataggcctctgatgggccgtctggcgatcgccggccctatagcccctaggcttgatgggccggaaaggcttcttcggccctcgcgggggcgaactagccatggcgaagtcgtcttccttcggcagatagtcttcgccttgcatccttcgcctgagacgcctctggcctggcaaggcactcgtacgactcttcgcctcacgccgttcttgctccatagacttcgccacgggtttcggcagatttggtcgaagggcctcatgccattttattaggaaacttatgggcttgggcccttgatggcccagcacatatacatttattgggcccacatctaaattttccatatatgaaatacggctatataaggagaaggggagctacttattgtacacttggtcctatgggaatgaatgagaagagagcctcaccccatatcttgtttctccaacttatgtagatattatgcaaccctttttggactacgcgtgtagcacaggggttgcataatatgtatagaactagaaatattatgacctttcctagcagcagcagttgaatttattggcctagaaagtgccacgctcatattacctatggaacagttatgcactttatagaaacatctattgtataccccttgaactctctaaaagtatgatgatttgggccacactaccttttatcaacggattgtccatattcgtcttagatttataagaataaacattagaacttgtatgatcatagcacatatatgcatcattttcctaagagaaaatcccttgtatacccctcaaattttacctaatcccttctatacccctgaattttgcttacttccttgtatacccctaaaatttgattttgatctcttccatacccctcccgtcagttgaccgttagttgaccgtctattttccataaaaatgaccattttactcttggatgaacaaagaaattcatgagttacattattaaaaatataaaagcttctcgcatgagactattatagttatgagtttgttgttcgatgcattatttatcccaaaaaatattgttagataatgaaataaaaaatacatatttatttttttaaaaaaagtcataaaaatgaggagcattcatataaaaatagaactaccaatgttcacaacattcttttaatgaatgctcctgataaaaaaaaatccattgtcctattaaaatttcaaataaaaattttaatttattacatttattttattttcaaaatttatgtcaaaattttctgcactaattatttagtctctttagttttataaaatgcacatactgtacactcaaacaaaatttttaattgtttttcaagcttatatttgaacctaaagcatcaagggcaaaaaggacatttgcaaccaaatgtaacagtgaaatgatggaaaatgtaacggtaggggcatggaagggatcaaattgaaatttcaggggtatagaagggatcagataaatttcaggggtatgaaagagattgagtgagctttcaggggtacacaggaaatttactcttttcctaaatctcgaagatgatataaagtttgggagatgcagtgatggtgattatacggttagtcgtgaaatcaaagagggagctcatgggaatggggatacaaatgtatattcataacttgactccttagcgggttgaatccgattccatcatggatctgattgccaaggacacctcttcggtccccgcctcccccctccccccccaacctaggtcggtcgttcatgaggtgggctatgggagggcaacatgtgtctccatctcgctcgatctcccgatccctgtctacacaaatgtggaatgatacattagtatcatgtatccctggccatgttgtataaaatggttctcccaagtaaaggttaaaacggcaacagttttgaatgttcaggttacacaatgcctattctttatagaaataaatatttgtttccgaaccattacttttacatcgtacaaactacatttgtgatccacgaatctatctatctattatatgtacgaagtccattaaactttctataaatgctcctaagccaccacatggcatcctataaacgcttataagctgccacatggcattctaataaatcggtagacccactatttttaactactatattagatttcttttagaaaacaataaagccccataatcaatctctctcctttttccgttgggccatatggtacatacaatcctccagttctcctgccggtggccccgagagaaaaaaagccaagaaaaataatatgcacgtatgtatatatgtacacgtattcacggcaaaaaaaaggaaaataagatatttacgtacgtacatatgcacctatcatcaaaaacaagaacaaaagcaagcacagtatcgatgggaaaaaaaaaagaacatctacgtacatatgcacctaccatcaagaaaaacaagcatcaataaaacatagcacatctatgttatctataataacagaagaaaaatactacatcacatattaaagatattttcaaaagatcatttttaatacatttttatgcctttttgtcaccaaatagtgttaataaaaactgaacaccacattgatttacaaacatttcgatcaacttcatcctcctgtgaacccaataaacatatctcagagaaaacaaaggtccttcatctccacttcacctccccttcccctcacatacgtatatcactgtctgcttctccctctgtctcgaattggcaatattcattcctctccccattcctaatatttagtaatccaactaaaagagaaataattagtaattgtaattttcaaatgatgataatttttaagccacatgctacacatcttatgtctaatattaaaatttctctatttataattaaaaaaacaaattaacatatatatacctacatttttatatataagattagtcgatccatgttttctatatggcagtcaaatagcaaaaaaaaatatgataataaataacaacaaatattacatcattatatagatcattttataaatatgcatagataaactaaatcagtagaatccaaaaaatatataaattcaagtatgaaaaatatttttatcgatagagaacacttgcctttttgcatgttgtctgaattgctataaaatgctataaaataattcaacaacacatgttgcgccatcatatatcatatgtagatattcttctacaacttttaggtatgaacacaatttcatttatttttttgtccatgaaccattaaaaacaattgtcatatataagacacacacaaattataataaatttattcagactttggaaaccaaacattttcttgcgcaaacgagtgcatgggagagaaagagaagtacagagagagttagcagaccagtcttaacgagctaagaacaatgtatcaatattaagtgggacatggcacaacgagcgtatttttaaggcatggaacatatttactaggaattattcctacgagaggatcctatagcaaccaaataattttcatgctagaaatgaaaaaaaatgaaatattttttttggtcttgggaaaacagggattttctatggtctttgatacgatacaacataattatagcaactggataggtattataggctttatataataatctaaatgcacttgataaatgccaggtacaagctagctaaataaaaatttaaattacaaagtagtcgatctcaagtaaaaaaattcctaatattaaattattttttatggaaaaatatttaaatcatgtaaacaatcatagtgtaccacattttaaaaataatgatgcatgcacaattatataatt

SEQ ID NO: 38170 - DNA, 9628 bp, Oryza sativa
atttatcatatcacaaattttatacttaaaataagacttgtataaaataaaatataaaatacaaaaatatcaacagggagtaaatttaaccaattggagaaattttgcttcttacttcacacctaaattgaaacgactattgcaataaccatttcataataattgccttagataattagaacaattctaacaggttaaaaaaaatatctaagcaatgccaagaacaaaatttatgaagaaataatacttttgaagcatatggcatacaaatattatccagttaatataatgaatcttatgatgcaagcccgcgtatttgcgtgggctttctagttgctaggaacatgtatgattgtaccatcatcccagcttcgaatttcttggcttgctcatcacggatgtaactaaggtcacaagaggccactatatgatgaagacgaagagctccgaaatagttttacaggatgggagatatgggcttggaatacaacggtggcatgcattatttgtctagaactttgattttagtttcttggatgaattacacgtcacccgctctttctgtgcaaaatatgttttgcagatagagattttattggcgttatgtcctacagtgagatagtatgatccatgttctcttcaatgattttttatctactgccttattctttattttgttcagatataaagctagctccagctcataaaaccatgtccggcatgaagggaacactacactacactataagggctcttttgatttgtaggaaaagtgtaggaaatttgaaagattttaatcgtatggaaaaatttccgatgaaatcctttgaaacaaaggattgaatcctatactatcctttaaaattcctatgaaatgagtaatcctatagagattttagaggaaagttagcaagaggtccaacctcttgaaaaattcctttgagtctctctctcatccgattcctacatttttcctgtggtccaatcaaatagtcattcatgtgttttccaatcctctgttttacacctgcattcctgttagaatactgcgtttttcctattcctccgtttttacattcatgctattcaaaggggccctaaaagaagggtttatgatctgtaaagtggatatatagtccaatattacgcctataccttgttgttgctagccattaattcttcagatatgcctttcatcgccatgaacactacgctctgtttttgaatgaaaggttccctcatgattgcagagttgagagttgagaccttgagcacaatagtgcatagcagtccagcccaacacccccatttgctcaatgcatgttttcctggaaggtcgtctgcgatggcatataaagtagtatcatttttgtttcacacaaacattttcttcatatatacctcccaagcccaaatagtaatatgtaaccagaatcaggttcactgctccctggttggcagagtggcgattgaatctcgtccaactttctatgctggcaacgtacgttcaactgctttgaagtggaaggcattaggaaaatggtggaaacaaggtctgcaatcctaggttggagatatgtgcaggtcacataatagctccgagttgcgatggcatggaaaatccattgaaacaagtcgagtaaatcaaagtatgccgctgctatcttattctgcaatttaaaagacgaaaaggccttgaatcgatcgaaaccaacagattttgtgtactatgatactatctcgcatatataaccattggtagagccaaggcccggccagcatgggcaggtgtccatgctccgacgcatgcagccttgcattagagctaaatacggtgcttagccattagcatagctgcacatacaccattagattagcactaattattgtacttagccattagccagcagcccaagtttgcttttgtccatgataaaatgctatatgtatctgtgtttacttataatttgttatctatcgttaggtttgcctaggctaaaaaaatttttagatccgctactgtatataactacagaatggcgctaaaagtaaagagggacttaaatgtatttcctatcgttcccaatctattattgctttgatccatctagtttagcttagaacaaaagacatctgtaatggcagactaatgtttcatctaatggaagatgttcatctttatattgagagatttcgaaaggagtctttttggacagggaggtatcaggttgcaccatagagttctaggcaatctctgtagaacttcctcttgcaatatctggggaatggtgatcatgatatttttccagaaagtccttcatgaccatcgcccgtacgttatggctttaatttggtgcttgttgttagttttcagtagagcagaggagctctgcgctgcaaaattttggcaccgatactgttgtgatcatatgctcagagaacttgagaacttagtggtgtcctggtctaatgcagtacaaactctagtactctctccttctctaaatgtttgacgccgttgacttttttaaatatgtttgaccgttcgtcttattcaaaaacttttgtgaaatatgtcatactatatgtatacataaaagtatatttaacaataaatcaaatgataagaaaagaatcaaatgaacggtcaaacatctatctattatatactaaaagttaattaaacttcctataaacgctcctaaaccgccacatggcatgctacaaacgctcataggctgccacttggcattatcaaatctcaccgtcgattttcacttaaattggtggacccgttattttataccattggattatatctattattaaaaaatttcaactttctctgtatatgatttaagagctactactgttgtcatgtacgtacaggtttatacgatgtcttctcccgtacgtacttatgtgcacaaaaacaaaacaatagtttacgtactattcgctggaaagaaaagaaaaaaaccatgcgcatgtacataaaaaagatgacaaaaaaatacatcataaaaatcgatgatctttaaataaaatatgattttctaaaatatattacatcacaaatataaatatatatagttaaactaagatctataataataatataaaatatccaaccaatgttccttgaaccatcttccaaattatttttaaattatatatctaatttctgattccgttgttttcctttaattaaattataagttatattgtggtcttaaatatatcacgacacatggggctgatatataatagttagtttttgataatctattatatactaaaaggctattaagcatccttaaaacattctcaaaccgttatatggcattctacaaacactctcatctcaccatgtatcactctagaaaaattatagaaaaaacaaaacatctagctatcgattttcactaatatacggtgcacccgtattttctaccctcggatttccttaaagaaaaaaaaaagaaagacccacaccccaccgcttccatccattacgttacattaggtatatgtacgtagttacgtactccctctgtttcacaatgtaattcattctatcatttctcacattcatattgatgttaatgaatttagacatatatatttatttagattcattaacatcaatatgaatgtgaaaaatgctagaatgacttacattgtgaaacggaggaagtatcatatatccctgccctcaccctaatatataagggcaacatgccctcctattttcaagcattttcttaattaatattggaaaacatactttgtaataaattattttaaacaactatatcatctaaatagctattttttattcgtgcatgggacgagattatttacaataaaatttagaattcaatacctacattaaatatattttaaaagtaaaataaatgtatttctttgggtcatataatgctagagactacctattggtcactcgatatatattaagaaaaatcacatagatcagtgcacgatacatgcccgcgcattcgcgcgggctaccttcctagtttttaaaaaagtcaacggcgttaaatattttaggatggaggaagtatatatgtttgtcacagagaacttgacctgctatgcaggtggctagctatgggaagagccccagcatgaacagcattgttgtacttccgagacctatgtggtatgcacgatgcgttggaacttgacggccttatctcgattatacttatggttagcaaccaaaatttaaattttcaatcttcgagttgattttagagttttcctcatcatacagcctttgcttttagaacatatatatatatatatatatattttatttataaattattttttgtttacaaatatattgtttggattttcgtcgaagaagccgaacgatgaggctgttagtgcgataggcaaggttttttcttaacgaatatccatgcgtcaggcatgtcatggtgacatcaaagcagtttaatttatttttttttgtctaggaattaaagtacgacttaacatggccatctgaattctgaaaatatggtcctgttttgataccaccctataattttttatccagtcacattaaacgtttgagcacctacatgaagcattagatgtaggcaaaaaaaaataacacttgtacagattgcgactaatttgcgagattaatcttttaagcctaattgctccatgatttgacaatgttgtgctacagtaaatatttactaatgatggattaattagacttaataaattcgtctcactgattactgacagattctgtaattagttttttagtttgtgtccgaacacctcatgcgataccctatataataccagatgtgacagacccaaactttacacccctggatcgaaacaccccatatgtcgaggaaatgctaagattgcttcttagaagtgcagtttgtaatttatatctatttaaagtggttctggtgttacatatgaagatctgtcgtacgtctgtatctactcaatataacagctagtcccagctgcaagtatttgtaaagccataacctttcgatgtttacaaaggaaaacactatttttaccaggtgtaaagagtgcagatgcctacatgtacacagcttcgtgaaatccgacacctatgcatgcaattcgatgatccaacctacataatgttcagtccaatgagcttttggagctccggtttttggcttggaaggcgtcaggaaagggaagatcatagtaaagatgaacatcctcactgcatgcctatcagcatctcctattggaaggctggagacggtagtctacattgcaaatagaaggccaggttatgacgcttccaccaactggaacgtaacaatagtcaagaacaccatcattttatagactgatctgttaccagcttgtagtgaaacaagggccaaactcaaaaaacctaatatttgtttgaccgggctcaaaacctagttaatatttagtggttatagatgtgcaagcactattattaatttgtaatagttttgaaaataaatattgtaccttgtatatatattagtatgcacaggttggtatcacaaaagatttagatttgaggataattagttgtatattccattttaattgcctttagacttataatatgttcagttggtatccattgtaatgcatggatttctgatgctaggtatatattgaaaacattattcgaaaaatatgtagcttgtcattcaagcttttatttacactagggtggtagcccacgcatatgcgcgggcatgtgcgtgaaattttattgtgaatgtccatgtgtgggtggttttctataaaaaatattcttttgattcatcataaactaaaaatgaatttatttaacatgctttgtgtaaaatcaaaggtgtttttgattattattctgtaatgaacaattggcattggagattatcggttttgttatttggaatttattctcgaagtggttttgaagataattggatttcacaggtgatatacaggatactgctagatttgtgtccggtcagaccgggctctggtagccggtcagactgttggtatatgcgcggtcagaccggcgcagtccgcggtctgaccggccgacgctatgtcggtttcgatttcgggttgtttctttggatatccgtgattatttcatgattatgacttctagatggatactatacgtatgtaatactgttgtttgctactaatgagtcaagttggagatagcttcgtctcggaatatggtttcagagatcatacaggatacttaggctagagttgatgtacgtggttgatggagattccatattgcatacgatggaggtattgtgtacgtatgggatgcggagtcgaatttggaaggagtccaaatttggtacgattggttatataaagtttctttcttgtactagagggtttcctaaggtgtttaggactcttagtatgagtttggttcgtggctttaggcttcctacctcgggtataaatagagggggagcgtgaggcttcccggtatcgcttttgagagcaattgagttgagttttgagttagggtttcgagtttaatcgaaatttttgtaaggagtgttgttggtgcactttgtaaacacagagagaatcaataaagtcgtcatccactttaagagttcttcgatttgtgtttaccgggtttcggcggtctaaccggcgatataccggcggtcagaccggcggcacgcggcggtcagaccggcggcatacgggcggtccgaccggcggcggcggcaggcgacttcggcggttcgaccgatcgatctacatcggtcagaccgacattcatctagcggtcagaccggcaatacaacttcggtcagaccgcgatccgtcgaatttgagggtaacttttattccagctaaaagttttcggtttttgggtatactaaccattcaccccccctctggttggcttagttcttgtatttcgatcctacaagtggtatcagagccttgttttcttctttggatttttatcgatctagagtttttgccatggctactcctgctaggtttttaactaagcctcatgttttcgatggaacagatttttctcattggtgtagtgggatgcaatattatattatggctgaagattatgatatttggagaaaagtttcttatccttatgtgattcatgaagctattaatactgctgctaaaaaaactgcgtttgaacaaaattgcaaagctcgcaacattcttttgagtggtatttctcgttcggattatgatcgtgttgcgcattttcgaactgctcatgagatttggaatgctttgagtaactttcatcaaggaacaaataacatttaagaacttcgtcatgatattttcaaaaaggagtatattgaatttgagatgaaacctagagaagctttggatgactatcttcctaggtttaataaaattttgtgtgatcttagatctgttgattcttcttatgatactaattatccacaatctgagatttctcaacactttttaaatggccttgatatgtcaatttgggggatgaaagttacatctattcaggagtctgttaacatgtctactttgactttggattcactttacacaaaattgaaaacacatgagatgaacgttctttctcgtaaagttgattctaagtcgagtgctttgatttctttttcttcttctttggatgttgatgctctttcatcgaagccttcctttcttgctgtttttaatgccacatccgatgatcaactcaaacagattgaggaggaggatttggctttggttgttaacagaattgcttgagctatgaataatgccaggaacaggaaaagaggtggtccaaatcgttgctttgaatatggttgaattgatcatcttcattcgcattatcctaagcttggaagaggcaaaagagaagacaaagatggtgagaagaccaacaacaacaagccgaagggttcatgccaagggaggaagatgaaggagaatctcaggaaggcttttgaacaagccgaagggttcatcccaaatgatgtagatggtgagagtggagatgatgataagggaaagaacatctctggtgtttgcttcatggcgcgtggtgaatcggatatagagtatgaagatcatgaggtaagtgcttttgaggaagttactaatatcttaagtgcaaaaaataagaagtgtgagaagatgtatagaaaacaggaatttatcattgaatctcttaattctgaaattgctagattaaaatctcttattcctaatgatgatgattggaaaaattgtgaggttttaatgaatgagatttcaaaaattagagatgttaatgctgcacataatttgaaaaatagatcttctcttgcttgtagttttgctttgcacacacgcactttggatgagttgtttttaactaaaaagttgttgcaaaaatatcaaattgcttttcatgctagtttgatgtttaacatgatttctgctaaaaagttaaaacaacctcatgatgttttggattgctcaacatgtaatttgaataagatgaaactgaaagatgctttaggtcgtgttgagtacatggaagatgttgtgaaaaacaatgaagtgctttcttgccctaaatgtcataaaagcaaaggtgtcatggtagattgtgaaaattgtgctaatttggaaaaagaggtctcttatttgaaaaattctttgctaagattttctgatggtaaaaagaatctcaacatgattttagatcaatctaaggttagcacacataaccatggtttaggttttaatcctaatactcatattctatacatccacctgttgtgttaggtgctggtgctagagatggtgagattttggttaaacctgatactaactaaactgtgtttaaatctgctagtatcatgtctaccttgagtgcatcttcttcaaaatccaatattgtgcatgcaaaacctcctgttgttgcttgtgttgctaaatcttctagttctaccaatgtgtctaatcatcgtgaaatatatacttgttctttttgtggcaaagatggacatcttgtcggtttttgttttagattagctcataaacagaaaaaggagagagagattgcttttgcaaaatcaaagtggcaaaaattgggttttccctcgaggaaaccgatcagaccgcagtgggtcccgcggtcggaccggcgaccggtcagaccggctactgagcatcagtcagaccggcggtgcagcggcggtcagaccggaccccggtcagaccggccactgtacctcggtcagaccggcctcggaggaatttttctgaaaattctaatattgattttgcacgtggatatatgcctattggatcttctggtcatgtgtctcagtactggattcctaaatttttattatcatctaaccccagtactgaggcttcgacttctgcttgtgtgtaggctttggtggcaaggaaggagaacgtgtagatcgtggattccggttgttcgcggcacatgaccagtgataaaaattggttctcctctctcaagaaggcatccaagactgaatcgattatctttggtgatgcttctacaagtgccgtt

SEQ ID NO: 38171 - DNA, 450 bp, Oryza sativa
ttcagttttaaatttaatttgtcttcaaaatctgactgaaaagcttgcaacccagcctgataagctaattaatggacaatcaattatggattacctgtcaccgtaactacaactgacatttccatcatccatctcaatgtaaggttttcctttttaccctcgttcctcgtacaccactactatttatgtaccacgcttggagcaccttcatcagcattgactagtatcagcctccagtgagcagaattcctaattcgcgcatacgcgtcgccggcgcacacttcaagcccacagcccacgcgtacgcacggtacagcgcatcggtgcgattttttttcggattttttttccataccgcgtaactaatccattagttttagcgtgtaaaaaaatccattagtttcagatagtaaagataattaagataagatttgtttttcttttcagaat

SEQ ID NO: 38172 - DNA, 705 bp, Oryza sativa
ttctcctcgtgttccgcaacaaaacgatgttgttgaaagaaagaatcgagttttggttgagatggctagaataatattggatgagtatcatactcccagaaaattttaggctgaggcagttaacactgcatgctatatttcaaattgggctttcttgaggtcaaaacttggaaaaacttcttatgaggttcgatttcgacgtcaacccaaagtttcacatttgcgtgtttttgttgcaaatgttttgtcttgaaatctagaaatttggataagtttgaggcacgctctaccgatggaatgtttcttggttacccagcacattcacgtggctattgagtacttattttggagaataacaaaatcgttgggacttgtgaagtttcttttcatgaggctagtctacgtactagaccagaaattgcatgtacattgtcacaggttcagggggaggatagtcgtatttttgaagacgagagcgacgacgacgacaacgaggtcggctcggccagtcagaccgccggtacacctccggtcagaccggctccagacgagcagtcagaccggccaggtttgtcggcttccggttttgttgatgctgatcgagatggtcctccaaaggctacaacttcgaccagtgagggtacagaatgcgaaacaacttcagaagtcgctgctactttgcatattcaacgacaatatccgcga

SEQ ID NO: 38173 - DNA, 20348 bp, Oryza sativa
gatgatatcatctttggttgttcaactcacgctttggttgtagagtttgctgagactatgcgcagggaatttgagatgagcatgatgggtgagttatcgtacacgaaagatcttttgagatggttcaggatggagaattgcaaggcaatttcaacaccaattggttctatagttgtgttggatcctgatgaagatggtgaagctgttgatcagaaggagtatagaagtatgattggaccattattgtatctaactgcttctaggccagccatataatttgctgtgtgtttgtgtgcgtgctttcaagcttctcctcatgcttcacatcgtcaagcggtcaagcgaataataaggtatttaaatcatatacttgagtttggaatttggtattctacttcattttctatatgcttgagtggatattctgatgctgattttgttggttgtaaaattgataggaaaagtactagtggaacatgtcattttcttggtacatcattgattgcatggtcttctacgaaacaatttagtgttgctcaatcaactgctgaatcagaataagttgctgctgctagttgttgttcttagattctttggcttatatcaactttgaaagattatggtcttacttttgagaaagtttctctcttttgtgataatactaggaaagaaatttgaaaatatactttattttttcatattttgcgtttatatacctgactgtaattaatttgcaaaaatatacccaatccgcggaacggttgtgcgggagcgaggataaaccaaccggtcccgctagccggggacgcggtaccgcgccggtcgcgcgggctgggtgagtgcggcaatgctcccgcatgccggatgtgcgggaccggcgctcccacatgccgcccctcatctcggttcccaaattggatccgatgtcctatgcacgaaaaacggagcaggccattagcacataattaattaagtattaggtaattttttttaagaaaatagattaatatgatttttttaaacaactttcgtatagaaactttttacaaaaaatacaccgtttaggagtttgaaaagcgtgcgcgcggatgagttggtaatattaggggaagaacacatctccaacaacacgcggcctgctcggttccgcgcgttggaacctcgggacagcctcggtcccgcgccgctgttatgcggcaccgactcgctatcccgtgggctccatcgctcccgctcaatggcatcgccgtaccgactcggtcccgcagtccagtcgtgcgggaccggctcggtcgcgcatcccggttccgcgtgactggctcgggtttcgctcccgcatccccagtctgcgatttgtcctcgctcctacgcacccgtttcgcggattgggtatagttttgcaaattaatcacagccaggtatataaacgcaaaatatgaaaaaataaactatattttcaaatttcttccataatactagtgctatcaatattgctaagaatcatgtacaatactcacgcataaagcacattgatattcactttcactctttgagggatcatgttgagaaaggatatgttcaattgacgtttttggatacaagttgcaacttgcagatattttcactaaacctttggattctaatcgctttgcttttcttcgtggagaattgggaataattcatccttttggcatgatttgagggggagtttttgtacctcatggttttattaagcaaaatttcataataagaaaaattgagaaaagagtgttttgttttatacatatagtatatttttgtgcatgctagcaatactatgaaggtttatttgtctctagcatagcttgtatgtattttagtctttttatgaggcttagatattggttttaagggagatgatgcatgacacttaaactctatacttgaattaagaaaatatgcaatattaatgttagtatatggtttgatttataaatgcttatatgtatatgctttattgattttttattcctcaaatagcttcgtaatttctcattgtacaagagaataaaatatctatgagagaaaaaaatgaataccgaatccttggaaacagtcttgatgacaaggacgtattcgatgtgggcaaaaattatggctgccgaatcctcggaaacagtctcgacgacaaggatgtacccggaataattgagagaaaaaaatatgagcaaaaaggttcaaataaaagataaaaattctcttggttgttttgtgctaaagctaatttgagaaagaatgctaaatgcaataggtatatatatatagtgtttatttttcaacctatgtgcttgtaaagatgttgcattataaatcgtatgaaatcttaaattttgattgttgaattgatcttatttgtaatatatttgattcatgattgtactttaatgcatgcttgctatattacagatgggttcatcttctttttattacaacacatgacttgatgtgctatatgtatgctaagctcttaaatattaatgaatataatttctatgcttgatgaattcattgttaaaagggggagaagagaagtttttcagaagagcatgtttttctgtttttcggacaagggagaatttctttctcttcaaaagtgagagaagttttcttttagattttgagcacgacgtgtacttttgtacgaagtgtgctttttactatttttgtttttattttttcaaacaacaaaacatttttgatgagtttgccaatgtgttcatgaagggggagattgtaaaatcaaagtattttttattcttattttgtgatgaataattggcatatgagattattggttttggagatgattgattttcaggtgatgaacagtgttgctgtttttgtcaggaccggtcaaaccgggctgtgcttgccggtcagaccggatttatgtgcatggcgcggtctgaccggccgactctgtgtcagttttggtttcaggttgtttgtttggatatccgtgattgttccatgtttatggcttctagatagatactatgcatatgtaatactgttgtttgcaaataatgagtcaagttggagatagcttggtcttggaatatggtttcttggtttgattcatgtgtaggtgacttgatgcctcgggagagtattgccggtgatggatcaggagtcgacttggggataaggcgatgtccgtgatggtcagatatcatgcgggatacttaggctacagttcaatgcacgtggttggtgaagattccatatggcatacgatggaggtattgtctgcgtatgggatgcggagtcgaatttggaaggagtccaaatttggtatgattgttgtttgtaaagtttgtttcttgtacgagaagatttcctaggtggattaggacttctagtatgagtttggttcgtgactttaggctgcctacctcatgtataaatagagagggagtgtgaggcttcccggtatcgcttttgagagcatcgaattgtgaagaagttaggatttcgagtttagtcgagattttcatgaggagtgctgttgttgcactttataaacacagagagaagtaataaagttgtgatctattttgagagtgcggcggtcagaccagcggatcaacggtgatcagaccggcagcggcgacaggaggtggcgacaggttttggtggttagaccgagtgatctataccggtcagaccgacggcttccaggcagtcagaccggcgcatctactttggtcagaccgcgatccgtcgaatttgagggtaacttttaattccgaaaaaattgggtttttgggtatagcaaccattcacccggccctctggttggcttatttcttgtgtttcgattctacacttacatggatttgtaactaaccctggcagggtgctatctttgggctattaagttgcaggtctctcaaccaattaatactagttaatcaaagtataacaatactttgctgaaagtagtagtttagccattctacggagctgcctggtacaaattgcatgatctatacatgaccccaggaaaacaaacatccccacaaacttgttaaagcaccaactgaagaaagttagattgaaagtctagttatcctttatcatcgacatcctaatgatgttgatgtagtgtcgcacagccagaagtaagccaaccaagggagtacccaaaaacaaaacttttagcgcaattaaaagttaccccataaatcgatagggatcggtctgaccggagtagccgatctaaccgctcgaagagcttcggtctgtccggtgtagtcactcgggtctgaccgcacgatgcaccgatgtaaacgtcgttgctgccggtctgaccatcggtgtcctaccggtggactgccgaacccgagcaaacacaaattaaagttctctcatagtagattgaaaatttattatttttgttcatgtttataaagtgcaacaacatcactcttcacaaaaaatctcgattaaactcaaaacctaacttcactctaaactcaactatctctaaaatcgatatcgggaggctacaccctccctttatatttataaccgaggtaggcagccaaaagctatgaaccaaacttgcacaaaagtcctaatcccctaggaaaccttcccgtacaagaagcaatatttactaactccaatgataccaaattcggactccttcgaaattcgactccgcatccaatacgcacacaatatctccatcgtatgccatatggaatcttcacgaaccatgtgcattgatttttagcctaagcatcccgcatgttatcctgatcgtccggacgtcatcttctcccaagttgactctccatccatcaccgacaacgctctcccgaagcatcaagactcacctacatatgaaccaacaaagaaaccatatccgagcacaagttatctccaacttgactcaacattaatacacaatactattacatacgcatagtatccatttggaaatcataaacatgatttaatcacggatatccaaagaaacaatccaaaatcgaaaccgagacaaaatcggatggttagaccgtcgggttggccagtctgaccgcacaacatatgccggtcttaccggcaacacctgcccatttgactagactacactgtcaacaatctctttttcgtcatctgaaagtcacacatctctaaaactgtgaagtgtttcacgttggttgtgtaagggtaaaggtcctaatatataagtgggagagcccctcacctcatttgttagcttttggggtgggaaaagccctttacgattctacaattggtatcagagtctggcttgttcaaccttcgacccgagggcaaagtgtgtgatgcccttatggaccgaccgtgtgtgcttgcggagcctgtatgcttgaggaaccatggggatacgatgaaggggcggggaatagctaaggaacaccaatgtgaagggggagattgtttaatagtcctacattggttaaggaagggtaaatgacctaatatataagtgggggagcccctcacctcgttggctaggttttggggtgggaaatgtcctttactatccttaaaaaaccacttcgtcaataatttctgaatatcaaaaccaataatttcatatgccaattattcatcacaaaataacaatcaaacattttgatgttacagctgacaatgtgggaagctcttggccatggttagaacgcaatgttgcctttcagcagccatctgacaaccattcactagttgacatacagtgtcttaagaatttgccgtcacttcttaacaccagggttacatttggtcttggcacagtactacctatgctttcctaatgcctcgtacgcccagagagaggatacattcagcctcctcccttcgtctgtaaaaaaactgtattttcagctagtcaaaggcagattaaggaggtaaaacactactatgctcttcattaatgtccaaggagaggatgtattgccgttttgatatagcccctcgtcacattccctagtttgttttcttggacggagtgggatgtagacagaggtaatgagcagtactgttggaggagatgaatgatataaagactgagaggtggaaactcctaacattcatgaatgatcaacgattcgttatttaatgtagcaacaggtgtgaatggtaactctgatcctgggaatggggatgatgatgttgatgacttgggtgatgataagaaggatgataagcaaaaggataagaagggggatgatagcgcaggtgataaaaaaaaaacccaagaaaatgcctcctggtcagagctatactggtagtgaaaagatgaaaggggcgcaatctgcacccccacctaccagaccagggaaaggttgtgttggtagtagcactatctctgctatggattgcaaaggggttgctagagtttgtgttgaatatgtgtacgtagtcggttacagtttaggacttggagttgtaataggtattaggactagagtatgagtcagactctatcctaggatctctcataaatagagaggcgtgcctgttgtaaccgcatggtgacttagcatagcgtccggccgtaagtagttgtaacactgatacgatgtatatgctggatcggggaggagcgcccataatcagtgcttccgagatgtaggctacggcggaactccgttatcaaatatcatgcctcggtgtcgtcatcgtgtttggatcgcctatggcatttctttcgcgtttggtttccgatgtgatttcggggccggttttgtaacaggggttgtaaccaaagaccaagggacaaaaaagctgagggagatctaaataaagctatagttgggtggaaaggagagagtgagttctctcaacctgagctgtttgagtctgaatctcaggagtctgattataaagagggtgaactgatgactctcatggatcttgacctcaaacatggggagatggaggtgggagcccaggcaggaaaagaacagaagtgcggtattcccactgactctgacatcgagaatatgagatcagaggaagataaacacgttagtgtgctagaaaggacaatcatcttttgtgctagaaaagaaacgttatgaacaacaaacttgcatattgatttgatagtaaggatgtgtcactagaacggataccctcatctcaattgggcggtaagccccatctcaatcaggcatggcgtccgtcacaggctagaagtcactgatgtgaagacctatctcaatcgggcaaacggtcgtcacggatgatcctatctcaatcgggccctaagtaaagcccgtcaccgatagctttgacccagacgaccagtcaaactatagcccgtcacagatgacctatctcaatcgggccacaactagcgcctgtcacagataacccttatctttgacgggcattaactatagcccgtcacagataagtcatctgtgacgggcattaattatagcccgtcacagatgagtcatctgtgatgagtattaacttatgcataagttaatgcccgtcacatatgagtgtaatccaaaaataaataaattttattttttggctagccctcactcgtgtgcacccacgcccgaaattgctccagaccaagcacacttaatgtcaaagttctttggagattggcttctagaaaagtagtagtaacatgttggtatgagtattctattaatcctattatgccctaggccaggatgtcaaattagggttattaaatgatttcaaatggaaaagtcaccagaaccaaagttgtagaactcatcgaggtgcaaaatttttattttggtcatttctccatctgactctatttaaacaattcgaaatttgaaattcgaagtttgaaaagttcaaatagaattttagaacagtgaacgacatcaactgaaaaaatcatcaacaacaaagttgtataactcatcaaaatctataacttttattttggtcatttttctatataacattttttgaaccgtttgagtttgaatttgaaaatatgacaaattcaaacaacattttcaaatactaaatgatataaactaaaaaagtcatcaacaacaaagttgaataactcatcaatatctaaaacttttattttggacatttcttcatacgacaaagtgatagtaacattgttcacaaaattgacatatctcttatctggttttataaactataacacctatatgtaaaatttgtgaataatattactaacatttcgtcggatgaagaaataacaaaaataaaagttttagatcttaatgagttattcaactttgctgttgatgactttttcaattgaaatcatttagtatttgaaaatattgtttgaagttgtcatatttttactttcaaattcaaattgttcaaaaaaaatgttatattgaaaaatgaccaaactaaaagttgtaaatattgataagttatacaactttgttgttgacattttttctatttgaaatcatttactatccgtaaaattattttgactcataaaatgaattattatactgcactaaattattttgctatagtcaacttacaaatataaacatttcatatgaaaaatggaaaagtagtcatcggtgacgggctttagttaatgtccgatagagattaagtatatagcccgtcaccgatgagtcatctgtgacgggcctaattgttatctcaaacgggcctcaagttggtgcacatcacagatgatggtcattgtgacgggccacaacttgaagcccatttgagataacattcattatctcaaacgggtctaaagttgcggcccgtcacagatgatggtctaaagttgagatatggaatgttatctcaatcgggcctaaagttgtggcccgtcactgataggtgtcatccgtgacgggcttaagttttatgctcatctaacatgtctgtgcgaccatatctcaatcgggcacttttcagcccgattaagatgacttccttgtgacggcccgctatttctaaacatattagagcccgtcacagatagaaggatctgtactagtgtgtttagtttacgtcaaaatttgaagtttgattaaaattggaatgatgtgacggaaaagttggaagtttgtgtgtaggaaagttttgatgtgatggaaaagttgaaagtttgaagaaaaagttggaaactaaagcaagcctaagtagttcaatagaacatacaaaatataagtaaaaggaatgttgtgtctctgttatatactttgtccaaagctttgtcacgatttctagagctttgtgcatccgggggtgagtaatatggccctgaacctatccctccaacaaatgataatcactaatattccataatagaataattaaaacttatcacctaaagctacatttttccaaatatattgtcaccttatgcttcactagaagataaaatcaaaatttacacctacttgctcacaactaaattaactgtaattgaaacacacttccctccccaagttccccctccagattaattgcctcatccattgagcacacttccctaccgaagcactccagattaattgcatgtttgtaatttaaacttcattccattaattttttaaacgaagaaatctacttcacaacccatgcaatcctttacgtttaaccttggtttgtgatctgtaaagaaaatataacatctaatatcaaatgacagtgaagtatcatctaatattatttaacagtgatgaatttttaatcctaaagttaaagattatgattttttaatgttgatgaaatataattaattcatgatttctaaatacaaaagtttgtaagtttgtctctttgggaatatgtatatgtaaaacatcatattcatatgagtggtgtaagcaatcacattcttgaagtcatgtcgtacggtgtatcccatataacgagctagttgctatattagggagcatgattgcttacaccacttatactagtaatatgtccgtgctaaacgctacggtgtaattatatttgcttttaataatttttaaaatttcatgttagcaaaaatttatttttatatggtctgtgctgtgcatgtgagcaaaatcaattaatgccgaacatcaaatatattaacatatttacatccaactcaccgccagtaatccaactcatatttacaatacttccagatgcaccatttaggtacaaatatagatcaaaataaaggaactatacagcacaccggcaaccatgtaacagattcttaataaaatatgcatagataagcccacctcacaattgcttattaacatgtgctctatattaaacaccatcgtaatatctaacaccatatagtttatttacatattggagtgcagaaaacactaaatatgcatccatggtgctgaaaaatattgattatacaaacaaattggaaatatgagctctgagtcttgtatgttcagaagctaggaaggaatcaatttggaagtacttgaatgttaaatgacactgaaaaatgtaccatcaacagaagaaatggcaagtacatgacatgctctttataagtggtcatgacatcaaaatagcaaaattcttaatgacagtacctatctcactaatttatctctcgatacaactggagagaaggtgacacagcttcagctccccaatcaccctatcccttgtatatgagaaacaactaaacgaatcagtatagaaaatcacaagcatctttcataacagtaaatccacatgcagagatgcgtaaattacagtgaaattcccagattaattcccatatcccgttaagctgcattgccagtggcaatgtaatataggatgtgtggcaatgtaatacagcccacctcataggatccgtggccatgtaatataggccatgacgtggattactaacagatcaaagaccttgacggctgggatattacttgtgacacaaaagagagatcatgctattttgtctaaatagcaaatatagggtaaataaatgaataaatttcagaagtgaaataaccctaccaaaggtagctaaacaacagaagaaatttctattaaacagagtctagttagcaataccaacagcaagtaacatgaacattgacggaggaaaatcatgatgtttattgctcagaaagtgatcacctgtacataaatagaattgaaaaccaccacgaacctcatgagatggtacctgccaagtcataaaaggagtggagcaagcagtgaagcatgggaataggacaaaacgtgggctgagaaaatattatctaattgtttgctcatgaaatctcagccccttctgattatgtcaagacatatcttctcattgattatgtcaaaaataataaaggtaaagagaatgttagtaaggtaatatatccactaattaatcaataggaaagttttttttttaaaaaataatcaatagatcagttggcatttttaattacagaagcactacaaaattttgctcagttttcatcttggggagacacctattataagtccctcatattgtcgaactcagccattgcccatgaatcctacactaagtttccccatcaaacaatatatgattaattacatacagaaaatgtaaatttagttgctactgactatatgcagattgatttcatttcgttcttgagtaagttctttcatgaaaaggacctgcaattagcatgaggagatgtattccgtttattagttgactatgaatacttgtacctagctacagccagccaagtcaggcactgaactgcaactgtcccctccagttgccaattctggtttagtcaacatgccatgcaagttaagcgaacagttaccaaaatgaccaaatacatactccctccgttttttaatagatgacaccgttgactttttctcacatgttttaccattcgtcttattcaaatattttatgcaaatgtataagatataaatcacacttaaagtactatgagtgataaaacaactcataacaaaataaattataattacgtaatttttctgaataagacaaatggtcaaacatgtgagaaaaagttaacggcgtcatctattaaaaacggaggtagtatttagtttctttcacatagaaacataattgttatgtaaatcaaaatgtatcttaagagcatatgagatggtatacaacagaaaaatctcttttcattaccaaagggacataaaaatcatttagttcagccagcctgatgcaaaaactcactgtttttcctttttttccacttactgtcatgttaagtcctaagggctgagtgcacgctaccaaatcctatacaggttaaagaatcaaatatccccaacctagctcgacaactcgagcattgaagtttcctggaatgatggaggtataccaaaatgaactatcatttagatagagaaaccaacaggcacatgaatcatgtatgcagattacctcgtaatgtggaagcctgtgtactcctcactcctaccggccatgagcaacggatcaggccaagacccccctcgacactgtcacattagctggtttaataaaaagcatgagattttcttcagtagttgtttgtctacaagcagacgaagacgatatggaaaatgtaaagttttgatggtaaaaaagccataatttaagaatgttcaatgaatccaaattccaaccaaccaaatctaaaactgcatggataagccttcaacttctggaattttagcatctaaaactactaaaatgtattgaaagatttttctaaccctcaagaacagtagagatacgcggacggcggtggaggcagcgacagcgacgttcggacggaggatcggcagcggcggcggcggcgcgtggacgatggaccagcagcgtgggcagcgtggggtcggtgcagacggaggttgtggcatcgtcgcggatggaggtggtggtggcgacgtcttcctagccgcggagggggcagcgtcgaggatggagggggccaagtgaggagagcgcgaggaacgggccggtctgcagcgggacgacggcgcccctcccctcccctcccatgctctgcttgcgagttgcccgactcgcaatatggggatcggagcggaggcggcgatgggggcgatggcgccggtctacagcggcctggaaggggtggcagccttgtgggatttgagcggagatcgcgggcgcgatgattagggctgcgacgcggttaagggagggagcgaggaaggtgagagggcgcgcgggttgcgggatgagggggagatcgatgtgcgtggggctgggggatgcagaggtggggagttggagatgatctgatgcgttggattttacacggatgatctaaacccttgagtgatgaatgaaataatgaaagaatgagtgaaagtatttgttgaactatagggtagattactccccccttgtttctacattgcaaaaattactggcacactgtttatatggctagttgctatctatttcgccatacagacattgaagtccctgagtcgtatgctctgttttaaaggaaaaaaattccctcagtgcttttagaattgagaccctcggccctataatgcacacgagggcagcctaacaccattcatcccatgttctgaatccagagactcttagatactccttactcctccatgctggatggcactggaaacactatagagcaggtagcatttttatctatcacaaaccttttcctcgtcttttccaagacaaaatcattcctcatcaacatcacttggcgctcctctttgtcttttattcatggttgcaagagaggtgagtgaatctcatctaactttataagatggcagtggtcttaaggtttggagtggaaagcattaggaaaaggtaggaaatagggtctgcaatccttccatatcgaagtgatgagcaggtggtaatgtagccctgagttgcagttgcatagaagggcctttgcggcaagccttgtacgggccagtgagtagagattgtgatcagcagcaccacagaatatgaaggttgcatgacatgatgcatctcctccattagctagcaataatattacttccaataatgttataaagtgtggaataaaataagatatacactcatgaattcatgattatccgaagtgtacatcaaacgatgtagctgctgttgtcttggcttgaacttaaatgatgaagaaggccggcctgaagccaattagccaaagcagctgttattgagtgctcaaatacatcctcctattcaactacatcaaccgttgaaagaaaagagactaacatatgtattttttctgcctagtattgttttaatgactctagtcaagtacaaacaacatctctattggcagtttacaaataagtacattttgcattatctgtgcaagtttatatattaacttcatcttaagaaatatgaagttaacaatgcgcctccgtggcgttcagccccagcatgagaaacgggcacattgtatgccacgtccaccacaagcggagtccaatgacgaacgcgtagcaaatgttggtcactagttcttcccactgaaaagcctgaaaaagctgggcacagcggctgggaagaggggagagagagtgtgaacgctgtcgatctgcagccaccgtcgtcgaggccgcccactccatggagggggcgcgggatggatgtcgttgagctgttcctgcagtcgagccgccgccgccgcctttgagttgatgctcctgcagtcgagcctccaccaccgccgccacccaaggccagatctggcgaccttaaggccggatttggccaggaggggcacgaagtggccgtcgtcgagccgccgccggtgttgtcgagctgtagatgggaagggagagtggcaaagttggggagggagatagcggtgaaaatggagctttgggcgctggtagccagcgtagagggggcggcacggaggaaggcccacccgacgtcgtcatcgctgtccttcgctcgggcctccccgtcacctagcgccgtcgcctccactcgacccacctctggcgccgctgccgctcgagccgggcggctgccgccctttggggtgccctgttgcccggcgtcgtcgcctccactcgacccacctccgccgccgccgccgctcgagccgggtggcctccgccgtttgcgccgctccgtcgcccgatgccgtcccctccgctcgacctgcctctagcgtcgccgccgctctagccgggcggcagccgctgtttaggccctcctcccccgtctcctggcgccatcgccaccgctccttggctacctgtgggagacgcagagagcagagagagaggggaaagaagcagataggaaagaaaggagattgaaaatactggtgggacccattataaaatagtatgcactgtgggacgcactataaaggactacgagctggatggcccatttagaagaaacaaagcactgcacggcagatcggacggcaatgaacacaaaagaggccacgttttgacgggaaaaacaataggtttattactccgtccatttcgaagacactgttgactttttaacgactgtttgtcttattaaaaaacttttgtgaaatatgtaaaattatatgcctacataaaaatatatttaatcatgagttaaatgatagaaaaagaattaataaatacttaaattttttaaataagacaaatggtcaagtatataataaaaagtcaacggcgttaaatatttcgaaacagagagagtacgatgcaacgaggtggcggggacgcatgcatggccggacgttggaaaaaggctatatgtacagatgggcggacggcggtaacgggagagcgtacgagatggcaccagcacaagaaaaaggctacatggagccagaagggagcacgccggcggaggttcagcggcgacgtcggcgtgaaggaggcgccgtcgatcacatccgacttttggaaagaaatatgtaatgtgcatagctatagataaaatagctttatacccttttaaatcaacggttcatcttatttatactggtagtagtatactacagctcttacaagaataaatataagttgtgaaaaacattataggaactatactttttatcttatttgtttaagttcaccccttcttgttatctaattaggttgtcaaacatgaccatgaagatatggcgatcaactgtctctggtgagcaatgagcaatgtagcagaagctcttcacgacatcgaggaatgttctattggacaatctgtcagcagcattataattctgaagaacaagcagggctagtttttgcatctccatgtccacttgtcggtctagctcctcagctttctgcagatctggaccctcctattttgatcattaacgaagaaaaaacttttgttagaccaccagtattaaatagcacatagaaattaattgaaaacattgtacactgggtaataaatgtgtgataacgtgtgatgctatttgttactccctccatctacttttgatagtcatattttccaaatctaaaaattttatttttgataggcatatttcaattcaacaacctatcatcttaatgactttctcggatttaatacatgactctccattctttcacacaagattggctacatgggcatcgagaaatgtaaatattaatgaatcgcttgtttacgaagaatgattagtagcatgtttaaatggatggtaagtagaattacttatccttagtctgtgtgccaagatgaaatttgactataaaaagtagatggagggagtattacttgtgcaattactctggccgcgagtctgcagcagattgaagatgtgatctgctcaagctgagaatactcgagattcagcgtatgatcgtctggatcatatctggtggagacaatctctaccgtccgaactatcagaagtgctgtattctcttcaggaagtgcattatggcatcccatgtgattcatgggtattcacctgaatacccatataatttaaaaaaaaataactatatatataggtatgttatgcatatatacatgagaaattagaaggaagtacagcatgtatatcccaaatgaaaagaagcccatttattcgcagcagaccatacattcctctccatcttggccaaacgaataggcccactggcccaaaaacgaacaaaaccctagtccctatcccccggtcagccagtccccaccccttctctcgtcccagccccaatccgccgcgcctctagtcatccccaccgacgggcgacggggcatcgagagctcgacgctcggcggcgccggccgccggctcggcgcgtcgccagaatcgccactgcggaggcggcgtggcttgcgacgacgccgccgcctcctcggggacgggcgacgctgagcagctgaggttcgcacggacggcggcggcgctgcggcgcacggtggcagccggttccggcgacgcacccccgcgtcggcgcgtccccttggtccctagacagctggatagtggactggcactggtaaaataaatcctcttgtcaaattccccaagcgattggccattgcttaattgctattgcttagaagttaaattagtcagaaatttgaactggaggtcttgaaatttgaaaaatgaagaagaagaagacaatagatttgaagtctttgtgggaaaggtcaaccaagtctcagaaagtagcttccacctctgatccaaaaccattaaccattgagagtgaagttcagatcccagaaaataccccttctagtcctattcagctactacttgaagcacccaatgcccatgatagtgatatgtccccaagtatacagttggagatagacatcttgactattgtgctactgtttgtacctttaaggctttaaacatgtcattaccactcctgtatgattttcctagtccaattttttgagttctgtatgatttttttttcaactttgaatacccttcgctcaaatcctggatccgccactggagacgctcatctgctcggtttggttcgaagatgtttgctgccgctaggaagaaggccgttaacgcgctcttgtgagtcacaccatatacctcaagatcgttctcggcataccacctgcatgcacatatatattgcaattaattattacgcactctgaatgtactctctctatcccataatataagacgcggtcaaataagacgcggtcaaataaagttgtagttgcacaatctctaaaactaatttttagcttataactagaaaggtagcccacgcacatgcacgggcacgttgctgatgccttgtttaatgttgcttaaatttttatgaataatattaacatgtgggtgattttttttggtaatatttttttattatattctaaatctgtttttgtccatgatttgtttaggattgctttgaatgttggtcatgattttcttctaactaccatatcaacatataaattctacactaaaattatttgaattcataaaatcttgagtttatgagaaaatatcgtatcgtggaaatggagttgattcacatggacctatcatttgtactatacgtgtttttaatatttagtataacttatttttggagtttctaaactttaagtaatagcttttcttgtgtactatagatatctttattgaatttaggatattttaatggaacaaacgttcaattaagatatatggtaagaggaaaattgtatccaattatgacaaatttatagttacttctactgcctcctttttttcatatgcttactatgttcttggaaaaatgaatttaaaattgaaataagagagcaattatataaataaaattagtatatgtagagtatttataaataaaattgttgatgacatttgttgaaattgggcattggtcaatagcatttttggattttgtcatcctatttggtcgtaaatatttgtcaactgataatatatataatgatatactttctactgtcatttgttatataattttcatgtatgtttggattacatgaaaagaatcaaaatgcgacctaaaatataattttattttataagttgaaatatattcaaaacagatagtaaaatataatttaatggtaaataatatgatggtctaaacttcattttcaattgtagagagaatttagttatgcatgtttgtaaaagtgatatatgataaaataatatatgtcgccatttgtttgtcatatatgatgaaaggggtcaatatacgacccaaaaaacatttatttatttattataatttaaaatatgtcagcaccagtttaatcctgtctcaactattacattatatgtatgtaaaaattgtatgcgtaattttgaatttatagttgtttagaatttattatgataaataacaaatattatctcagctactataaaaaagattaaaggaaagggaagaaaacgtgaggagggtcggttgcgtgcatgcagtatgaagatattttataagggttaatgggatccatgccactacaaatatgccattttagaaaaatatcattattattcacgatattggctacgtgccattagaatttgagaaaattagaaccatgccactccatcacgttatccgtcaaaaatctccgttagccccaactgcaagtgggacctaactgtctgtttcatcttcacctccctcccatcttttctctttcctcttcctctctctccaccattgtcgtcgaccaccactgacgctgccgccgtcatcgaccacctccgtgaaggcctccggagccactgccgtcgccgatatcatcggccctatccacggtgggaggcttggtagctgtcgccgccgctaccatctgtagtaggaggctcgggagcagccgtcctcaacgccatccacgtgggagggctcaggagcccccgccgttgttactatcctcgaccctatccacgacgggaggactcggaacatgcagccgccgccgccgccgctatcctttacgccatccgcgtgggagggctcgggagccaccaccaccgtctctgtcctcgatcgcatccacaatgggaggtcttgggtgccgtcgccgccaccatccttgacgccatctgcaatatcgtgaatagtagtggcatttttctaaaatgacatatttgtagtggcacaaaatataagtgattttggttgaatgggatatcatattactacgaatctaaatctatgtccatgcatccaacaaaaatgtcttatattttgggacgggggaatatgtattttctaattaagttcttattattttaatcttattaatttgttttatgtgttttatattgtctagtgtaaactacgtg

SEQ ID NO: 38174 - DNA, 11528 bp, Oryza sativa
gtggtccaaagcaatgtatttcttttacttgttattaatacagttaatttgggatttgaattataagttttgttataaatgatctaatagtatacatggataaaaaaaattagctatatagaaaaattttatagttattcaagaaaaattttacaacaaaaatatgtttcaatgtaataaggcatgaaaatagaaaagaggagatgcaccggccggttatgggtgtacgtatgtacagtttgcagcacacgtacatgtacaggccccatgggccttttcttttattattaaagtaaatgcaacgaaggaaaatagtgggtcctttgttaaataaaaaaaattggtgggtccaccttatttaaaagtgtcacgtgtcgaatcaagagcgtttgtaggaagacatatggcggcttaggagtgtttataggaagtttgatgcacttttaggatataatagatagatagatagatagatttctcatgtacacaaaattataaccatatgaaattaaattcaaatcttaatctaataatataatttttaacaaataaaattcattttatattatactaagtgtcagtcaaatgctttattggatggagtagtatatttgacccggtaattattacgcactttggatgtagtacatatgacccggtacttctttcgtccctaatagttgtccttttgtttagcatagattaatatttaagaagagaactctatataacacccatcattattgagtatggtttgggagtagaaggtggtttgggttaaaaagaagagaaatttgaatataatgtaattaatgagacaatagtttaaaaaattgcaaagtagatttaaactattttaggacaattttaatcctataaacacaactattttaggagggggtagtacgtagtaattctttgtttatttccattccaaattaaagtagatcagtcggatggagaggcaggaggcagctcacttgttgatgccatgccactcaagttggcagcgcctctggaaacacttgaaatcagcttttgccatgttgtgatagagatcattgttcacgagtggcagcctgcagaaaggtttaagaccgtgtacgtccagtatatatgaggatgatgacatgataaagagagagtatttcacaattgttggttaattaccgtgcttttacctgtaaagcgacttaccgatccacacatctctgccggcgccatattgctccagatacattcttgtttcaacacgtggcagacttgctttccaggggaagtctagggcgtaaccaatctacgtgtcgacattgatcaatacaatcaatcgacagacattaaattactaattttacacatagtttttggtctctataaatacgtacgtttgtcgtagtgttaattagttgtatacaacctcaatcaaacagtacctctaaagatagattcccatcgctttatgctatagtaagaaggaggcattcctcggttgcaaatgttatgtcttctgttctactgaatgtctcttttgaaagagctttagtaggttagaatttgtttaattggcataatttgagtgctttaattgttcatattcatttgacagaggataatgacgtattttgatggaatttcttcaaaatggtcaattttcagtccattatatgtatttagccttaattaataatagctacattgaaaggaataagtttttatggaaacttaaaatgtctcttaaaattaagatttttatgtggtacttgcttaaaggggtcgtgttaacaaaggacaatttagcaaggaggaattggtatggtagtttgaaatgttgtttctgcatgaaaaacgagtctattcaacatatatttgtgaaatgtcactatgcaagatttctttggagaactctacaattttcttctggtttaaatactccgcttagtatatctcatatgtttgagaattggctgatgggggttgataaaaaaaactagcaaacttatttttgttgtagcatccgctatttgttgggctatatggttgtgtagaaatgatatggtttttgacaagtcaccatctatatcttatatgcagattcttttcagagcaacataccggctccggtcttgggctcaactactaaagtgtgatgaagatataaagttagtgaagactgcatgtcgcaatcttgagtcgacgattatgcagtttttcaccaactttagatcgagattcacaaatagaatttaataattttgttaacttctcatgttgtgtgcgtttttagtagttagtgtgttcctgttttttttaagactgtttttttattctgttgaattgttgtaataattggctgtagctctctgagcaacggctggaattctattccattataaaaaaatcaaaccgtcacattccgagacaactttagtggtaaattaagaggagaaataatacgatgttcctaacagaaatctaatctagttttcacggatggatagataaaacttttcgaatcgtggacagaggataggtattctaatgaaatgttagttcaagtttttttaaaaaaaaacttttaccgtacttctgtgtataaattgtgatggtagtttcagccttcatataccatttttcgtacttttactgtatttgatatatgtgtggttatgggcaattttagatttcactgactctgccactggagcaatatatatgtatagtgtaactttaccattcaacatttggtacctcgaaatacctgatactactctctctccacctcatccatgcacacatgcatgtattttagcaagcttcaaaataatttttcttttaaattatttattcaatccatgatccgatcacaccattatattcgttttaattaaatctttacaataagatatcgcatgattatattttgttaaaagaaaaacacatgtttcaatccgttaatacttgttgtttcatacgtgacagtgacatgtttcaacgtgtatcttcaccatgtttcataaaatatttaaatgtttcagttgctgatttttttatttcaccatatataacttaatgttttacttgttggtgaactgcaatatttgatcgttcaattttttttaggcatcggacgtccgataggtagcttcctccatacactactacagaaatggatatacaagtcagcactataagtgtcgaaaatagcataactagcacctatagtattttttccacctccacaggctgaaaacacacacaaaaaaaactaacaccttcaagcgactataggtgccggttctttagaaaaaccaacacctatacaatagatgctgctttttttaaaaccggaacctctagtgtattataggtgttggttctttaaaaacctggcacccttaaaatcaggtcgagctgaactggtagcctcctgtccttagcttctccttctcctcatctctctattattacgctccaccacaccctttcctctctctcggctctcactctctctctcgtctctctctcttggcgccagcgggaggggaggagcaggcaacgtcgtgcagcagcgggggggggggggaggtgatggcagtggtgggaatggcttcggcagtggtgagaacggcttcggcagtggtgggaacggaggcaacggcagccggtgacgtcctctcctccgccagaccggcagtaggggagatggtgacagcagcgttcggtgatgggaaggagctagcaacaacgacgtgcggcagcgggatggaggtggccgcagcggcggacgacggcagcaggcagcttcgccctaccctgtgccagatctggcaggaggataggcggcgggagtgatgtgcaacagcgggaggtaggaggtggcaacggcgagcggtgccctcccctccgctagatcaggcgggagggaagctggcgggagcgacttgctatggtgggcggctcccctccaccaaatccggcgagagaggaagcagtggcgccctccgcgatgtcggtcagcccattcttaatgttttactgttccttttgttcttgagttgttgaatgttcttgtgttcttgtattttcttggattggtcgggggtgagggtacgaaggggagctgctcgatgcattggctcgtctacttttttttttatattcgtggaacctcaaagatgcgctatggtatgatcgctcatacacatgaagcgtgggtgtacgttgccgccgtcgccgccatcgtcgccactggagtgtgtcgtccatgactacgagacctcactagtgacggatgtaatgagatgatcctcaaagatgggagcactcatctgtgactgggtcattattactagcattgatggagaacattatcggtgaagcttggtagttacaaaacgttatgaatgagggaaaatttaaatttttgaatttttcaagcaacctcgtatagagatatacttcacatgaaagttgtaaatctcaacgagctgagctctgcagcgcatcaccttgttctgttcagtcaccggtgccaatcacagcaattcttcgccatatggccatatcccagtgtgtccttccatatcttgcatctgcatatatcttaattacctagaccatagctccgatttcactatccaacatccatactccacataccaagtctgttggttcaaaactaggagacattggtctaactaggagaaagctttactacacccaaaaactagctcaagagataaagaaactcttctacttttaagttggttcaatccctaatcaacaaatatgagactattcccgacataggaaagcttgcatgctgacaagaccgagcacgatggccaaccacttcgcctgtttcctgttgtgtaacaaggctttgaaatggatcatgtacttggaccttccaacatcacaaatttaacccaaccaccacacccagctgccaggctccatccatccaaaatctgcaaataacgctgcctccctcttacttaattattcatcatgtgaacgttcttatctgtgtttatgttatggatgtgtggctagctgtagataacgggactatatgatatacactcgagcagggacgaattgaacatcggtgcagggcggctcgagccacacctaccccattatattggatccccatggagaggagagaggggatgggtaagtaaagtatatgggctcgacgaggaagcagatgatgagctttcctcctaacttattctagatccacccctgcactcgattattcgggaattcagtcccaaagtgccaatgacgatcaaagtcagatatcaaaagaattaaagaaccaacagcatcagttgagaaataacagaaacatcagttgcctgttgcttacttggagagacactatagccatgcaaccggagtagacgaaaagccattgacccggtatcaatatccttcacagagctgtgccagttgtatgtcacgccttccttagtccaatgcctgttccattagatttataacattaatttgacaagtcaaaatacgtattttggtacacaatgtggtcaaatgatcacctgaaggtgtattctaagcagtactcatcaatttcagttttgaagtagtaagatatgcctagccgctccaaccggtcgactgcccatacgcgctcaaatatttcgataggatagagaaatggtactcaaaacattgaacagagaaacaaacaatactctattaacgactgtttgggtggatcataataccgtcatttggtcgattcacagaaaggttaatgctacaataatttttttcatatctggggcagtatgaattgaatgcatatctggacaaatccgattgaataatgttacggctatcaaaaatgatatccatttttttcaattctggaactgtacagaaacgaactttgcatcaaataggttctattcaactagaaattaaatgaagtctcgaatgagaatttatttataattgaaagatcattatttacctcccccatggaatttgctaacaattccatcaaggaactcgagacatttcttgtcgcccgtttgcatcaaaacataggccgttgcagcgggtgaggataggaaggatccatctgaaagttggagcttgaggagcctcttccagtccaagcctcgcagtccctctatgctaagaagcaaacttgttggtagggagtgaagtatttctcttgggatcctacgcaaatgtaacaaaattattaatgtgtgtgtgtaaattaaatacatatgaataaattggagcctttccctattagaaacaggtatgcagattacttcttaagctttagctccctttgggcatatatcttgtgcaaagcagggtcatcataagggatgtcaagagccaagtccttggctatctctaaaagtgaggggaaggtgatctcaaaaccaactggcatccatgcctcttcctcttgggccagcctccatatattttcccgaataaacgacaaacctaaaatcaaatggaacagtcttaaactctctgaaaattaagatcacaatacagttacaccgaaaacctcaaaaagcctctcatcgtaaacagattgatctgccaacactatggtacctttctcacgcttgtcaccatgaaccttccactccatcagcgcaatcacacaagctagggtgttgaggagcctatcatgaactagaaagcacaagtcatcaccccatgaaccatctggcagctgattgtgagagatccaatcaatggtcgaggggaattgtgggctgtcgctgccgttatgattcttcacaagtgcgacccacgcggtgtcataggcagaagcacttatctccccatcgcccattgtccttagcattactctgatggtattgaccatttcttccatgtcccgcggttcgtcctggataaatatgcaaatcatttctttttcttaattttctatatttttatgactatataattagaacaaacaattaatgatcaaatatatgtataggtaactatgttaatgttctaaacttcatgaaaaaaatccaagggtctatatttatttttaataatagaaaacaatataatccagcctactccatcggccaaaaaaaactcaaccaacccctcctaggataatgaatctagactagttagctctaggttaagtttttttgggacggagggagtacatcaaccaaccttcattttttataatcaagaatattaagttgagaactgaaaaaagaatcaagaaataccattaacatttgtgtacgcctgcactaatcctattacaaaacagaaaggaagtataacatagagctgtaaaggaaaaaaagatgggaaaagtagtctgtgcaacattaatatattacttttccaccgctcctcctgtcaactgtttcttgtgtttctttggctttgcaatatactattccctttgattgctctttatctacgtatatatatagagacaaaaatgttagaataccaatagtagtttagaaaattaagtaaacgaaaccactagctatattgatcggattcactatcccttggtatatcttctactgagacaaaacaagggatgagtgttgttaaagacaatgtcgtcctcgttaaaacgatttagttaattaaactccatttatatagtggtagagcatgtagtgcgaattgcatgactgcatacaccctttatgaacaaaaacaaacattaaagagccgtctcatctaatcaattttccaatgaactaaattgacttcctactacacccagaatgcctagagctaccttgaatgaatcaatgaatgaaaacatcacaaatcacagaaaccgaatcataagttttggcacgatacacaattgcgtcactcctcaagttagaattaatctactacccaattaccacttttccatacacacaaatcatttacaagcatcaaccactagtacagaaacctctatagttatcgattgggaactggctataggtgctggtttcccaaccgacacttattgatcggcgcctatacctcaatcttattagtgccggttaacaatggcacctatacttccgctggctgccaccttgcccatacgctgcactgaaggagggggaggtcccccaggagaggggaggccagcgagatccggcgactgcgccggccgccaccacacgttgtactagaggaggagaagggaaggggggaggtccccctggagagaggaggccagcttgtcaaaattactgataaaactaaatatattcagtcatcagctgcccgtgtcgccgtcggctgccgctacacgcgtcctacgtggcgctctccgccccaccagcccacctgcctgcgtggtttccccgccggccgccaccacaactcgtggtcgcaagccatggccgagccaagtcctgccgcctagtaccagccctagccgaacgagctattaggattgggctaaaacagatggcccaactgctgttggagtgagcttgtgttatgtcccatgtcgtccccatctccccaatcagcgtccttactgttcttccccgaccactcaacgttgccatgactgattttgctttgctatgagtatgggatattctttttttaaaaaaaaatcagaggataggctagagcctgatggagcctacctactagattcatccctgcttagtaggttccatgacgacccaacatcatcatttatccgctttgctacgtggcatgtccagaacggttcagacttctgcactgccaccatggattcagactccatggatccatctggagtcggtaggactgctgattcggcaacttggaacagcatgactgttgcacgatcaagatgaagtggcgcctgtgccttatagttagcgagtggcacttgtgaatcggcgggaatcttaccggggagcgggagtggggagtgcgtcaagggaggacgagttggattctcatgttagagcatagccccaatcacaatcagtccaaaacatagcaagcaccacaagaaaatacctaaaaaagtcccaaaatccagaacacctagacgaaccctagacctaaaaaacagatcaagaaatctttcgccttaaatcaagggttaatagatcaggcaagatatatctattgcataaatacaattggcaaatatcaaattatttaagtgggatctacgggatggcacattaaaaccaccggattgcaggaggaaggcggcctgtgattttcctgtgcggttcttttattttgttttctttccgtgcggcaaaaattccgaatttgctcgcgttgactgggctgaaaaccaccctaccgtggacggggatggatcgcgtggattgggccggctgcaagttagcagaggacggacgaaagtctgataatgcgtgcgcgatcacgatgagacggacgaaaaagatgtgtgacgaacaattttgctatatatttatcgataaattttctctcaaaaaattaatagatgtaaccacagtacaattatattataattatactgtaacttatatgtaattacactataatttacatgtaactttcacataattttgaaccgtttgatttgttttaatatttgtgtaagtgaagaaggaaaaaaatcactgcacgcatatatgtgagagaatttgttcccacgacctccatttcatgaaaataatatgttatggaaagatttttggaacttacgtgcaagttacatataagttacaatgtaattacatcatgattatactataattatatctgtcaaatttttaggataaaatttatcgataaatgtaaaagtgatcccattttttaattagttaagattgcggggcatcacaactgataagcatggtatgttgtcggatgcagaggggttaaattggcgacccatgtataaacatttttgatacaaactttgctatagattgaatttcagtcgttcactttgcaatcaagataaataagattggacaatggtagcggtgaagaaaataccttatacgaatctctatctctactattataaaaattaaaaatgtttctgccggtactttggtatgtcatccgtgtatggatcggtttttaaattcattcgcttttagaaatacagaaggagtcgtataagaaaactcgcatactaaccttagacgaatggactcctaactgcagctggtgatttttaaaaaatatatgtatccaagtgaattcccacagtaaatttcatcttaactaaaccatataaaaataataagattaaaatgattttcatccgttgcaacgaacgggcttctttttagtaattctaaaatcgaattcttacaaaaaaaaacataagtaaaaatccttttagaaaacgtagtgccaagccttaaaagtttgcaaggatgttttggttaccacgtggacgcggagcgtgcatacgcgtatgatgatctggtcgccggcgatcccacgccggggaccaccgccggcggtcgagcaacgccaagtgcggcggtgcatttgcacaaattagtatctgcatgggcaatatccgagaaagtccgtatggtcgtaagtttagtgagcaggatccgtcaactggagggcccgtacttaaaaaggcaatcgtccaagctactaggcaaattgatcaacccaccagtgaacgtaagagactacgagccacacgtatggcccactagcgaacgtacgacacacgtatgtcggcccactggtgaacgtacgacgcacttatgggtcttttcatcgcgacgtacataactttgactgaggactagagcgtccaacggataagttccaagagctatatatattgtcgtttgttgattactttgatatactccctctgttttagcttataaaacatttcgactttagttaaaatcaaagtgctttaagtttaactaaatttgtagaaaaaaatagtaacattttcaacctaaagacaaatttattatgaaaatatatttaattatgattcgatgaaactaatttagtattataaatattaactatatttgtctataaacatagttaaacttagaaacaatttgtctataacctgaaacacggaaggagttgattttttaagataatggaatagaacatccctacatttgctcaaaagagctacaatcacaacctaacacatgtagttcaaataaatataaaaagacaccaaacataaataagaaacaaaccaaaacaaccaatcaagataaggagtgcacatttattgaattctatttgtgacactccatttgaaattggcaaacagttatataactgttatctcaaggttacgacagtcaacttttagaaactctcgatattcatcacactatgatatagatatgctacctcggtcccaaaataagtatagccgtgggtatccatgtccaacgtttgaccgtccgtcgatggtgatgatgtcagcgacgatggcggcaggcgaggtccggcggcgacggaagggctagtgcagcgagggcaagtgtgga

SEQ ID NO: 38175 - DNA, 6487 bp, Oryza sativa
cgcggagtgtggaggagcgccggcgcgcagagtgaggagacctccggcgccgcggccgctccgccctaaccctcccaccgccgccggacctcacctgccgccatcgttgctgacatgttggatagagagagaagagatgagagagagaagaggaggggatagagagaagagagataggaaagctaacatgtgggccgaaggctatttttgacatttcacacgatttctctctccaattcaaccataaattattatattaatggttgcgatgtccaccagcaaatatcaaacttttgggagtgttttcccccaaaagtcaattcatgccatatcctgtagcaaatttgtcaaatatttaacggagtcgctaacagggctgatttaaagatcacagcagtgtcaaatttgacttagattgatttggagataacctccatcttgtgggagaatcacaaggtttacgtaacaaacttacgaatgatttacaactcaaagcgacaaaattgggagagctaaggtaaagtagaaaacatggctaaaaagtaaaaagtaaaggtaaaagaacttgattggagtgcaaactattcaattgggtatcaagaacaaaattgaccagttgaccaaggaagtaaacatgcaaactagctgatttggactcggtccgatgttcggaccggccccatatggaaggctcaaattctttccaaatatgaccaaactttgccatattttgttcttgatacccaattttattgttaacactaactttagcgcactaatctgaatagttttatttaaaatatagatgggggcagagaacaaagatgttcactcaataagaacaatcaaacacaacacatattgcatttatagttcaatcacataactgcgattgttattgtttacagtatgcgtgtgttgtaaagagacggtctaatctgttagacgttcacaccttgttattactaattttaatggtccatgactactttaagggtgtaatggggtcttggaggtatggtgttggaacaaattccaatagccccaacgagcatagcaggggctcccccatctatcagagagagccctagctttgtctccctgaggagaagatccgagaaggagagtccttgtataatggatggaatgggcgagatcctcctctcccttgcaagatggcaatgaggacccacgacccgatacccgatgggtttttaccctattaagagctaatcatgtcctaaatcttatacccatgggtctactaacgggtaaaaactcttacctattgggtccattctttacccacccgtacccactgttggtaattcttacgatcacaggaaaaatctgcaagcgcacggatataccgatgtagcacttcccccacggagtattccaagggtatcgaatcaaagggaacgtgtgtggtcagatcttcctccggttcatccaaggacaccaagcaaaggatatgacaggatggagaggatttactggtgagaaacagtgtctaggaaaagcttaagtttaatcctaacgcaatacttcaggcactggcaacccgctgtttccagatgtcgctctactacgtacccggacagcgagggcttaagtgatctcgatggctgtcaacatctctacacatatctcaaacgtactgtggaatacacaacaattattggataacaattacctaaacaccacgtctaagcaattaatatctactttagtttttataactcaccaaagcaatcactatattttagttgattatagtgaacaataatcctgtatgctatttacgaactaaccaagagataatcctcacaagataaatctaaattactcacgaagaatattatattgaaattagagtaataaacagaataaaagaaatgagagaagattaacgacaactccggaattcttccgacttcttctactctactctcttcctattatagtatataatatagtacagtaaaacatcttataattcagctcaagcttggaaatatgtgtgagtgaaggaatgaagctccttatatagaggtaggtatgacggttatccctatgtgaattgtctgaattgccccgcaaccgccatcaggagtgcattctggaccgtccctgccaaaccccaggatcaacggcgattagaggggttcggccgaacctgggctgggcccctctggcctggcttttggcccatctcctcccctggtctttttctatccatttctcagagttttgggctgattctctggtattttgatgaagtccacaacccatccctgtatggatacatattttctctcactttagtatgattttcctcccaactttggggttcattacctgcatacaaatatacaccaacatttgtggaatatgtgagattaaagttctatcactgtgttggatattttattatctgaactttatgcagatgttggcggtatagaatcggcatttaataaccgctaacacccaccgacccgtgggtgaaaaaaacccataagttgagcctaaaactatgagtaacacaagtctcaacgactactaaatcatagcataaaactcttttcacatcttaagcattgttctagtctagttatatgaaattattatttgatttattgattatgtagcgtggttctagaaatttttttactcgcctttgaatgctaatgttaacaacattgttgctagagaaaatattgatggtttacagttctaatatggctaattaaattacaaaattataaattctataagtcaattatatgggtaagagtactcgttggatacctattacccgcacaggtgtgggtatggggatgattttgcacccgcgatggatgtgggtatttaaatgggaatatttagccatcgcgggtgtgggtatggggtaagggaacccgatgggtatgcacccattgccatcttgcctttggagggctccttttattcatatgtagtaggaaattacagtattacccttaatcggttacattgaaagggtattgccttaggggtgtttttgtccattactatactagtttatacaacaccctagctatgagggtcttttccaacgatgcaccctaggcatggggttattccccaacatgtggggtgacacgggtcgtagtagggtcggtcaacccatcttgtcaaatgggtaggtccacccctgctcgaggaaacataattagagaccactcaaaaggattttccgttaggctcttcatcttatactgtcgtcatatactgtaatggttctgaactagctagcaatgcacgacatattccaacaatttttagcatgcaactttccaagtcttccgctttcagactctcaaactttagcaatacactaacagatttatcaaattctgaaagctttagaaacaggtttttttcttttactgtgatgattgttcattctacattgaattaagcatccgaggaaaataaacttatgaagataaatagagcaatgcgtaaatagacttgcgactagtctttgatatcagtcatcgctgctcaccccaagctattcaacttggactttcagttagattgtgtagttgatctcatcaacttccacatcaaagctttgttcatgatgaacatcgagattatcgatcgtcaacgtgcacattggtcctgagtagttcaagattgagttggattgaaccggttcaaagatctctagtcccttcttgagatccttcgatggtttagaggtcatgtctctttgtacccgatagccacttctctcctaatgcctcccatgccaacattgcagatatgtatgtattatgtaaacaaagtaagttcatgtttgggttaccattttgtatgtaagagatattaatagatgtgtggttcttcagatcaacatactaaaaagatgactgatatgcaactagctagaaataggtatatggctatatgccttgacagtaataaatgtgggatttcaatatttgtctagcatgtttatgttacagagattctagatgtttaagaatgagaggaaaaaataaaaaaaaggaagagaaggatggaggaggaaagagataggggactaggaagaaaaattgttgggggagctaggaagatatagtttcagcattttcttccagaacaaagaatacttgggttgtattatgtagcttgatagttaattacatctagttgggttggaaggaaggaccatgtttactgtgtaggtaactacacaagtgaacaggaaaaatgatatatacgagtataggctgatatggattaagtgtattcgtgaaaagggatgtagcctagtggttgcagtgaccttgagtagcagacaaggttctgagtccaaatgttgcagtatagtaattgtagtgcagtcaaattttttgtttaaaaaggcagcagtcaaaatttttgtttaaaaacctgcatatatccagttggatatagaggctaattatagtgcagtcaaaattatcgagcagggcactttctgttccaccctaaggctgtgttcgggagtaagggttgggctccctagcacgcaaaacggagcagcatttaacgcgtgactaattaagtattagtttttttacaaaaatagatcaatatgattttttaaacaactttcgtatagaaactttttttaaaaaaaacacatcgtttagtagtttgaaaagggctatgtggagaacgagggagaggggttggaaacttcctataccgaacgcagcctttcgttacctcctgttcccaacttctctccctcgttttccacgtgcacacttttcaaactgctaaacggtgcgttttttgtaaaaaaaaattctatacgaaagttgcttaaaaaattatattaatctatttttaaaaaaattagcaaatacttaattaatcacccgctataaaaaaattctatacgaaagttgcttaaaaaatcatattaatccatttttgaaaaaattctagcaaatacttaaaatcactcgctaatcgctgctccgttttccgtgctaggtagtgagagttcccacccctcactcccgaaagcagcctaattgtgtaaagtaatcgttcttaacaaaccagaactgtgcaacacactgcaacatttttatctgatttatcgaagtatcttccacttaatttgcagactaaaaaaataatgcaataaaaattatattatctgatttatcattattggaaacttttacaaatagatgatgtgtttatctggtacttgtgagtgcatgagacaatgagttatagtatcttcaaaggaccgtaaaaatgtggcacaatcactgccaagtgccaacaatctttctagatgccggacaagtgcagaatatatgcagcgtcattccaaccctcaaattttgatactgttatactactcccactactggaaaaagaatttttcccgatgtgcggtctttttttcatagacagacataacccttggagtcaaatgaccgcctacaaaaatataaattggggtgaagttcgttgaccacttaagcggcgcttgcgaaaataattttcgcaggcagacaatatattttcacaggcgcaccttatgtgatccgcctgcaaaaatcgtacctacccaaaaaaaataaaaaaaactttaatacttatctactcctccaacccctccccaccactcatttccccacacttatcttctcaactctctctctccctccctccactggattctcagctccccatcccctcccctcccttcccctctctccctccaccggcggcggcggcggtggcagcgcgtgcggacgaggcggcggcgacgacggagcgcgcggacgcggtggcggcagagcgcgcggacgcggcggcgacccggtgtggcggcggcggctccctggcctcccctcccagatccggctagagggtgaccgggggagggcggcggcgacgtgggcggctcctctcccctcccagatccggccggagggaggccgggggagggcggtggcggctcccagagcggcggcagcgatatgggcggctcccctcccctcccctcccagatccgaccggaggccgggggagggcggtggcggcgactcccggtgcggcggcgaggcaattttttttattttttcattggattttcgcgggcgggccattgccccgcctgcgaaaatggatgattttcaccgtcgttggtctgcaggcggttctcccctctacttgcaaaaattgcttttggcagcccgcgaaaatgctttttcagtagtgtccttcaacagacttgatgcgatcttctatacaatgattctactgcgcttcagtacatatcttcagcaaatgtacgcaatgcttgcttcgcacttgggccgatgcattatttatactagtttcatgcccgcgtgttgctgcaggattttgtggtaatgataaacaactttataaatatgtgcttataaacataatt

SEQ ID NO: 38176 - DNA, 3209 bp, Oryza sativa
cccaccggagcacttaagtgggtcatccattgatgtgtttaattacccatgacagtttgcttacttaaagcctgcatggctgttcactatgctagatcctcacacctttgatgacatacctaggacgggcatatataagtgctggtcagtgatgagggtcacctttaacgagttctacgggatgccgtcatcggtgagccatccggctatggcccgttacaggtatctagtcactagtgacgggccatatagatccagcccgtcaaagatgttatgaaaccatctttaacgggtccgagaccacccaacccaatccttatctatcacccaccgacagtctgagaccactcatctctcgtttttttctttcttccttatccatccctctctctctcttttctttctttcttcctcctccgcacgcaccgagcttgcatgctccaagcaccgggtctggcggcggcctctgactccacgcgctaatagcggccacggccggccgcttcctcctccgcctcccgaccgccggccggcactgcctaccccgaccgcctcccgaccgccggccggcactgcatacccggccgcctttcgaccgccggccaccggatctggcttacgaggcgcggatccggccaccgcgggctctccccccaccgccagccacttcctcctctgtctcccgaccgccggccggcgctgcctcccccgcttccgaccgccagccgccggatctggcctatagggcgcagatctggccaccgcggcttctccctccacccccggccgcttctcctacgcctcccgatcgcaggccggcgccgcctcccccccgccttgcggccgccggccgccggatctggcctacagggcgcgaatttggccaccgcggcctctgccccaaccgccggccacttcctcctccgcgtcctgaccgccggccgcagccacctcccccgcctaacgaccgatggcctcgacacgtttgggggacacagatccggcgcctctcccccgaccgccagtcgcctcctcctccgccaccccacctccacctgctagatccgacggcagcctcctccaccgcaccaccaaccgttggatccggcggcctctaccaccgaccgccggtgtcgtccaccgtctccttcacccgctagctccgccaccatttccaactcttgtaggttgagcaaattttcgttgccaaatttcagattgggttatactcatggttgcttgtgtggatttgtagtttattactaaatgttgtctggatttgtgatatatattacttgtgtggatgtgcttcatgtgtcaacatatctatcaataaaatgcaaagttattgtgtcatgagatcttgagatgttcttcatgtcatgagatatggcctgagggctgagagctgagagctagaggctgagggcttttgaattgtttttttggttgattttccacacctatgacggctggtaagttgaacctatcagaggtgtttgtcacctttgacgggctgaaaagatccactcgtcacaggtgagacagtctcacctgtgacgggttattttattcggtacatcagaggttccaatcatcattgacaagctttcacccgtttgagatgaggtgtagtcatcagtgaccactaatctgtgaccaaaaccaaatccgtcaaagctgagggttagagcccgtcacagatgacgggatctggcctagtggttgaaggaacaaatgcatgccagttaaacaaagaaagatgcacttgatctgacggctattggttattgatgacatggcttaacctagaggcttctttatagtgttaatgcttgtagtgggtaccaactatataggaagaatggatacacgggcgtgagaagttgtcatttggtttgtgcttctattttccttgttcttacccatacccgttatggcatggtcaaacatctccgatgacagggcattatggatccctggttcactgtgcctccccttcctagctagctgatgttctgatatgtacccttgttgtatgacgcgtccgtattgggacacggtctacaccaaagtgaagttgtatgcatctgccatgtaagttgtgagctgtctgtgcatggaccactaggagagatatgatttttaataccggttctcaacccctattaattctggttgtagcaattgagagaagaaaaccgagacaaacaagaaaatggagactaaagttgttgatttttagtaccggttgaaagaaccttttcaaccgatactaagatatatactaagtcaaaaaaatatgtaggatgtgggattccaactcacgatctcttatcattgcccttaagagcattaccatcgcacatactacacacatctgagttctctagtagtggacccttaagtaaggggtcattgtaacagtcctaattcatttaaagcccctgcagtagtggtgtggttttggcccaagtgaccgaggagtagatcgattagtcacatacttttgctagtttcatcagtcgtgtgggcatgaattctagcaaacattatcatcctgatcttttggcttatgcttatacttataagccaaaattttaatttttaaccttaaatttagagttgattttagggcttttttatcgtagtttatttgttagcctttgctttaaataactaataacatgtagataaaagtttcatttataaatcactttccgttgcaaatttgccgttttgcttattctgtcgataagcaaaacgatggagtcctaccaatatgtatatggtaacacacattccaaacaaatttctatgcatattgaggtttccgaggaaatgtttctaatttatcaaatgctaccagcctgcgagctttagatatcagactacgaaaatacgatgttttctatggttctttgggtgtgaaagtgatattatgtttgatgaaatgtagaaatgatgtaattaatggcattgctaataatcatgctaactaaaataatcgatatgcatagttcttgcacaacacaatatcatcaacacaagtacattgtacgaccctgtgccacagtattctcaaagccttctctatccgtcggtgccgatgcatgaccattttggccccatcgccttgtatttcctaggtccgcccagtcctagatcctattttttgtggcatgcatctagagcacatgtttattgat

SEQ ID NO: 38177 - DNA, 3692 bp, Oryza sativa
actatacttggagaatatgagagcatcattaaagtcaataaagggccagccaagatatgtgtaaacatcgggtaaggattctctaacataatatcattatcattacagtcactagtatatatgtgaatctcaccctttgtggtgtgtgtagtttttacctttcctacacttttcgtatcaattcctccctctttccactttcaacattttgggagttttatcatataattgaattaaattgtcttagcattttgcatttgctctcttttgggacctaaaatccccgggctatcctactaaacatatattcccaccatacggaaaaccaactcaatcttcaatcaaaatgacccatcagatttgttaaggtggtcacgttagaactcactttttagtttcagtattttcttcagaataacatcctttattaatcttggtttaggaaaccgcactactgctttggcattcttcaccagtgaaaaaactattgctcaattattgggagttgggacaatgctttatatagctgaaaagtttagttttgtgccatttttctccaaacaaaaattaatattaatatcatcacctttctatgctttaaagagctcaattttgtatattgtttaaagacttgcttctatggtcctttaatttaaccatgctttggattaaattaaaacatgatttaggagtgactgagtgctacccttttctttagataatggaaataggttacatctctagcctctgcccgtaggcacacaacaaaaaagtctagaagtgaacagaaaagagctcaaaaaaggcgagatgggacaaacccccaatttcagccgattatatgatctacaaaaataatgttttttaaaatcacgtagattcaaacaaaattctgtaggtactacaccatccaaacaggaataaaagttccttggctaccaattccaagcgtgtagcaccattgcgcatagtatcctgttgttcctgtaaaagcatcatacaccaagaggtggagccaattggaatacatgaagataacctgcatgatgttagcctttttttatgtttaaaaactatatcattacggcaacaccaaattgactaacatagagcactagctccaaataaaatcatttttttgtgggtctaggcactccccttagccagttgccaaaaatatcttttgcattgtggggagggggggtattgaaggcaaagaagacacatcgccaagcaaaacatgcaacattacagtcaaagaaaatatgttggatggtctcttgtgtattacaaaaacaacattgcttgtttcccctccattttctctttatgaggttatctttcgtcaagattacttttttgtgaagaaaccacataaaaacattgatttttagtggtacctttaccgcccataagatcgtcttgcggatccttacattaaaattgatgatcgcattaaacatggatttgaccgaaaaatagccatttttatgtagcgaccaaacaaagcaaaccttttcatttgacagggttatgttagctagtcgagaaatcaaatcattccactcaactaactttggtcctacaattgatcgtcggaatgaaacattcaacggtattgtgctcgtaacctctgccaaagtagaatgtctctttcgaaccacaatgtatagagaaggatattaatatttgacagattgcaagcccaaccatgtgtcttcccaaaatcttatgtccatcccattaccaagtttaaaagatccattttgaaaaaaatgatcttttactttcattaggccagcccaaaattgagatgttcctggtttgtgtgacatgtgggagaggggtttaccctttaagtacttgttgcgtaaaagatttttccataggccatcaccattaacaagcttgaatagccatttgctcaagaaaaatctattcatgatatcaagatttagtacacccagtccaccttgatcttttggtcggcatatataatcccattttgttaacctatatttcttttcctgcctatcactgctccagaaaaagctcgatcggtagtaatctagtctttgaagtacacctcaaggtatttcaaaaaaggataacataaacatgggaaggcttgaaagaactgagttaagaagaaccaatctccaaccataggagttatttttgcctatccatgtgctaagttttctttgaaacctatcctccacacatttccaatcagaatttctgagttttcgatagtgtatgggaattcctaagtatctgaatggaaaggaaccataattacaaccaaacagttgtctatattggtcctccatttccttagctccctcaaaacagaaaatttcgcttttatgaaagttgattttcagccccgagagatgttcaaacacacaaagaatggccttcatgttttttgcttgttaaaaatcatgttcaagaaatattattgtatcgtcggcatattggagaatggacaaaccatcatccactaagtgtggaattacccctctaatttggccatcggctttggctctttcaataagaatggctaacatatcagccactatgttaaaaagaaatggggacattggatccccttgtctcaagcctttgcatgttcggaaattttttcctacattatcattgactctgacacttacagttcctccttcaacctagttagaaatccaattgcaccacgattgtgagaaccctttcattcgtaatgtctgctgaaggaactgccatttaactttgtcataagcctttatgaagtcaattttgaatatgataccatcgatcttctttgtgtgtaactcatggacagtctcatgcaaaatcaccaccccttccatgatatttatatctggcaaaaacctcgtttgggttgggcgaattactttgtgagcaaccgttgtaatcctattggtgccaacttttgtacaaattttaaagctgacattcagtaggcaaataggcctatattgttgaatttgttttgcatcagccttttttggcagtagcacgatgatcccaaagtttaggcaataaaggggtaatgtccctttatgaaattctctgaatagagccatgagatcattcttaacgatctcccaaaagacctgataaaactctacaggaaagccatttggacctggggaggagttatgatccatttgaaaaattgcctctttgacttccttttatgaaaattcagcagtaaggatgttattttccaagtcagacacttgacgaatatcaccagtccatccctctgtcatggatacatgattatgatctggaggaccaaataaacctttataataattggttatatattctttgagattcccatcacccgttattatagtgtcctcttgttccaaccgactgctacttaagtacttatatcctaaaaatatagatgctttaatatggtatgatggacttccattcttttttacggaaaatggattaaaaatcccggcctctacatccatgattgacttccatgctttttcaatttcgattatgaggtaactagtaagaatgtctgatacttggacacataacctaactagaatctgataaaaaaaatgagttgtgcaagggagaaaggaaagaatatggagaatcacagcatggcataaccttaattaaatcagaacgtcggg

SEQ ID NO: 38178 - DNA, 21434 bp, Oryza sativa
cgattattctattgtttataatgttaatcttttgattggttttattcttctcttcagtacttgttaacttagggatattttccccagtaaactaacaataaaataacacttaacgtaccagaattatcctattttagtatatatatatatttggatgaccaggatgtacaagcattaattaagacaagataaatcacatgagtagtcaagacagaaatttcacctgagtaatattgttattctatatgattcctctatgtgtgcaatactgttgtgtgctactgttgagtcaaattgggatgttggggtagaacttatgctcgaatatgatttgttgtttcattcatgtgtaggtgtgtcttgatgcatcgggagagagttgccagtgatggatcgggcgtcaactgagaagaagatatcatctaaacggtcaaagatatcatgtgggataattagattaaagaacaatgcatatgtgtcatggttatggataaggcatatcttctacctcacaacttacggaatatatggatacaacatacctctgtatgtacgatatgtttccgtatatgataagaaaatctacaagagattataaaaataatcctcgcaggcaagtgaataacagagtcccactcggtgaggattaggattgtactatatcgtgttgggttcggtatttacgagttctacttggagataaaggtaattcacggtataaatagcgccaacatcaccaccatagcctacaatccggaggacgtgaagtctactcgctaggagatctcgtcaaaaccatctcgacaaggatctcgctggtaatctcgggatcgccggtcttctattgtaatatgtggtttttccgtatcaatctcatataaactggattagggctattaccttatgatgggcctaaatcaatataatccttgccttcctatgtgcttgatattctatcgtgtagatcatcgtaccaacgtaccccaatatcctattcatccggtctacgggtactccccgtcgacaatatggttgatggagattccatgcttcatacgatgggagattgtgtgcatatgacatgagtcatgaaggagtccaaattttggaatactgaattttgaattgggaagagataagatagtttcttgtacgggaaggcttcctagtggactagaacttcttcaacaagttagatacatagttctagagatacatagttctagactgcttacttatctcggttacaaattgagggggttggggttgcactttctaaacacagatagaaacaataaagttaaatctacttttacaaaattattttacttttatttctattttttaccttattttatcctatttctgtttggtcctatgtacacaattaacctgagaagacaacaatgcaaatgttgcagaaacggctccggatgaccaggcctagagctgactggactatacaggccagcatgcatggtgtcaccagtgcacatgccaatgggggttgctagcgcgcgtgcgcgcgccaggaaaggagctggcgcagcgtccctacgtatttcttttgttaccttttttttcaatctcctattttggtgcatttcctttttttctctttttttttctcaatctcctattttgacgccaccgtttccttttttttgttttcttttcagatatttttaattgttagcatgcatatttttgaatgttttgaattttgttatgaaaattttcaaatttaagtaaaaaaatttgaaatttagggtgaaagtttataaatttgagttaaaagttttcgaacctgagttaagttttctaatcttgacttgaatttttaaaaatgtaagttgaaagttccaaatcttcagttgaaagttttcaaatccgagttgtaagtttttaaattcaagttgaaagttttcaaattcgagttgaaagtttttaaatccgtcctgaaaattttcaaatccgagttgaaagtttctaaatcttgaattgaaagcttttaaatccaagttgaaagttttcaaaaccgagttaaaagtttttaaatccgacttgaaattttttaaatccgagttaaaagtttttaaatatgagtttaaaatttcaaaaaatcttgagttgaaagttttaaatcttgacttctatacgcgtgcagtagtcaacagaaaaaaaaagaaacgcgacacttgcaagaaaaagaaaaaaaagaacacacgtgagagcgcgtgcgctcggaagatgggccgtgtgggccggcgcgtgcgcgccaattagcttttctgcatgccaatagccttttctttcttttgtttttctttcacggtgaaacgtctagactaatccagagagcaaagccatagcacattccctaaatcattaacaaactaatccagagttgccatgtggaccaatgaaacgctggcaaaatggccggctttggattgatacatagattaatacatgaaccaatgaattatacacatctgcaccaaatatatgtgtatagctgatatccaaggttttgggtgatacgacataatattgatgatcaaggagtaaacattattatgatctcagattgtacaagacacttcatccctctctatagaacatcgcccacactttcctcatgcttcccaaatcccaagccaaaattatttgtctcttcgactaagaaacagtgagaggtgggtgggtggggggtgggggggggttctgattgagctgtttttagtatgtagccgcatcagagatgacctaagcgagaattaagacagagcaagaatgcaaactaaagttgtaattggtgatactatgtttgttttattagtgtgttattactgtctttttcttactgatagttaggattgggttcgaagatagacagtcctagaagctagcagatggaagggcaaagaggaaagggcgaggctggagagaattgaagaccataagagacgcggtacacgtgagtgaaagggatcggttgttttggccatggattgtttacatcttatagctagctacaccatctatttatgcatggccttaagatgtatccataagagatagatactcctcctaaccatggttaatcatggtcttttcttgtaaaaataaaatcattgtgtctaccgatatggtgttaccatgcattcttagtttgtgtagaggatggaagttaaatatacttttatttttaaaaggaaaagataacatctaacaattaagatcgataaccctaagtataagcattaaaaaaactaaaccaatcgttcatgatattaacatcagtcaaaagtatactaatttcagcatacttattttcctgacacaaaaacagagttaattttcaatggtgcatgtgtaatttaaattcagtatgtgactgtacagtgtatgttggtcaattatccattacgttcctgatggctaaagtgcaaccgatggtgtgaacatgaagagaacaatattacagttaatacgagagctgtgctccaatattcataagctgataacagtgaattttctggaaacccaagtgtttcaagtggagcagaatgacctgatatcctttgtgtttttgttcgatgatcacgactgccaagcatctagctatctcccaatgtcgcccaatccaaaattttcatggtaccatagtgcgcagcaacggggaattcagaggtagtgcacataaactgcaaaactcagatgaattttacctttcgatatttggatgcatggcagtcaggaacaaacatatatgaaacattttgatctcactggaggctgacactagtcattgctgataaaggtgctccaagcgtggtacataaatagtagtggtgtaggaggatacaaaaggaaaaccttacatcgagatggatggaaatgtcagtcactatgctggactaggtcatctctgacgggcccaaacccttacctttgatgggtttggtcttggtcagtgattagtggtcactgatgacaaaattacctgtgacgggtgaaacacccgtcacagataacccatctctgactggtatataagtcatctctgacgggttaaaacttgtcacccgtcacagatgagttatcagtgacgtgtcgtaactacctggccgtcactgatgactcatctctgacgggttgtaacttacgacccgtcactgatgacaaagcaagaaatacaatttttgaattttaaacgcaatgaaaaaacgtcaaaaaaatattttgaattttactagccatcctatacatcgttacacatcactacctacaaattcacaatttttcacgcaatatagcctgcatgctacatatgagatttgaactccagacctcaaccttccataaattcacaatttttcatgcaatatagcctgcatgctacatgtgagatttgaactccagacctcaacctccataaagagctcccttaccaactcacctactcagcacatattgactactcacccaatgttattattttgtctatgcttgtctgaatcatttaaatatatttaacaccctaaatgacttcaaatgaaaatattatcaactaaatagttatagatctcatcgtgttttataacttttacatagaaaatatcttcatccgatgtgtttgaactttgaagaattcaaaatttcatttttcaaaatatatctcactttataacctgtattttgaacatgtaaactttgtgaaatgaaaatattttcaattataatgttgtaaatctggttgagttctatgactttgatatggggcatgtatccatccatgtccatttgaaaaaaaactcaaaattttgtttttaaaagtagatctgatcacttgtaatgcatgttcggggatgtaaacgatctctaatagaaatgttgttagttataaagttgtggatatcatcgagagctacaacttttatatatgacatatctcaatctgaggttttttgcaaaatttaaaattttgaattttcactcatcactgacgggtcataactacaacccgtcagagataacaatatctgtgacgtgtgttagttaaagacccgtcagagatgagtggtctcttttgtgatggttcataatactacacccgtcacagataacatgtcatctatgacgagccatggttgtgacccgtcacagatcgtcacagacgatctgtgacgggttccaagtgcaagccgtcacagatgacctcacatctatgacgggtcctccctggtagccatatattgaagaggatattttttcggcccgttagagatgactcatctttgacgagatgcgttgtcccgtcacagatgacctgccactgaagcccggatctgtagtagtgagttgtggtcacggtgacaggtaatccataattgattgtccattaattagcttatcaggctgggttgcaagcttttcagtcagattttgaagacaaattaaatttaaaactgaaatatacagtttatgacaattttagaagttttgatgaaaggatgtaatgtaaatcgtaaagttcaacaatacaatgtctgccaaagcccattttgttaagaggagaaaaacctccggagccatcgttccacttattcgcggcatatttgcaaacgaaaagtaatttgtgaaaaaaatatttatatatgtgtttttagcgatctaaaagtaaaggctgaaaaataaatttcgatgtaaaaacctcaaaatcgtgaggaggggaaaactaagagaagattgagagagaagtaaaacaagttgagtcattagtacatgatcaattgagtattaattatgttaaatttgataaatggattaatatgttttttaaaacaattatcgtttagaattttttgttgcaaaaacacaccgtctaaaagttcagaaagcatgcgcataaaaacaagagaaactttttacgtgggtttgtaactattaagttacaggactctcaaccaattaatactagttaatcaaagagcaattctacggtccttgataaggtgccaaaaatttagtgtaaaatttggtaccatataggacctatataacacgaggtatcaaatttacattaaaaaagttgtacctcgtgttacctacttaaggaccataaaattgctattaatcaaattataacaatactttgctgaaagtagtagtttagccattctacagagctgcttggtacaaatcacatgatctatacatgacccaggaaaaaacaactccacaaacttgttaaagcaccaactgaagaaagttagattttttttaagcatctgtagaaagttagattcaaactccactactccactcatcctttatcatcgatatcctaatgatatgctgacaatgtaggaagctcttggccatggttagaacttagtgttgcctttcagccgtcttctcaccagcattcactagtttccatacagcgtcttaagggtttgccgtaacttcttaacaccagggttagatttgatcttggcacaggaccacctatgctttcctaatgcctcatatgcccagagagaggatacattcagcctcctcccatcgtctctaataaaaaactgcatttttagctagtcaaagacagattaaggatgttaaaacactgctatgctcttcattactgtccaaggagaggatacatattcggcctcctgccattgtgatataagatgtagacagagctaaggagcagtactgctggaggagatgaatgatataaagactgagaggtggaaactccaaacattcatgaatgatatgcgatacattaatcaatgtagcaataggtcacctcgtcatcttttaatttgctgctccacttcttgttattggaaaattctgagatggcgattctgctttgagactgcttttggctcaacagttaacagtattagctcgaataaaaagatctgcaacttttaacagtaggagtcaacctaatactacaaagtgaacagtgaagtagggatgatggtatgtgatcactatattttgtacctttggacaattgaacttgggttttaactgtaagttcaagaaaaattcttgtggtaattaaactacagctcgagagtgaaaacaacactggtatatctaggggtgaaaacggtaacggtaattccaggccgaccggcgttcgttttcgattttctacgggccgagccatatggaaatggtaatcgaccgaaataaaaatagaaatggtaaaaaatatagaaatgaaaacggaaatggttttgctgttataccgatcgtttccgtatttaccgtattcttgtggaaattaccgtttcttattaatatggtaattaccatattctaaatatgtcaatatttataagccatatctctacttgacccatagcttacagattgattgactcttcaatcaaatctctaacttttatttttgtgcatggctaaaatggagttaatttataatttatatagtataagcttgaatttatgtatgtaaagttaaatatatgtttttatagtttaatattttcgtatttgttaccggtttccgctctgtaccgacctgtttccatccgtattgttccgtttccggttttccgatattttcgatatcgttttcgttttcgactttactgttttcgatttcgtttccgagaaaaatatggttccaaaatggttgaggctgttttccgatcgtttccgaccgttttcatccctaggtatatctagtagtagagatatccctgaatccatatggaacttggctatagctagtaacaattaattatcaggctctaatgaaagaagctacaactcactggattggtaccgatcctctgccaccggcaaggaaacagcaaggtcgccattgtgcctatccaccgtccaaatagattggatggctagaaaataacgccgaattcttttcagcaacttgaaacggcaacattcttcttttccattagcacacttctcgaacggataatcggtgtgttttgtaaaaaaaaagtagatttttttaaaatttatgttagttaataggtaaataatcatgcggtgattatccacacagttttccattttacggggcttatatcttgtttcttttggagtccaaccattcttctccatcgctaggaagagaaaacaagtatagaattgctagttggcgattacgcgccattagcttaagtcgcgtgcattttttttccccaaggctccgtatgcggtccacgtactcactagcagcccatccgattggttttttcctttttcgcgtggcaatagtcttccttttcttttttccccgtcgcgaagccgtgattagatccgataatcgggagaaaattgtgatcagctgcacttctacgtaattagatccgataatcacggtacttcctttttttcacataacattgttttccttttttactaaagatttgaaacctatcaacttgaattttaaaagctttcaacttttcatctcaaatttaaaaaacttttaacctagatttgaaaactttcaacccaggtttgaaaactttcaactcaaatttaaaaattttcaactcaaaaattgaaaactttcaacttttcatctaaaatttaaaaaactttcaagccatatttaaaaactttcgacccaggtttaaaagcattcaattcaaattataaactgtcaactcaaaatttaaaaaaattcaactcaaattttaaaactttcaagtcaaaattaaaaactttaaattatacatttgtaaagagatgtgtgaaagattagaagaaaaatgggaaaggaacggcgaaaaaaagtgcgaatagagaaaattaaaaagcgccaaaagaataaaagaaaaaggcccacaggaggggtccagctagcgcacgccagtgaaattgctggcgcttacgcgcgcattagcgccccccaaacaaatatgctactaccatatccttttcatttcttcaagttcgccaatataatataataaatctctttattctacagattttttttattctacagatgattccaacttagcaagctttcatacacagctaattgcggaattgcctaggaggtgttttctggtttcctgctattttctttattaagtattttctactccagcgttcatggcttcttgccagcatgtttatctttaatatgcatgatctgatcagccttttcctgaggccttccaagccaagacaataaaatatttgttttctttcgcaagcgagttgagtaccaaaatcttcattgcacgaaagaacagagagatagaaaagagctaggagtgtcgctaaattatataaggaattgaaagtagccagtaactcttcaagagtaactgcatgacctacaaatctctagcttcattctaacttcagtaatactactgtactcttttaacagtaactatacagctacagttttgagtccaatgtgtgtgcagcaagtgcttttcttttctggggcttctatctatgatgggaacatattgtgcaaattaattagtaggtttgcatgactatagatttttttttcttgaaaatgtaaatgctatgcatttcatttcattaaagagaagagaaagtatgtacaacagagcagaaaacacaaaaataaaagggtcgccgaagtgatgggcaacaactctcataagagctaatctcctaaggccttgttcggtttagaggggattatttagaggggattaaagaggattggagaggattgaggaggaatagttccacaccacaataggagtggaataaattccctctaatccctctctcctagggattaaccgaacatagcctaagtggggatcgaccagcccaagaattcgtgaaaagctcttcctacggcatcacaccataataaattctcctttgccactgcatccaaaacaaagtagtactaggtgtgggattgttaaaggcgcagtcattccagtgctttaaaatttcccaagccactaagataatcaaagagtatagcccttccttagcatcctgagagacacctctgcatgaccagggatgaatgtagatgcagagggaggtgggtcgatcactgcgagatttcagtttctttaaagaaacgtctataaaacagaggctacagatctagaagaaatatacaagaacaataaacaaaactcatgttgctgcttttgaaacagcaatttgatcaatttgtttttaaaacttgatgcttggatctagaaattgaggctgttctgcggtgctttgaaatttaccgagctacctgcaaccagaacctcaatccgtggaagactttggtgctccaatttgagtgtccatggaagacaggagaattacactatgatcgtaaatgtttcgtttgatgttccattggaccttctggtgtagtgagattcatcgacaatatcctcatcagtgccggttggaaggcctcatcagtacaagtttcccaaccggcactacaatttgggcgctgatgtggggtgccatcaattccagtttaggcaccggcaatgataaacctgtatgagcccaaaaaaaaagtaaagaccggctcgaaaaatcagctaattgagtcgattcttcgagccggcccctctcattccacatgccaatccatatccaaaaccattccatgttcaacaataagaacactcattccccattaaagaacggatcaagaacacaacaaatattgatttaacacattcgatgaacattatatacagattgggatgaacacatatataaccaacattggctcaacatacatattaatccatcccaatggtaaccatatcaagaatcccaattatcatcgaattgtaatatccccaatcaatccccaatttcaagagtagtaatatatattcaacagatcaagaacacataatctagtacctacacaaggtttgcctcaccgcagccatcccagaggatacaccaacgccttcgtcgatctccttcgctgccatcatctcccttcagccatcaacaccacctccggctcgctttcacgttcttccgctcggcaatgccttctccttcctcactggcttccccatcgagccgctcaatctaaactgcttccctgaatcccctctatctggacggagagaggaagaggaggaaggtgttagcggcagccctgtagttcactcaaaactcacactcgatcggaggttgaagacagtgaacagtagaaacatcaggtgttctacatgagaattttttgcactgcgtagaatgtgcagcattttctggtttatcatgaacttaaatagcaatcatacatgaagactcaaaacaaacaaaaagggaaagagtggagagaactggttgttaggaaacgataagcgaacaaacgataaaaaacaatagatcaatcacagaagacacgagatttaacgtggaaaaccctcccaaaacaggagaaaaaaaaccacgggtgccagccagcaaaatatcttcactatatctggggtgaggttacatcgccgcacggcggtttacaagaggtatatatatggtggaaccctaaaagggatgacaacgggccaagcctttattaagtacaaatgaatttggatcacaactcaacaaactccaccttgagacaaattccttcttatagcatgaaacaatccttcaccctgaacacaacaaagacaaaaacactttcggcgccaaatagcctcttgggctaaaccactataccaattaagcttgagcaaagctcaaacttagcaacaggaacaggctttgtcatcatatcagcaggattatcatgagtacttattttgcataccttcagcttaccttgcgcgactacatcgcgaacataatggttcttgatatcaatgtgctttgtcctctcatgaaacatctgatctttagtgaggcatatagcactttgactgtcacaaaacaagttaatgcaagaatcaactccacaaagctcagcaaacaatcctttcaaccaaactgattatttacatgcttcagcaatagccatgtattctgcttcagtggtagactgggcaacaacaggctacaatgttgccttccaactcacagcacaactaccaatggtaaacacataacctatgagtgagcttctcttatccaaatctgcagtaaaatcagaatccacatatccaacaagccccttatcagtcctgccaaacttcaagcaagcatcagctgtgcctctgaggtacctgaaaatccactgaacagctttccagtgttctttaccaggattagccatgtatctactaaccaaactcatagcatgagataaatttggacgggagcaaaccatggcatacatcaaagaactaatagcactagaatatggaactctagacatgtattccacatcctcatcagtactagcacattgtaaagctgataatttaaaatgaggtgcaataggagtagtaacaggctttgcatcatgcatgttaaaacgctaaagaacattcttaatgtagctttgctaactaagaaatagcaaaccagaatttctgtctctagtgatttccatacctagaattttcttagcagcaccaagatccttcatatcaaactcactactcaattgtttcttcaatgtactgatttgttccttgctcttggtagcaatcagcatatcatcaacttataacagcaagtatataggtgatccattaacaaatttaatatacacacagctatcaaattcagacctcttaaagccatgtgacaacataaatgaatcaaaccttttataccattgacgaggagactgtttcaaaccatacaaagatcttttcaacttgcaaacataatcctccttaccaggcactatgaacccttctggctggtccatgtatatctcctcctcaagctctccatgtaaaaatgctgtcttcacatctaactgctcaagctcaagatcatgcatagcaacaatactgaagaatgtgcgaattgaactatgctttacaactggagagaacacatcattataatcaacaccagcaatttgactgaaaccttttgctactaaccttgccttaaacctcggaggctcgctaggagataaaccctcctttctcttgaagatccatttacaacgaacaggcttcttctgttttggcaagtgcacaagctcccatgtgccattcttctcaagagattgcatctcctcctacatagctgagatccacttctcacggtctccagagacaacagcttcaatgtatgtggctggctcaagagtattctccacctgttcagcgcaactaaaagcataataaaccatatcacatttctcaataaggcggactggagctccacaactcctctttgttctgcgatgtgcaataggttcatcttctggctgcaaaataggaggtgagtgctgaacagtatcattaacatcattactaacaatttcagtttcctgatcatccacgtgctccacctgcacgctaacatattgctgctcctcatcagaaccacctggtatgacatctgtgggcaagctgtctttaaacataacagattcattgaaaacaacactcctgctcatgaatgtcttattagtttcaggattccataacttatatccttttactcctgaaccataaccaagaaacagacacttaatagctctaggctctaattttccgttatcaacatgagcataagcagtgcatccaaaaactctcaactatgaataatcagcaggcataccagaccatacctcaatgggagttttcttattaagtgggatagaaggcgacctgttgattaagtagcaggcggtgttagtagcctctgcccaaaaacgcttgctcatgcgagcgttggacagcatacaacgagccttggagatgatggttctattcatgcgctcagccacaccattctgctgtggagtgtacgggatggtgtgatgcctaacgatgccttccttcctgcagtaatcatcaaaagcatccgaacaaaattcaccaccattgtcagtgcgaaatacttttacctccttttcagtttgcctttctatcatgactttccactctttaaaagcagcaaatgtatcatctttatgtttcaggaaataagccacacttttctggagaaatcatcaataatggtaagcatataacgagcaccaccaagagagggcttacgagaaggcccccacaaatcagcatgtacataatcaagtatacctttggtgcgatgaactgaggtattgaattttaccctcttgtgcttaccaaaaacacagtgctcacagaacttcatgttaccctgagtgcagccatccagcaggttcctcttcatcaattatgccataccaagttcactcatatgtccaagacgcatatgccacaggtgagtcttactaggttcatctttagaaacagcagcagcggtaacagaaccatgtaatgtacttcctctaaggacaaataagtttgcagaattcatatcaccaatcatataaacgagagaaccttttgatacctttacaactccacctgaaccggagtatttgtatccttctgcatcaagtgtgctaagagagatgagatttctcgccatacctggtaagtgtctcacatctttcagcatgcgtgtcatgccatcatgtgtcttgatctaaacagagccaatgcccacgatctcacgtgggttatcatctcccatgcgcacaacatctccattctgcacagacttgtaagaactaaacccatctctgttaatgcaaatatgaaacgaacatgcagtatcaagtatccattcatcatgactagcaacacaaccagcaaaaacgacgagacaatcttctgaatcagagttatcagcactggtaataacagaggccttaccatcaaatttccttttctccttgttctgcagcttccaacattcttcaatgaagtgatttttctttttgcaatacttacagaactttttacctctagacttagaacggcctctactctggctcttgtcacgatcattgctgtcgttgtaggttctctgctcagatctgcctctgacctgcaatgcttcgcccttagaggacgatgcatcagactaaaccatacctctcatcttctccctgttttggagcgcctcatagacttctgctagggttagttcatcacagcttaaaagtatggtgtcatgaaaatttgcatatgaactagacagtgagcataatagtaaaagacctaaatcttcatcatcaaactgtacctccatcgacactaggtcggcaacgatctccttgaagaccgatatgtggttcaaaacagaaccactctcctgcaacttgtgcgagaacaacttcatcttgatatgcatcttactggttagatctttagacatgcagatcgattccagtttgagccaaagttctgcagcagtcttttcctgcaacacttcttgcaaaatatcattagatagatgaagttggatcagtgacagagccttacgatctttccgcttctcctcagcggtccattcagtcgatttcttcttcccgaagcttttcagcgcctcatcaagatccgaagtttgcgccagaacagcccgcatcttgacttgccacagcgagaatcttgtcttgtagtctagcagcggtagaacatacttcatcgacgccatcgcgaaaccctaatgtgggaacaagctctgataccacttgttaggaaacgataagcgaacaaacgataaagaacaatagatcaatcacagaagacacgagatttaacatggaaaatcctcccaaaacaggagagaaaaaaccacgggcaccagccagcaaaatatcttcactatatctggggtgaggttacattgccgcatggtggcttacaaaagatatatatatggtggaaccctaaaagggatgacgatccgttttgcgggggctccgtccccgcacccccgggcgtccccacgtgcacagcccaagcctcccggcaacgggcctccgctccactacggcagaagctggcctttattaagtgcaaatgaatttggatcacaactcaacactggtgagcgttcgccatgcacgccaccactccacgaagtcctggcacacagattactcctaaagactcgctccgcccttgaacatggctagagcacaacgcccacaaggcacgcaggtaggtgtacaacagaccgacaaatgaatgctacagttagcttcataggatacaaagtgactggcacgggattatgtaaagtcgaacagaagggagggcactgtgcagcatgtgtggagagagaaattggattggaggaggccacacagaggccgagcggcggtagcggtaaggagaaggcatattggtggcggcgacaattttgggagagagacaaagagagagcgagaggaactaagaagaatcgagaagcgaagaaaaaatacagagaaagagaaagagctagacttatctgaggagttcattggttggcttatgattatacttataagacaaaatttaaatgttagaacataattttgaatttaatttttttttcatcgtagtttattttacaacatttgattttagtcgctaaggacatgaatataaaaattttattcatgaatttgataggatctattcctatgaaacgaataatgcatatacggaaaaaatagtaaggttcaattcctacaacaatcctttagaaatcctttaaaccaaatgaactcttagtaccgggtttttttattgaaccgggactggtgtggtgtcatcagcgccggtgcttgcttttacagcgcactggtggttttcctggaacgggtttagtcgaaccggtactggtaatggcagcactgatatgctgttctgcagcggcggatgcagaaggatatattcctgataactcccaagctgatgcggtcgcttcaatagaagcagaaatgagtgaatttagtgagaagtgttgtatcctaggagtttaattactatcgtgcagagaaaagacgatgcaaaggctagaagcatcagagtgtgtggcttcaccttagcctacaatgacgtggtcatgtggccatatattcggtatggatgtggatagggctggcaaacaatgcaaccatacacgttatctaaaatatgacaacatgaaactggtttcattgtcaaaggcacgttatagcacactttgaaacaatgggatattaatatatggtaaactaggtaatgcagaccagtgttatgtatattcatttaagagaaagagtgtccaaacggttccaagtaggacagccaaatccaataaaaacactggaatgcccaaataatattacaatttccatgtaaaatcgtatgatttgtacaattattttattttcatttatgataaggtttctacttcaatgacagcaatcacatgggatgattgttggggcaagcaaactttatagatgttatcggggagcatttaaaaaagcatgattggaggtatagtaacactactgcaggatagggctgtagtaacacatcattatcagtaacacaaactagtatgcgttgctacaacatgatcttgtagcacatagcaattcctattgataaaaaaacgtgttacaatcattcagctagtaacatctctttttaggacctgtaacgcaaaagcatgtgttgccatagatcctaggaacacatattttttccaccagtaacacataaacaatatatgttcacataagtggtaacatcatttttaattataataaaaaatagtaatatcagtttaagattgcccagttatcacaaatgtaaataattattaaagatctttatcaagcatcacatattaacatgtttgaattacacggaaagtaactgtatattacatccattgagaacatacaaaataactcgatctagggagttggtccattaagaggccaactaccgaacaaccatttcatatttgagtatacttgtaattcgagcctcagccctcatgtgctatacaagtccctgcagttgacaaaaaaatattgacccatagaaattaatatgtactatactccgctgcacaaaaaagcatccgctgcacattgtgttgaattaaaatgaaagtatttaaggcttgtatagccgtagttttaaaaccatggttttgttaaaatgtcacgaaggctccaatatcagagtacaatacataaaaggatccggtagcatatatatatgattggacaattggaagaaaagcttacaaattacttactagtgatttcagaaaaaaaaaagtacaagtgtttttcttggaataggaactagcagcttatttatacggtcttgtaaagtaaagaattaagatcagagcagagtatttctacacaaacgataattttagtgcaaggcattgaactagtcagaagacgtatgaacaaaattgaattaaaacattctcatgattagtacatatatacaagctgtaactacatctttgatattataatagggtttgtgtgaactaaaattttgtgtttcattatttgcttcagacattgtatgcagatattgttgtatatatgcttctttaattcccatggttgtaaaacttataagtgattactaattgctttgttcatatctcccggccgtcagaattttcatttcattatctaataaaaaaatgatgaggagacgttgcataggggtacacacttacgagttacgatgtatatttgattcccaactacctgttactagtttacaatctagcaactttggagacatctcttggcatgggcaacctgtgagcccagaaaaggagacaagtaagtgtcgagtatcgagagatgttatgataggatggggatactaacagatttagaaagtacatatttttacttaaaaatataatatgttgcataaattaaagcatataaattgcttttagtaaatctaattgatttttatgtgaacttaagcatatttattcatactatttttaatccaccttattttaaataatattgtgtcagatcatagaattatgatactacctaaaattttgtagaatcatgtgtaaataatcatacatgcaaatttaaactctccaaaccaaggagcacattgcaaggaccggctatgctaagaaatgttggtaccaaagaatttgcaaggaccggctctatgcctctatgtagattaaaataataaaaaaacagtctgtcacatctttcttggagcatgcatgaagcatatgtccgcatttatgttatttttgcctctagtgggtcccaatacttagatggactggtgctaaaccatattgtacagaagcttagtatcttaaaacttctatgtggtgagtggcaaacttttagcttcccaaccgagcagttagatttaggcatatgtttggcacggctcgagttctagccccaactctactggagttaaagtcctaccaaacagtgagttgaccctaaaagagagtaaagcgggctgaaacagtgagttgaccctaaaagagagtagagcgggttgaagtaatctggaaaaaatactgaagaggagcgcattttaggcaccctattgtgtgacactcataaattagagaaacatccatccattgattttcacttaaatcgatagacacattattttacatcgatagacacattattttacatcgttattggatctttttttttaaaaaaaaacatcccataccatattcccttcctctccatccctatgtgcattaaagtacataaacattttgctaagctgctacttgtctcacttaaattagaagaaatcctaataattctgagaaaaaaaaataaaatccaaccatcggttttttacttaaacatcaacacatttcattattttatgtcatctgatcactcttttttttaataaagaaaacatccaaaccctccctccatccccgtccccgtgcggtgtgaggcgttacttttctctgtttttcctatatttatgataattaaaattaaaattatttttgtgggcaaagaaaagaccacaaacgaatctccacctattaggtctagccaactattatttttttaagtgatatcaataacttaatgcccaaattgactatatttaaatgctaacaaaaaattacattatggacccacatgcatattgaggcctccacttaataaagacaaaattttctacatgacattaaaaaaagtgtgattagctgggagacactacaagaatgtacatctactatgatacactgcaaaaatggtaataagctgcttggatacccgtgatattattttgttatatccaaagaaaaaggagatagaaacaatcacgaaagtatgattttgccccctttctgccatgtgcggctcgcatatagctctgacgccatggacgtcactacatgggtggcggagggtaccgctgcgagaccgactgcaatagcaagtgctctacggcaccctgctcaacatgaaccaggaggtggcccacgttgtgctctccccaagtgtggtgtgtggcggagcatcggcgccggcgtggctctcgcgctgcagcggcgacgagtgcgggaacgatgcggacccatgggcctaggcgcaaaggtcctcctcaaaaccttgcccccacagagccacctcaccggctgcaggtgcggttgtggtgtcagaggggaatgtgagacagacttggtaggcaggagcaaaaatcatacttttgtaattgtttttctctccatttcgtttggatattgtaaaataatatcacagatatccaacagctaattaccaattttttcgatgtcccactcataaattagaaactacacagtttacacagtttaaagtaattttagttcacaatttatatgttgcaagtaaccagtgttcaaagtgtaggatcgaaacacaagaacaaagccaaccagaggggggtgaatggttggtatacccaaaaaccgaaaacttttagcggaaataaaagttaccctcgaattcgatagatcgcggtctgaccgaagttgtattgccggtctgactgccagatgaatgtcggttcgaccgatgtagatcgatcgatcgaaccgccgaagtcgcctgccacgcctgccgccgccaccggtcagaccgcccgtatgccgctggtctgtccgccgcgtgccgccggtctgaccaccggtatatcgccggttagaccgccgaaacccggtaaacacaaatcgaagaactcttaaagtggatgacgactttattgattctctctgtgtttacaaagtgcaccaacagcactccttacaaaaatttcgactaaactcgaaaccctaactcaaaactcaactcaattgctttcaaaagcaataccgggaagcctcacgctccccctctatttgta

SEQ ID NO: 38179 - DNA, 729 bp, Oryza sativa
  unsure (1)..(729): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctaggaattcagaatagagaattataaggttcttgagtactaagtacaataggtaactacacacgtgcagaacaaaaaaatgacatataaaggatcagcagagcgcctcatatttcccctttccattgatctcatatccttgccatgtcgtgatggacccagatggtcccctcgcgaaaaaggctagctgttggttaatcgtcgcgttacccatgagatgttgtcatagccaagcggggaaagtatcaatgtgacatcgtgttatccagccatcggacttaccgatgttttcgctccttacaatcgccatgtgctcctcgatgtaaggagcaaccaaaaaagattgttgcaaaaccgtgaaatgtgctttacggtata

SEQ ID NO: 38180 - DNA, 549 bp, Oryza sativa
agtaataacagacatggcataagaaatagaatgatctaacatgtgattctgcagtgaaagatgaagtaatatgcataaaaaaataatccttacaagcaactgattgcgaagaagctctgactttgcttcctgttataaagaaagaaaaaacataaagctttatgactgtaatagtatgccgtcaaggtagaacatttggaagaaaatataaaaggtgctcaagacctgttcgccgagggcttttcttagtttattgattagggttattctagccatgttgacactttcaagttgctcaatgcactgcttaaggactgtttcctgcccttgaaggtcagaaatcaacgatgatccttgctgaatacctatgaaataaaaaaggagtaaggtgcgcatgttttgatcaagaatcgaagtgaaaggctgaaagcattatagtgtcaaagcatcatttcttcatatctggtctccaactttgtaaatacagaaagtcagggtacaggtttccgattagagtgaaatgcatggtcggtccttaaaattgagcag

SEQ ID NO: 38181 - DNA, 31367 bp, Oryza sativa
  unsure (1)..(31367): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaacttgggtttattttgtatttatgactaccttgcagtacctttttacttgttaatgtattgtcatttcaacagctatacttttgtttgccaacaagatcaattgcttgttcaaaagttgatttttggttcagttgactttataaattgtaaatattacataaagctcaacttaatttgaaccttcccaagtatatcacataagatcagttttacagcaaacatttctcattcacttgtaatatatacattccccccccccccttaaagcagtattttgaatgaaatatgggtgttgtgattaattttggagttatgatgctttttttttttaatcttgctttcataccagggagcaaattgggacccagaaggccgtactgcattattatccttttctaactcaacaacactgggctcaattcacttctcatcaaagccaccatctttaggtatggacagctaccctcatctcaccacagcatttttatgtgaagttacagtattatgtttattgtctgaatcctgaacattgtgttgtgttcattgacttcagatgcccatctcctaccagtcgaactacctgaaatttcctctctgattgtcaggtaacaacagtggcagtacctaccattctatactcctaacttcttgtggacccgatggaacatattttactgctgtcttcaatgctaactttaactgatgatattttgaataaccacatctgcatctggttgggaagtcattcatgatatggattgtatggttttaaataaatcacttatggtatgtaacttaggatcattagcaagtaaaggcaagttctccctaatcaattgaagcgcctcaaccattttttttttcaaaatatctttagatctggcttgtaaaaagtctgtctcttgccattttagtatatactcagatgctttcatttaggatgaacctttacatgttcaaaagtctatcatttcatccattacagcctagaaaagtaacttgttgtccagtccatatacttatttatgctagctttctctggttcatctagccgaggcatagataaattagcatgggattcttcaggagagcgcttggcattatcattcaaagatggtaatgaaatgtatcatggccttgttgctgtctatgatgtgaggagatctccacttgtctcagtttcactagtgtaagtgcagtcctctaatttaccatgttatcttggtcatgaacattgaatcttgataattttggaccattgtctgacgaatttccaatgtgcatatacagtggattcataagaggacctggagatggagcaaagccacttgcatttgccttccatagcaaatttaagcaaggaccattgctttctgtggtatgagatcatcaaaagttttgagcctattagttaaatgataattatggttgctcacattgttattcaactgttcatgcagtgctggagcagtggctggtgttgtacatatcccctcatacttcgtcctcattgactccctaagaggaggtaaatctctttggctgcctgaaagtcatttactttggtggcacgatatcagcgatgtttcttaattgaatttccttttttcgtccagtaaggaaagctcgctgggtcaagagatgattggcatactattgaattatattaaaaaaaatgctactatgattgttatcctcttgtatgtaaatttctgccctatggaagcgatgctattgaatggagacaagtaggaaaaaaaactgaaatgtatttggtagcattacaaaatgtatgtactatacttatttggatggggaaatgtattggctacgcttgtgtttatgcagttccctaagcaaagacaccattgtcttactcttaccatgtgtccatttagtgcatgattacggttgtcattaatttactgcactatcgcatggtaagaaaccttcactgaaaggcttgatcagtttttattggacttacgtttgagatatcacagatatgttctgctgcattattaaatgtcaatcttatcacttgggggaacacaaggtaaacatgcaggaccatttctcatcaaccctacattttcccttctgtttgcttatccagattaactgagaatccattcaagctctgagtaaccagagttcagtgatcaaggggatagcttattgacaaggatattaattagcgttacccctaggttcaataacgtgacaaaccttaaactatgcttgcagcgtcataaacagcaggatcacaccaagtgtttctgaaattcaggcatcacatctcatgtaaacatcctgtttctctgttgaaactatgcatcattgcttcacatctctgctacgagcttgctgtattgatccagagcgaggtcaaacgaagtgaatgaaaaaggagggagcactgcttccatcacctctgcagcatttggcagctcgctttcaaccggcacgacctgcatgcgtcattcacaaagatacttgtatgttagatgaactcgccaacacctgagaatattgcgtgttagagcatctctaacagactctccaaactaaattttggcaactctatcaaaaaaaggtgcaacttctagaaatacttgtaggaaatgattccagacattgagacataaccaaataaactatttcctggaaaacttacagataaaactgaaagacagaggagagggctcggtgaaaaaaaaagacagaggagaggacatctataagactacaaaagtttatgccttatgtataacatacactacttgattaaataagtcatacggcttgcatatatattggcagactgtaaatttgtaatggtaaggttgccctctgctaaattcagtgcatggttatgaaacaagaaacttgtgatggaaacaatggttgtcttgccttgtttggttcactaaatgaattttcatccagaaagttgccggatgtgagaacagtcacagttgattttgcagtgttgacgccatcttgaagtcctcttgaagatattgtgaggttcacagcatttggcccaaagtttactatctgcagaagatcttttgaagatcaacatatgttctaaaatccaaagagatgttatccaagtatgcagtagttgaatcagttttatatcgttgtaactaaatcattcaaaacatttaggtgcttgtgtaatgaattgctgcaagggtatgcaaattaggagaaactggaatggttagtttacctttactctcagaaagatatcctcagagtcttgccaggtgattgcagaagcagccaatgaatcagaatatctggaactgatcgtaatcggatgaatcacagaaccacttgattcacggaaatatgtctgcacccaataactaggagtgccatactgctgccaggaattgaacacaattgcatctgggttccagctgatcattacattaaggtctagtcaaactcgcgtacttgtgaccaacaagaacgttggaaataaaaaggagcaaagctggaggtactaacgtgctgtcattgtcatttacgaagagtggtgcataacttgccatctgaacaacatcactgcagataaacaggacatacacttttaatttattcatgatagagtattcttgctgctcactattaatatttacaatacgtgtattattcattatcttgtaatttctgaacaacagacattttccctttgttccaaatgtgattatctgaatagggtcataaactactaattatccaagacaatactgaaatttatcctggaaaagtcatgaatgatctaaatacagctgcatgcacgattcagttagtcccaagaatatggaatgagagattatccaaagaaaggaagaagtgagagagatcacctatttttctccaacccagtaaggaaagcagcctcagccagtgaagcaagaaggcttcctttaccagcatccctttgttcattgacagcgtactcactgacaaatacctggaacaggatcatagcatagtaattaataagtactttctgtgtatccaatatcctagggcgtcgggatgcaagagaactgtaatgatacagagaaacaaagccggctgaagtgttgtgacactagaacactatcattaatggaagttacacatataatattatgacttcaatataatttctgaagaaatttaataaataaacatgccagtggccagcctcaggtagaataacatggaaaaaaaataatgtcctaaaaatattccaccaaagttaggatgataggtcaattaaagaccaacccatataggagtatttcgaggatatatctattgccagaataaatcacaaaaacaaagtccatattttggatgggccgtgatggccacggatccctgaccatccaaacaaggactgaaaaataccttaggcccaatgcgtgatgtcctgtcaaacttattcttcatgataaaaagattagcagcactggtatatacctgaaaaaatatgtcagagtgcatcttaataaaagcacaatgaaaagtctgttagaagtaatgagacagtatttaaacagtgaaaatggaatgaagattacatgaaaatcgtacaaatcagcaggatggtcaagcggcctagatgatccatcacagtttgaaatcatttgaatgtctggataggccttgcgtatagcatcataaaacttgaggtaatttcctgtaagataggattcaaaaccatcatgggcaactcggggacaagtgggatactattggctagctctctggtattttcatgaaattagtgaatgttatagtaacttcatgtgcaaagaaaatctatcctcagaaactgatgacataaatagctcaaagttacatccattctattttcatctattatttgttgcgaatgtttatatttttattatgcttatctgtaaggatgaaattgttttgccataattgtagttgactccacaaagtaacgacggcatacaaacaaagaaaaacaaggggtaaagaagaaggaaaataagtggttttagatatgcattcatatatgatgagggattttgtgttaagtacacttggccatcacaccatttcagcctatagatgtaccaacctaaggaaaacaactatggcattgacaacaaatgggatcagtagtatgtcaaattctgattaataaaaatatacctcggtaaaattccttcccacaatcttcatttccaatagcaacatacttcagtgggaaccgttcgggatgccccattgcagatctaacagagccccatgttgattctgcgcttccccttgcaaattcaagactatccaatacatcctataaatagaaaaaaaataatgaacttaaagaatgacaaatgcatagaaaacattttgttttgctacgatggcatctgcaataaggaaaagtcaaaccggagtaatcctctacccagttctatttggatgactattcttacttttggcatttaacgtaccttaacaaaaggttcaattatgatggtatcaacttcatcatggtggctgatccctaaatttcaaggtaaaattgtaagctggtaatgggcatgctagcgatgagaaaagatatggtaaaacaggaaaattttaaataattagaatgtattaccaacattgaacacccaaataggggcagcacccaggtcttcagcaagctttccatgaaaatttcggtagaaatatttggttagatatgttggtagcagaagagataaaaaaaactcagattgcattaatcaacatatacctggagaaactcataatatcctaggccatcatcggtccaataattctaaacatctccaaagtgcccaggtctctgttcccatggaccaatagtttctctccacctgaaagcatttcttaaccaatcaccttcaacaaagcaccccccctgtcataattgtgatacaaaattttgactcaatatatgtgtagaattgttcaaaagttagttgctgaaatcatggaaccatatataatgcaaatatagataaatctacaatcatgctggtttcgtactaattgaccacaactttttgatgctttactctagagtattatttcttaattatttatgcttgttagtatcccagaattggtttagaagtcctcttgcaaagcatgcataaccacaaaatagaatcacacagtaaatacaatatattatcactattaattcatattacccggcaaaaatcataaaattcttatgattgtatgcatgttcaggtttagttttagttatctaaatgttcattttggtctaattctagttaaaatatgatttttgggaacataagaaataccaggaaagcgtagaaactgtggccttaattccaaaagcatgtatattagctccttacgaaaaccatggccctgtacatatataagaaatttcccgttaacaaatgcggaaactaataagcatggtctagcaataaacaaatgaggactttttttttccaaagttttgtgaaaatgaatataagtagatttattaagtatcactaattaacaatgagattgaatcaacatgtttcctacgcatttatgaataacttataattctgctagtacattagttgcatcacaaagcagtggatgaatattcactggctactcccatagcaaagcatgctcatgactgtcagtagccaatagcaggatgaaaatgcagtgaaccttgtatgtgtctgatggcatgagtgacacttgatcaaaccaaattactccccttttcatacttgttaattcaagtcttgaagttctgcatgttccttgagccaataattgcatctctatctttgtccaatttgacggatcaatctctctgcaacatttcaatatgcaatcctttcaatcataaaagaaaaacacatcaagaattatttatttcagtgttatgtcaaagatacatactgtatagagactgatgccagattttgcattccatctgaacatgtgagagaagctgtcaactccacagattctaatgatctgatatacatgactagattataggtctttccttcttctatgttctggaagttggaacgaacaggttcatccaaaaatcagatggtaaaatcccaagcaaataaataaataaataaatatatatatatatatatatatatatcagaagataaaagtagaaatggtcggaagaaaaactataacagatattcatatttccaagtaaaaaaaacagaactattgcatagaaagacaacattatgtcagaaaaatgagcataaaatgaaatcaagcaaaatataggtaacgttagctattagtttaactttttggaaaaaagatcacaactttgctgtatttcctttaagtgacagcattgtacagtaactgttgtttagaaaaaagattatttggacaatgagttattttacatcgataaggactcataccatgccccagaatcctgggttgtaaatgccaacaccgccagctggacaattctcacagagaatctccatccttagagcgacactatttttgctgaaacaagatgagcgatcagttgtgatgtatatagaggattcatctccaatgatagaccatggatcgatgttagaaggggtgtggggccctccagattcaaatcctggagtataatccatgcattagtcagttaaagcaagacttcaatgttgatgacaaattataaaacacagatgcttttgtttcatttggttttaattcagaactgtaatcttttctgttctgtagcaacttagaagccaaaatatggaatagaaattaagcaacctgatgtcagttattaatatgaatgaggataaatatagtaaatgcatttgacaagggttgattttttttctcatgaataaacttgagcattgcaaagggctgcagttgcgaatgttgacaaggagttctatattgttcttgtaaaatagcattgtgtatcacttgcacaaaaatgtcactttacactttaatttccttcattgactattggatgtatgtgaacataagaatatttcttatacagcaaaacctgcaatgtgtctttttgacatgtgcgcagtgcaagaaactgattcactgcttgatatttggactgatttatctatttttgtgtaaataacaaatcttcaacttagtcaagtgcatccattcacttctcacagcttccatgaggaatgtttatcaaactgagagttacttctgttactgacaagctccgcccatatcccaccagctccagcatggttaatttcctataatgttcactgatctagttatcatgactgacgagcataatctagaatattcagattgcagtgaacacataatgaatataaagcaagcgctaacaaaagaaatcttcgcgcgcacacacaccccaatccctcctctttccctgactagaagtaatgcagacaaaattataacaccggcatccacacaaaatagtggtggaaaaggaaacagtggaatgagaaaacatgtacaacataggagttattttctgaaaccagaaagaagatttgcatgaagatatatgaagaaccaccatagttaatacagtgcagtgtagtgtgaacaatggtaaattcaactgaaaagactagctgcagcagttaggtaaggttgactaaattattgatctcatcctaacatattttgatgccggcagagaaagtgacgcgataagatgaactgacagagctaaataggcaaaatctgacctcaaaaaataatccaaatagtgtgtcagggatctttcgtgaaacctcccatgaagcatcaacctctactagtgctgtctgaggcaggtccagctctgaagataggcatttggaactgaaacaaaaaagaagcaaggagcagaaggtgcaaaagaatgcatctttggaacccatgccctcggtcctgcctgccgaacaacagtaggtcagtaaaaactgtaattcagaccattgctacttcgctagtagtcatatagaaatatagagtaagaaaaggagcagtaaaaagaagagtacggaatcgattgagttgttaaacagcaagaaatttaacagaaaacagtatgcatcattggattagacctactagaaaattgaaactgcagctgccgcaacagaagtccgctaccaaacactaacaaagggaactccaaagatcgtccgcagtcactactgaacccatgtaaagtttagtggaatcccacagaatctccgtcaaacaagatttttttttagaggaacaggggaagattccccatcatcatacatatattgatgaatttgatgatcagctaacaaaggtttgaaggttcataaaaagtgaaatgaagacgaatctatcatgcaatgaatcaagaacagaaggtaagcaaagtagtggccttctctcaggcatttcatcaaacatgtaaactgcacgacaacaggaacatgattaggggggctagagaaagaacttttcgacctgcggatcgaagtacgcctttgcctccaacacttggagacgagaggcaacagctacaagtgcgtgaacagaatttgtgaagcttcgatagtgttagcggagctcaggagggaatttagctgtgatgctgcttgcatccttaaataggcctgcgatgctatgaagtatgaacaagacaagtatgggcttgccggcaagctacatcacaacgtgacatctgtagcctgaattcctgacggatcttgtcatcttcgatcgagcggtggaaaggcggaacgggcaaccgctcggttgttgcttcccgggctagacatgaccgggatcgagaaaatacgaccgtatttccgtatttgtactagcacaaatcggaccaagttcgtctctttctagcttgaattattaattgtgcctagttatgtgaataaaattttttacatggatgaatttgggtggcaatgaaattattgaacgctgcaaaggacaagaggggaagaaaaagatgcaagtacgtgaccacataaacattaattatgcactcagaaatggcaaagacattcttaatgtatgcatactctatttgcctgtattaagtgcatccaacaatggcttaaccaatatctcactttttgtgtctccattttgtttgttctcttcatgtaccagctggatgatttccatgtgcgagtacattatattatttgtccccttccatacataatctgctgaattttacgaaatgacataaatgcacacattgttgtaacaaacaatataatgcaataaagaagaatgtacaagcaaatgtactaatgcatattacatcacacctgaccaaagcaataaataataaaacttaaagtggatgatgaggtgacacacttggatgctgagatttacctttgacaatgggaagaatcaagagagtgcacctccaaccagtcatggacaagctcggatcccgacttgcaggttggaaagggaagttgttgcaacaggcaggaaggaagacccctgtcacttcggtactaacctctataccaacatacttcctcacagcactaaaaccccccaaaaatttcctacatgacatggacaaaattaggaagaggttcctttgggcaggcgaccaagagattagtgggggcaaatgcaaagtaaattggccaacggtatgttcacccaccaaatttgggggactaggagtcttggatttagagaaatttgcacgagcattgagagtgtgatggctatggttcagttgggaaagcccgaacaagccttgggcagggacaccccctacttgtgatgaaatggacaaaaaagctttttgcttctccaaccaaggtgactataggtgatggtcggaaagcgagcttttgggaatcaaattggattggagaacaaccactgaaggagttagccccggccttatacaaccatgccaaaaggaaaggtagaacggtccaagaagggttagcaaatgaccaatggataatagacatcaggcacagcctcacagtcgagcttgtcaatgaattctttgaggtgttctaccatgtgtggaagacattgttcctacagaaggtgttgaggacaccataacttggagatggacgagaaatggaaagtacagtgcaaagtcagcctacatagcacagttcaatggcagaataagctcagctgcagcaaaactgatttggaagcattgggcaccttccaaatgcaaacattttgcatggctcctattacaaaataggatttggacagcggacaggctacaggtcagacaatggccaaacaactacttctgccaactatgctataggaaccttgaaaccgcccaacatcttttcaaaaattgcactttcgtgcgtcagatctgggagagggttctaagtagcctatactgccacgacatagaccacccacatgatgaaaatgaagctcggttggaatggtggattaaaagaacatctcaagttggaaaaagcaaggctaaagcactcaagtcaatccacttgttggtggcatgggaaatatggtgtgaacataacaggagggtgtttcgaagtcaagaaaaaacaatgctgcagctacttgccaaaatacaagacgaaatcaagctatggagcatgtgtggagcaaaagacatcgcgagaatatccacttaggtttttgttcaatgtgtagctctatttaggttttttttcctcgccccctctaatttctttcaccttcttggtgatattgtaaatactttctctcctccttaatataactccagcttaagctggcttcggttttcaaaaaaaaatgatttagcagttattgagcattaactttatagtaaaatatgatatgcatcatgcatgcttgtaatcatcatgtaccgacatctctaaaacaagtgaaattttacgatccttgagaagatatcttagcacctaaattttacacctttttcttatctcgagatacttagtatacataggaattagattttaactagaaaattttacactgatatctagatgtatctcgagatacttagtatctagaggtatcgaattttatctcgagatacatagtgagcgccataagtctcgtggtgtttgctgcccgagcgcaacacaatggcttgccggaggcgttcggccggtagaatggggtatccgaggcacggcaggcgctgcgacggcttagcgggaggtcacaccaggttgaagaataattctccgaaccccctccccaagttgggttcacacgatcgagccgttggatcgagaatgtgcaacgatgcggaggaaagaggggtcggaggcgtcacgaatgttacgcggggttggagaattagtttccgaaccctatcgagtccacgggaaccagttgatcatgatcgtgcggtcaataatcaagacgatagagtccagcacagatatatctcgagtatagattactgaaacttgataatttttttaaagataatgactgaaactcgagctatatatcaatcgattttctgattccacagctaattagggattgatccgccgtcacctgcatggaatgcagttcagtcagtgcgagatatctcaatctcatcgttgattcaaaccgttggctctcttgtctgcttctatatatatatgctccagacctccagcttccctgaaatgatgtgagagtagaacatgttataggaaactagcaactgtcagtctttttattaacatcaaatgaatcggaggcatatatagtatagttttacgagcttaattattgatggtacagcatataaaaaaaaatcatcaactctatgcaacggtaaggatgttttattaggcatgattaaagttaaagctagtataggttcttagttcatttagagactatcttattacaatttacaacagcagtagagatggtaaaatactactctaacaattaatacaccaaaactatttttttattatctttcttttcttttatcgattctcatgcgacaaatgttattttagaaacactaaaagtctgtcgttgtcacaagtaacaaatatatttctctgtcttctcttttttatgtaagtaaaatcatcttattaataacttcaaaacatgctaatgattgtcattgtatatgcctcagccatatttggtcagagatttacggggaatcaataattgattttacggatctactctatctaattattaactggagacgatctgttcgtttttaacaccatgcaaaacctgtccataaatagttcacacgcaaggccacaaaagtattcatccaaaaaaaccattcgacatcatcttgcagatcgatcgaggtttcacaatggtctcctcccatggcatcgtcaatgcattcttcctcttcgccgtcgccctcgtcgcggcgtctcaagctcaacacgccgccaacgctgactctttcatgtccggcgcatgcaagatcgtcgctggcagcagcagcggcgtcatcagcgtcacgttctgcatggacgcgctcggttccgacagccggagcctcagcgccagctactacagtgacctcgccatcatcgccatcgacctcctgacatccaacacgacgagcaccaaggccaagatagacaacatccttaaggacgacggcaacggcttgaaacccggcgacgccacgacggtgtgcttccagtcgtgccaggcagcatacgccagcgtgctacagggtcagcttggcatcttctacaacgtgcaggctggcaggtttccggaggcgatgtcggcgttggagaaggcagccaacatggtggaggaatgcgagaaagggttcgggaagagtaatgtcaagtcattgctcaccacagagaaccacgacagctttgagctcgccaagcttggcgctttgttactcaatgaggaacactgatatcaagagacaatgtttatatacacatagtctttttttttcttagcatatccctttgtcatgtcctttaattttgaaataaacaaggatcaaggaggttaaggccctgtatagatgggactaaaacttttaagtccctatcatatcatatgtttggacactaattataaatattaaatgtagactattaataaaacccatccataatcttggactaattcacgagatgaatcttttgagcctaattaatccatgattagcctatgtgatgctacagtaaacattctctaattatggattaattaggcttaaaaaatttgtctcgcgaattagctttcatttatataattagttttgtaagtagtctatatttaatactctaaattagtgtctaaatatagggactaaagttaagtccctggatccaaacaccacctaagttatatggatttgcaaagaaagaaagaccatacagtgaagtacatgattacgtagtatgcactcccttcgatgaggaatataagtcattttagtttttgacatggcctttgataactttgatcattaatttctttgatagtttatatcaatatattataaaattaacttcatatgaaatacgaatatagcgtcaccacatgtactatatatctacatgttttggcgtaattttaataaaaactaaaatccatgattagtctagaaaaaactactccctccgtttcaggttacaagacgttttgactttggttaaagtcaaactacttcaagtttgactaagtttatggaaaaacatagtaatatttataataccaaattagtttcattaaatcagtaattaaatatattttcatattaaatttgtcttgggttaaaaatgttattgtatttttctacgaacgtagtcaaacttgaagcagtttaactttgaccaaagtcaaaatattttataatttgaaatggaggtagtaaaatgcgcatatattatattttccagccgagggagttctaatgcggaatagagcagaaatactccagatgaattctataccataaaaaaagggggaaaaaaaggtggccaccctcaatcccccgggatttttgactatttgccatcttccccgatgccacactcccaaatgccatcttcccaaaaattctagataaattgccaccgggtccatatattagttgattctcagccatttttttcctttttatgtcaaatcagcattggatggggcgaaatccctattttgcccttacgtatagggagtgggagaaaaactctaatatttgcatcgctactttctccaggcttcgcatcgctcctcctcgtctgacttcgcgtcactccctgctctaggcgactccgctggcggtggccaaacaatgatacaatcccaagtaaaagaacagatcctttgtatttccctctttgatttggcatcaatttttttcatgatctttgcttctttttttagattgatctgtctagggtttggttttcagaaagatttgagggagccatggctccacccaattgcaagttttgttgtatgttccaagctgtgtttgcttgtgaaattgttgtgcattgaagttggtttcattttatttgctgtgagctgtgttaaatttgtactgaacgggtaggggtatcattgtcattttcttaaagtgtcatgaggtggctgctgatgtggcatcaagaatggaccaaaatggtaggaaatcaactaatgtgggggaccaatggcaattcagctacaattttttggaagatggcatttgggagcgtggcattggaaagatgtcaaatagtaaaaaaaaaaaaatccccaatccccctgcctatcgcgtttccccacccccgatccgccgctcccctcgccctcctccgcgccgcgaccgatctccacctcgacggccgcctgcgcgccgccaccgagtcctccgcggctgccaccacctcctgaatccggcctcccaccaccccatcgcacggtggcctccgtcgtcgacagtttgtctcctttctccccttcatcaccgagggacatctccatctaggaaaaaaaggtaacaaaaattcgtttatggcatttgattgctggacatccctcatatagaaattcgtttgagaggtttcttgtgatattgccttgttgatattaggtatgaccattacgattgaatttaacacctttctgtctgaacgaactagagaatgaacattttgcctgtgaaattacaagattttgtatgttttccttgccccacgacaagctgatatgatgccaaatgtacaatataatttgttgctcaaagcatagttcgatcctttatttttatgtttattatgttgagcatttgcttgtttaggtttttagcctcagagttgaagagttactattaagactgaacccataatcttgtatgactccattgtacagccggcttgtagtctaagcaccgtcatcggaaaaactaaaagtaatctaagcactgtaaattgacaatattcgtcaaatctcagaggctgctatctgtgtttttttttcttttctttccttttttttttttgccaaaattaagcctagaacactgtactgttagcccaggggtagcaaaatcttggactctcacattatagcagatgcgcccttgaaccatactaacttctgtgtctttgtgatcttccatggtcgagtaataaaaactgtacaactccatcttttttaggaatactcactcatcggttctagtcccaaagattaggctcctgaattttagatggatttattgtgcctgcaaaaagtttggtttcttgcaagtcagccactggtactatgatcctattactgtttttctcttctatcacattctgccctgctacttgcaaaaaagaaacaaaaaaaaagagggggggaaggggtcagaaggtccttacctggagaattataagttattgtagggttttccttttttttatgttaattaaatgatattttgctgctcgatgtttataaacttgtgaagttcacagggctggccctgaggcaggtcagtaaggacgaccgatctggacccccattagttaggggctccaagcccatagatggtacctctatatgcatgataataaaggtccaatcgggccaacagtatggctaccgaaggaaatcaggatcaagggagaggacacgtcactccagtctccagacgtgctctcgtcctcgcctgttcctcttctatttcccccagacctcctcgttccttcaatcctttcctgagacaagcgttggtgttgccacccctgtctcttctgatttctttctgtgatttgtttaccactcggaccagttttgctgacttgcctgtaattcgttttccctcttctatagatctggttcagagctaggagacatataaaggctcagattggtgattcttactaacagtaggctgctggtatgattttcttggctataatgtaggagtatacagaactaagatacagttttggaaaggttctaaagactagtatattttgaggtgttttttcagatataaaaatctgaggtattcatgttttgttagtactatttcagattctaactaatttgcacatcaaggtactaatgtactccatattttgttagtacttgtgttcggaggtcagggtagatgtgtcttgtttagcccatattttctgattgttatcctgtagaatagattgctcattttagccttagttcgtgcagatgattgtagatgatcaaagcttttaatacgcatcttgttgcataaggttttatttgatatatgcaacaacctagagaaaaaatctgtctggtatgccatcctgttcttgtctttgattctgttctttgagttggcttcaaattacatgtcgcattacagaaaattttttcttatattttgctaatcattctataaaaactattagttcttttctgagaatgattcacatgaaatttgtgatgcccatgtcacatgcagtccattaaggcccttggcatggcacatgcgacggcaaccacaaccttagttttgtttgtcatatcatctctgttactgtttggtgcaccttattttttcaaagcttgtaattttttattatcattagcagcaactgtggatttcaacttttctttgtcaattgaactcttagatcttactgtgtattaccatgtcattttctacatgtattttacagtatgtgtttcaaatgcagacactgcactatggcgtctagacgcaatgttcgggggtatgctccccttcctacagaggacagggatgacagcaatcttactgatgatgttgaccttcggttcacttacaccccaaaatccctcaggaaaatcccgtggaagtcaattgccctggcactattcctcctcctcctaggatgttcgcttctcttcctgtcatattttatattcacaggtcacatggagggggataactctcaggcatatggtctcttgttcctgggcatccttgccttccttcctggtatgttaatgttcttaccttacattttcacgttattatggaaattttttcatcttctcaatgaaaaattttccccaattatttattgatcattttccatgactttgttcaaaagtatttattttagtgtagtttgttggaaatgttgctacatttttttataaacttggtcaaatttgaagaagtttgacttaggacaaacccaaaacgccttataatatggaacggagggagtgtcatactggaaacagaatctctttggatatgaaatctatttaaatgtgcattagtgtaaaattatgtcctttgttattattgtagatagtagacagacatctctactattgtatccatttagcgagaaggattatattgttctgacattgttttgtaggtttttatgagactcgagttgcttactattcctcgagaggagcaccagggtatacctttgcatctattccagattattaaccttccattgttttcatttgtctcaccaagggacagtggcgatagaacatgggcaaaaacttcaggatgcaggaatcaaaatgagctctttattttattaccactaaaatgttaacatctaaatgaagtcagctgctgacttctgtgttcacccgatggcattgctcaccaggtgtcacttatctgtgctgtacagacaaagtaaactcgtgatcatactcgtctcttgctacatactccagatgtagatggctgtttgtcaccaggagtagatggctgttttaaagttgccgcatatttttattccacaattccattgtattttgtgttggtatcattaaggtttttattttggctgcagaaatagtataaccatactttcatctatatattcaagctcttatagcagctgatggcaatgtgtatcattttgtactgcttttctctatgatgatatttgtatggataaattccttctgtgctactggaaggaaatcaattcctttgcacatttcgttgagagaatagttaccgctccctctattggtcagaccgtgctcatcatgactggtcagactgcgccctacctcggccagatcatgcctcttgtggccggtctaaccatctcactaactgtcggtcagaccaagtaccaggctggttagatcgggctacctatagccgtcggtcagaccaagtacctggctggttagatcgggctacctatagccggtcagaccaacaccctggagccttttcctgattttgtatgccacaactaatggtaccgatgttaattgttatttgattttgtatgccacaactaatggtaccgatgttaattgttatttgccacctataatactgttggtcatgttattccatatacacatggtatttgcaccgataattgctataagctaaaccaaaatcatcaagaagatggattggctcaagacgcgtagattactttcaaaactctgttgcgcctttacattttaggccataaatataagaggatgatcaattaagccctaaaggctagtaataattcaatgtcatataataaatgttgatacttgtttgtgatcgttgcgaaactttgtaaagcttgactgcatgcacgcattagtcaattttataaagatgtgcattaaggggacataaatgtttaacaattagccgggtcctataaccttatttcttaaaaaaaagaactatttagactccattaatatgtcaaccattgtattacaataaggaccaatgtttacttgtataagtatagagttcgtaattaatgcaatcaaattcagctagtaaattaatttcgaatggaagttaccacaaccagattaaaatagggctttttaatttttttttacttacatattgtagtgtgattttgaaacaatttcataatttttgcatcacatagcaatttgaaacagcaagatataatcgtctttttgtttcatttcatccatcatattgaattgggacaattttattcttgctgctactttgattccgatattgtttttccctattttttggttttcattatttcttttcaaatattttttatagaagttagtgggtccaggattgctaaactaaaaagtaacaaaacaagaaataatattatttcaacttaacagttaacctttctacccgtggagattttgccatatgcaaacaatacccttgagtcattttcctatcccaaatccaaattcatgcccccaaacctaaggcaatagcagctcagccaggcggcgaagaggaggtgatgacagcggcagttccgtgtaggaaggaggcccagccaggcagctgctccttgtagggaggaggcgacagtggtggcccaaccaggcaatggcagtggcagctcctcacagggaggaggaatcggtgatagcctggctaggcggcggcggctccttgtagggaggggtgacggtggtgacgactctgcataaggaggagtcagtggcctagctagagttcaacgcaggaagacggcaggtcagtgcgatgagatggcggcggcttggtgtggggaggtgatggcgagtagggcaagcgacggcgattcggcgcggggtggctgctatgagtaggcgatgcaatagcgactcagcgcagggagtgtaggatcaagcaggccgactagaggggggtgaataggcggttttaaaatttaatggcacttaaacaaaactaacctaagttgctaggcaaggtaaggtacaaggttaactaagcaactaagttaagttttgcaaacctatgtgttataggctcaaatatgtctctatgaatgtaaatagcacaaatgtaaatacaacaaataaatgagacaagagacaagaaatttttcaccgaggttcggaaactcgccggtttcctaatccccgttgaggcgagcccaactccaccgctcaatcacgaagccaccgcacgcccccttcgtcaaggggtgggcaaggcgggagccgacccacggagaggactatccaagcctcgatcactcggggtagttcttccttcactccgaaggtggtgaactccaaaccactcacaaacggtgccgggcctcctccacaatcttctcggagaggtcaccgggcaacacctatacaagccgtctaggaggcggcaacctccaagagtaacaagtctaggatgcttgccgaggatgatcaagtgccacactagctaaaacaatgaagcaatgcacttggattggcttaactcactctctaacacctcactagataaactaagtgcacaagggtgtgagagctcttgcaagggttcaagataatgcaatggagtgccaaaaccttaccctttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaataagataaacggcgcagacgactccactccacaggcagcttgaccagggctacacctaatcatccacaccatcagcatcactgtagaactcctcctctgatgaatgattgcaaggtgagtatatgacatactcagcaagccacgtagcaaatatgcaagtgcacaggataacaaaggatggcatagtagggtttcatttgcataaacagcatttaataaacatttcagaatttaataaaatagttaagtagtaatttaaacaatattaatccaacgctatacaacataccctgttgcataggcccaaccattctgtacaaccaatcctggctgcacagttctatctccaaaccaggaatataccattccaaaccaggagctaatcaaattattaccagttatagcatcttttattatggtgagaagtgtgagactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagcgcacctttcctggatcataatcacccccttataaacaaggcatagactccccagcgacccccatgggcttatctccgccacttctcagtctggtgctccgcaatgaaccatgctatacaaaaggtaaagccgttgcccacgctggcttgtggttggcacggttaatgtttcacaaccgaaactcgtgaaccggtcctaaattgtcatgagcacgactctcaaaaccatgtgctcacaacccaccattatcaagttttagttggcaatttaattaattaaccaatcatgattaaccatcatgagctatcattaaatatccatcattaagtaatagtgaaacattagttatcccaattgtgtgctaatatttctaagcatggctaagcaatcatatctaatatctagctgaaccaatatataaagctcaactagtcaagttataataatccaaggtatcaaggaataaagtaatcaagaacaaaaggactataacaaacaataggttaattccacccaatggcattcgaaaataaatgcaatagttgaatagaaacaatagctttaaacgggataaacatgttcaaagggttgtttgggatctgtgtgacttgccttgctgcccttggaactcttcaaattcttctccagcgaaaacgaactctccggaaacgtcagaatctaaacagaaaagagcaaaaacaccaaaacagcacataaacaagcatgaacagtacatgtggatatttttaacatgtagatctcaattttaaaaaaatttagagacttgaaccaactaaatccgagctaagatgaattagttatgaatttttagagattaaatcggattaaaacacttatatgggttttaattgaattatgacgcaataatgaattatttttgaaaaggaaaaaggggtttattgcgtcagcggctagggtttgcggtggaccgggtgcactgcgactgctcacggaaacgaacggccgagatcgatcctaaccaaaacgaacggccgagatcaaccggtccacggccggaccacgacggacggcaacgatgacgtcagcggtgacgtcaccaccggcagcggctcgggcgcacaagctcgccggcgaacgacggcgcgacgacgcgaacggagggcaccagcacgtagagaatgacgcggcgaactcaccggtgaccaaaacggcggcggaagatcaacggacggcgacggcgtcgaggagaagcggcggcaaccttcggcttgacgacgacggcggtgctccgacggtctacagcaacgatggaggggcggacgaggacggcaacgcgacggcgaccacgacggcggccttcccgagcgacggcgacgactggagcgacggcggcgcacggctggagcggcggcgacgacggcggcgcgaggctacacggtgctagggttctaccggcgacgagagacgaaggcgagggtggcggcaggtagcggcgggcttgggggtccttttataggggcaaggaggcggcggcgaaggcccacggcgaccggcgacggcgaaggaaggtctagggttcggggagagagacgaatccgattcgagatcgaatccacagatttccaaacgattttagccgacgattccaaaagagaaaaggtagaggagatcccgaagatcatttcccctctattgatttcaccggaaaaggaaaggggcggccgaatttggaaagagacgacggcggcgcggcgctagggttcgggcggcggccggccggaggtagacgacaggcctgataggtgggccccacttgtcagcggcagcgagcgcacgtgggcggctcggcttgactgggccggcttgggccgaggaggagagagagagggttttgggccgactttcggcccaaagccaaaagaagacttttaaaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaactagatcttctcttctaggcttttaaaataaattctaataattccaattaaacaacaatttatatatttaggatttttagggtgtgacacccttgctgctggggagtgggtatatatacccctaaccaccaaaactaaccgttggaaccgaaatccccaactttgtgctctgtcggtcagaccgccgttgtgaggccggtcagaccggactactttgtaatggctagaaaactagccgttacagggcaatcattgagcccactcaacctggccggtctgaccgcagtgtagtggccggtcagaccgtccacggctcggtcagaccgccgtcggctcggtctgaccggttgcagctctagcggctctgtatcgccaccaaaaaccagaccagtgcaacagaccagtggggctggtcagaccggccttaccacgtcggtcagacctgctaacaggcccggtcagaccggcctaaggcccacggtcatatcgcatgtcacttttcagctcaaccgaacgttagtaaaacgacgatatctcttgactcgggtctcggaatttggcgttcttggactttatggaaagcttattcaaagggctatccaacccatgaacaatccatccaagaaacacaacttttctcagggagaaagggctcacactctaaaggatactccaccggacataaccacatgaggctgcccaaacctataggatttgcccacatctctctttgtttaggacttgaaaaaactcaccacacttggctagacaagcccaccaaatacacctacatgcatatgaactaatatggcacaagatcatccacaagctcgcttcatagacccctcttgatagtacggcgcctatctagcaaatccggtctacaccaaacactaagaccgggaaaagactaagaaaacattcttagctacattatacctttgccttgcgccatccatcttggggtcaagcttgagtcgagatcaacacttgtgaccatttgattcaaccatgtttataccaaggtatttaccatcatttgtcaagactttcttctcatcacaagcttgatttcattcttgccaacatggcgatgtccttggcttggtgaccattaacccatggtgtcatccattagcctcatcatagtgggacctattccttttcacatctcaaaggagaacattagtcttaacaaatcggttgtcatccttcacttgatgaccaaccggttgcatatgaaagatatggatatgtttgttgagtattcattaacatcacaagtgtcatatactcgtatgcaagctcaagtgcaaagatccgatataaataataggtgaacaacatggatctaaaacatgcacaataaatgtataggatttgctccccctaagtatatgcatacaaagaaatatacaagagagacaagtgtatgcataagtaaagaagaaccaatgggggtttatcctatacacatagagaaggcatatgtagtaatgatgaagataaacaaaaaaacacatatcttcatgatctccatgttctcaatgtaaaggagactaaataagataagactcaagtaaacattagtctcacacttatataacaataacatggaaatcatatatatgaacctatcaaaaagtaggagataagaagtgatacatatcgctttatctccatgaatttcattcttgtcatgattaaggtccatcaccaaagaatgcatatctaccacatctcattatcgggaaataaccttgttgaaaacttatgtaaaagagaggttaatcccataaacatcggtttatcatctatcaccaaagtaacaattacacaaattgtttaatccaagatctttcaatcttttctctcttctgtgatagataataatccgatataaacaatacaaagagatgagatgaaagataatttcaaatcaaggtagagatcttataatgaacaaaatatagaataagctccccctcaagatgtgcatacatatggatatgaaggaatgcatatgcacataatcaatcaagatcaatgagggagctcacactatattttggatccacaagagagaccaagttagaatatgtgaagtttaatacatacctcccatcatttttacttttatatccaaataatactagtcaaagaaagactcataaaaacgttagtctcatataattagatttgtcattaatcaccgaaaccaaattaaggcacttgaacttacagggaggcggtgagggctcggtgcgtaaaggtggtcataactgtgtaaaaaaaattgtgcccaaatttttagtagcgtaaaattgtgcccaaaattatcaaatgtggcaaaagaatgtaagttttgaaacattttttttgttgaaattgtagtttttcaaaattgcaagttgcatgtataaaatatgggcaataataaggtatgaatgtctttttgccaaaatttaacatcgttaacttgttcatctaaaatagagcaaaacttggtttcgtttttttaaaaaaggagggaaaacaaaaccctaaaaatagggtctaaaaacaagggcaaaataagtattgtacatcaaataaatgaatacgaaatttccaccattgaattaatacttccaccaaattcattgaacattgactatggaagcttttgataaaaaaaaaacgtgacctaatatcaaacaattaaaattaaaatggatgaagcttttaatcaagatcgtttacatgcatatcttgatatttggatgcatatgttacatttggaaaaataatttgtgtgcatttcttttctgctgtttattactggaaagaatcagtgccataaaatgctctatctgaaaaagaaacgcaggtagtatcattacctttatcatcacttaggccttgtttagttgggaaaaatttttaggtttggttgtcatatcacatatacggacacacatttgaagtattgacaaaacaaattacagattccgccaggaaactgcgagacgaatttattaagcctaattaagccgacattagcaaatatttactgtagcaccacattgtcaaatcatggcgcaattaggcttaaaatattcgtctcgtaatttgcacacaaactgtgtaattagtttttcttttccacatttaatactccatacacatgtccaaacatttgatgtggtgggtgaaaagtttttgttttgggaagtaaacagccccctatattattgagaacccggggaaaacatgcattagggcattcccaacccaatgactaggatggtgtccatagcattaaataagttgtcacctaggaaaaaaaatgatgtggcaagtgaataaatgaggaaagagaaggaaaccatgtcttacacgagacatggtttctacacaacatctaagacatcatgtgagataaagtagcattaaattgaagtatggaatagtggtgtttgcattggaagagtagtgtctagtactagtttctatggaaaccatatccagtgttatgggttgggactgcccttataaaaaaagcaattaaggcgaaacattgttgatctgttcgtcacggatgagcaaaacgatgagctcggcaagctggaaggcatcgtcgttctccgcggagagcggcgacgtcacattgctcttgccgaacccgtcctggcattccttcaccgcgctcgccgatttctccagcgatgagatcgcctcctggaacatgcctgccttcaccgtcgcgccgacggcggcctgagattacagtatgccgccgtacaccgactggcatgactagaggcaccgcgtcgcagcggcgtcgccgctgccgttccggagcttgccgtctatctcagacttggtgctcgtcgcgttggccgtgaggaggtcgacggcgatcaccgcgaattccttgtagctgctgatgttgctgctccggttgtcggagctgagcgcgtcgatgcagaacgtgacgctgaggagctcgctgccgccggcgatggtcttgcatgcaccgtacaggaacgagttggtgccggcggcgagctgagacgcagcaattaggagaacagcgaagaggaagagaacactgacgccattgttaacattggaggatgacgccattgtggttgtggatttgatcttggaccttctctgtaagatgatgttgaatgagatggttttctggatgcccttgcgtgtcaattacataagtacagcattttgcatggcattcaatgacctgatcgatcatctccaatcaatgattccgatatcagatatcggatctgtagaatcgatatcccgttaatttctctgttgccaaatttagatggtgtgtgttgagagaaactctgggtctgtcagaaataccaaatgattttgaggatggcttgaggatgctaaagaagaaactaaaaacaaacctcacaattgtgttcgttgcttggttctgttgggggatttggttaaatagaaatgagtgggtttttgaaaataaaattgctaaatcacctttgcaggtagtctacaaagccctggcgtgggtgcaaagatggaaactgctacaaatggaaggagattgcccagacaagtggcataaggagctgatggacaagctgcaggaaccggagaccttgcctgatactctctccatcccaaaaaaaaaacttaacttctagagtttaaattttatcccacaaaaaaccaacttctaccatcctacctatcttcaacacataaaacgagaagttttatctcttaaataatctttacctacctatcaccagtactaccttttctattgatgagggtcattttagtcattttacttctcactaaatttgccttgggatgctaggaatcctctttttatgggatggagggagtatatcgtagtttcctttctgctgggattattatgtgtcaatctgttgggttctttctttttaagataatggaagctttattgatctcactcaaaagtttttgctgggattagtatgtgtcagtctgttgggttctttctttttaagataatggaagctttattgatttcactcaaaagttttgataacactcccagcctctgcactacgatagtgcacacagccaacacactcaaaagaagagaaaaaaacagcttgcaagatcaagaccctacaaggctacaacccaaataataggtcgtcacctatataccgaggtataaaactcattgacacttgctttaaatatagacaagtcgaagtgacaaaaccctacaaattgggcttctcgagaataacccatgatcagagccaatgtagagccaatgtgtaattaagaaaataacctgcaaaggagaagaaacagttttcctataaaaaccacatcatttcttgagagccaaattacctagcaagttgttaccgtccctattaggtctaaactctttcttttgtggggttagaggtctggtcgttttggtgtggactgcgccgcatgggaggcaacaacatattagcgctgtagcgtgtccgttaccggagatgaatgctcttggttagtttatgagctttgtataacaccctgtttattcctgtttggctttctcccgagagctgggtaatggaagttacattttatcaaaaaaaaaaagagtaaatttcactttgggcctgattttttggccaaagttttaccatgaaccaagtctaactctactttttcagttagcaccaggtatgattaccttcttatatagtttggaccgggtaccaatacttttgggccagcacgttggcttgagctggtgaactcagttcagggcagagagttatcgagggagactagcgcacgggaaaggaggaagatagtgtcgtggaggtggacttgctcaatgcctcgatctccaccctcgcaaccggtggctcacggccgtgtctccggagcggcatggcgcggcggcggcgtgctcttttctggctccgaattggcatggcggcgcgctcttcagctccagtgtagtgctggcggaatgaatcaatgtttgtttctgaatgagtgtgcaagtaagatggagctgtccattttgccactaaaaacaagcagagaggttccaagttccatatgtacatgtacctgatggtgaggtacaatgaattatcggcacaacatggcatttctgataatttcccttcccagtgccttctctttagtgggacttatctacagtacacagagctaataaatcctactctaacttggtgaggcttttggcctccattctgcctggagctgaaggagcagtgcgtgcaccc

SEQ ID NO: 38182 - DNA, 26214 bp, Oryza sativa
gcgcccccacggcactatcttcctctcccatgcgctagtttccgtcgataatttctcttccctgaactgagttcactaggctcagatcaagccagcgtggtggcccgaagtcttaaaacccggtccaaattgcaaaagaaggtaatcatacctggtgttaactgaaaaggtcgagttagacatagttcatggtgaaactttggtcaataaaacaggtccaaagtgaaatttactcaaaaaaaatcacatccggagacaccggccatcttgccaaaccgtaatagagaaattaacagagctgcattccgcaagaaaacaaaagagagactcatcaccatccccatattatagaaacatcatatccatggctatcaaacaaaaaggagacgtgatctcattgataccaagttcctttttgatgcattctacatttttatctggtcaacttaataattcccatatcattactaatatccaaacaaacaactcgatgatttcttagaagcaataaagggatatattataaataaagcgagttgttcaaactaagctttaattaaaaccatccttggcctaatgggctctgatacagtggaataattagcttttgatcactatgaaatcctgggatgtcattaaggacagaaacagcgtcccaacatgttagcctgataaacttgtgctaattaaacggctaaaccagagcaagatcaaacgaacaaattgagtaaggaaaatgtaagacttgcatctgttctgctgcattcggcaactcgctggcaactggcacgacctgcaatgcgtgttcacaagaaacttgtatgttagaccaacttgcgtaccctgagatatcgtgtgttacaatagattctctgtgttctttagaaagacaaggaaataatccagacatgacaaaataaaaggcagagtagggatatatctacaaaggtgtttatgtagcacgcactacttgacaaatgcgaggcataccacctgcatgtctaattgtaacagaccagatttttgtaatggagaagttaccctcttctaaattctgtgcatagtaatgaaagtctgaaaccaataattactgatcaaagcaaaattggtcataccttgtttggttcactaaatgaattttcatccagcaagttgctggatgtgagaacagtcacagttgattttgccgtatctacaccagcttgaagtccacttgaagatattgtgaggttcacagcatttggcccgaagtttactatctgtggaagatcatttgaagatcaggatgttctaagatccaaacatattactccagcagtaatacatataaagacagatgcatgttatgcaagtatgcattggctgaatcaattttgtatcgttgtaactaaatcattccaaacaataaggcgcatgtctaatgaattgaaccaaatgcatataagtttagaagaaactggaatggatggtttaccttcactctcagaaaggtattctcagcgtcttgccaggtgattgcagaggcagccaataaatcagagtagctggaactgatcataattggatgaatcatagcaccgcttgattcacggaaatatgtctgcatccaataactaggagttccatactgttgccaggagttgaagacaatcgcatctgggttccagctggttatcacatttatacattagcaatagtcagagaggaaacagatgctagaatccttgaacaaagaaagtataagaccatgtatactaacacgcgatcgttgtcattcacgaagagtggtgcataacatgccatctgaacgacatcactgcaaagaagcatgcatgatgagagccaattcaataacttgcaataaggaattactgttgctcaatgtaaatttttacaaattatacatttactcaaaatattttccttgtggagaagtacaaagatgaggtagtagttgtcaaacaaaaatcaacaatttatccaggaatcccattgaacgatctcttatattcatgcatggtctggatacaagtagacaactctgcgcatgattttatatttactctgaacccaagataaagaattaagagagtatccccagagggatcacctatttttctctaaaccaattaggaaagcagcttctgccaatgatgcaagaaggcttccattgccagcatcctcaccattaacagcatactcacttacaaatacctgcagtgaaacaattgcatagtcagtggttcctgctcacttatattctgtctatccaacatcaaagggtaatgagatgaataaattgccgggccggccaagaaaggccaaccaaatttacttaagattgaagaatatatacaaatatacaaagttataacttcaacaagaagctgtcgaagtaatggaagttgtcaccggagcaacctcccaaaagcaaaagattacactaagggactactctcctatatttctgaaaaccccagcttccttccaaatcgccacttcctctttgattgaaccaaacaggaaaccggctgagcgccgctggttctgaaacacacgcgcatttctttccttccaaaccatccaacaaacatgggaaaaggaagaacagcgtcttacgttttgctattcgatagttaggcttcttctcatgggaaaaggaagagaagaagaagaacatgcttgttgtcataattactaactatgcttgttgtcaatcaataccacagcagattgctctagaagcgatctggagttcaagttatgaagtactagtagattgctctagtttgggatattattcaagttatcatatattctgatcttatagattcagtctcagtcatggaagaagatggaagaaactaatacctagaaacacttttttttcgaaataactagaagcatatttcattcaagaaaatgtcgaggataatggcgcatgagagaagctgcctttgtaagactgatctaatctaagaacttaatttcctatggagcgaatctcctagtacccaaggtcctgagttcaaatctcctatggagcgaatttcagattgggttgtttgtggggctaagttccctatttcaatggccgcatatatccggttggatgtagaggccgggtaaaaaatacccttctctaaaaaaaataaaaaaaagaacttaatttcccaaaagaagccactttatatcaaattcattacctttggaccattacgtgatgtcctatcaaattcattcttcttgaaaaacacagtggatgcattttcatatatctacagaataaatgtaacattctcagaaatctatggagaaaatgatcacataaccaagtctgaaaaaaaccagcaagacagaatttaaaaatagggagaatgatagaaataaattagtctcagtgagttgtttacatggtagtcatagagatcggcaggatgatcaagtggcccagacgagccatcacagtttgaaattatttggatgtcaggataagcctcttttatggcgttgtagaacttgggataattttctgttcaacagaattacatggttatatgatatcaagggaaaattaggatatttatgatagtagtagcccatttaaatgtactgaaacagcattatacgtcgtagccaatttggcctcaatcaaatgtaaaactaatgaaccttctagaaactggtaaagtctgtttcgaaacataacagcagactggtaaattaacttcttgtttttcttttcatctattattttttttataatggaaatattttacatccctggcctctgccacaaggcatgcagccaattttttcatctattatttctccaaaatatctccattatgcaatcagatagtactaaaaagggtgaagttaaataaaatagtgctattacccttgcagatcgataaaaaacagaatgatgaatttagccaatcatcgcagcattaacacgaaggacaatactatttgtttattatgcaaaatttacctcggtatatcagcttgaatggagcacaatcttcattccctagtgcaacatacttcagtgggaatggttcagggtgccccatcgtggctctaacagagccccatgttgatttgtcactcccctttgcaaactcaagactgtcagttgcatcctgtagcaagaaaatcaaagcatctcgaaataagaaacatgggatcacaataaatgcaaggccttatgttaatattcacatgttacaactgttttctgttacatcatgagaagtccatcttcatctcatccatacttcaaaaaatgtagggcatcgaaaacatacctttataaaaggtgcgagcatagttccattaactgcatcatggtgactcatccctaattacaagataaaaaaccctgagcagttcgttggtttgtgcaaagattaaaaatacattgaacaagacaaatagacacgatatttaccaatgttgagcacccatacagggttagcacccaagtcttcagcaagctttcatgaacattttgaagtaaacaaatggtgagatatgccgagaccaaaagaaaaaacccatttcacattaatcaacccatacctcgagtaactcataatacccaaggccatcatccgtccagtagtgccagacatctccatagtgtccaggtctctcttcccatggaccaatagtttccttccacctgaatgcattttttaaccaattgccttcgacaaagcaaccccctgccaaatgtaatgcgagcgattaaattacagggcaaccgaaattgattgccagttggaaaacattcgaaataccaggaaaccgtagaaaccgtggttttaagtccaaaagcatgtacatgagttccttgcgaaaaccatggccctgcatatgtagaagaaaaatgtcgatcaacaactcctatggactcatagtaagcaaatgtagattaaggaacaataactcgatctgccatctctacgggattactgattacagataagttaatttacttttttttcttgtcagatagcaatgtgaataaattgataatttttatgatgacctttttaaataagtttgaataatatcaaatagcagacatgatttgaacagggtgtccattgaacctggcatggtgtagtggctaaaatctttggggtcagtgcatgaattctattctccattcttcacaagatgataccggattccagatcaagctatgatgacagtagcaataaaaaagtaaaagacagtgcaccttgtatgtttctgaaggcataagtgacacctgatcaagccatattactccccttttcctagttgttagttcaagtcttgaagttctgcatgtcccttgagctagtaactgtagctctatctttgtccaagttgacaaattagtttctctgcagaaatttgatgtacaatcctttcggttagcgagcgaacgagcgagagagattgaaaaaccttttttatctcagtgttacggaaaaaatatataccgaacagaatttgatgcaagattttgcgatccatttgagcatgtgagtgaagctgtcaactccaccgattctaatgatctgatatgcatgaccagattatatgcctttccttcttctacattctgaaaattgaaatgatcatattcgtcacaaaaccagaaggtaaaatcccattaaaatatgagaaggtaaaatgaaaacggttcgaagaaaagctatagattacacttttccaagagcaatgcacaacaatctgataaaaaaccagcattatgcaaggaaaagataaatgcaaattgaaatcaaacaaaaaataggttagcttaattatttgttttcttcaccatttcgaacagaataaataactttgctatagtttctttctgtggcagcactgtttattgtaaactgtcgtaaaaaaaaaggatactactttcaattacaagctctattttgcatattattcatataggaatgcacttataaaaatggatagaactcataccatgccccaaaatcctggattgtaaattccaacaccaccggctggacaatcgtcacagacaacctctatccttacagcaacaggattttgactgaaacaggatgagcgatcagttgtcacgtgaacagaggattcatctccaatgatggaccatgggtcaatgtttgatgtgttggctccagcttcaaaacctaaagcaagaaattagacaaaaaatcagttaaagttaaactccaaatattattatttatttatttattgaggggggaaaatgttttcttattcaacattgctatacatcagccggttgatttctcctcaaaaatccttgcatttgccatacatgaggtgattgatttctccccaaatattcttggcagtagatcacaaatccaaaccatccatgttgcttcttcaacctcaagccttcgttactcactctcacacacaccacccccaccaaaacgaggtcgagctggccggtgaatcccgagcatccctgcgccgatgagcctcctcctcctccttttggctttcttccccggcgagagagggcgaatggattaggatattgggttggggtggggccgtggagtggatctggcggggtatagaggggttgtggagggaggagcagttcatcggggcttcgtatacagggaggggaggccttgggcggtgggtgaggaggcggcggatccggccgcgagagacgccggagatggtgcaggtgcaggtgcggggagggaggaggcaggagggaatcgttcaagaggagagagagagagagagagagtagccatgagctggaggttgaagacgatccatcaaccgttggatggccatccaacggctgacagcactccactgctctcttcttctttaatttaagagtgaattaaacttagtgccatgttttatcgccaaaatttcaatttgcaacaccatatacccaatctctttactttgaataggtacttttacctttgttgcataatgaaccaccctaactctatttgctagccatgtctattgtttcctttggcaaagatatggcatgcgtataggtatgaaaattcgccagcatatcgttaacgatttgctcagagtcattgaagtgctgaagatgtggattggagtatctattatacaacaaaaggtaaagttacttagtccaaagtgaaaaaattggaaacaaagggtgatccaaaataatttttttaaaaaaatatagtccaaagtgaaattaactcttgatttaatgttcaacttcaccagagaagagttctcaaagagaaaaaaaaatagagagaagataaaaagagagacaaatcgtgtcaatgaactggaggttgaagaccaatcagccgttgaatggacatccaacggctgataccactccactgctctcttctttaatttaatggtcaatttcagctcggaagccaaataaaatactacctccatcccaaaatgtttgacgccgttgacttttttaaaaatgtttgaccgttcgtcttattcaaaaaatttaagtaattgttaattcttttcctatcatttgatttattgttaaatatacttttatgtatacgtctagttttatacattttacaaaagtttttgaataagacgaacagtcaaacatatttaaaaaaattaacggcgtcaaatatttaggaaaggagggagtagtactataatgtggtgttacctctgttactgacgagttcagcccaaaggccaccacttccagcgtggttaatctcctgcacaaataataataatgcagattttgataaagaaaagaaaagcaagcatccacaggagaagaaatggaaaagaaagaaaagagacgtagctagtctcacctcgaagaagaggccgaacaaagtgtccggcattcttcgagcgacagagtaatccacatggagagacgccgtctccaacgtctcggcttcgcatctgctgctgccgccgccgacgaagaacagaacgaggaagacgacgacgacgacaatggcttgcctggacagcatgctcgtcgtcgccggcggccacactctcatcattctgcgactgcgatgacaatggattggattgtgttgctacttgctagagggaggcttgagttagtatgatatattgatatgaactacactacttgctaggctgctagctggtgtagtagtgtattagacgacacgatccaacctgattattcgaggttgctcgatatctactgctggaaattgctctagttagatacagtaagtcgctaaaattgccaacaagtagtagttcattcacatgggttccagtaaaaatgtacagccatagcccatgttttcttccttttttcctcttctttatctgctcatcttgattcatttcacagaaattcctctgccagatggaggcttcagttagtgtaacatgaactacactacttgagttacacgaaacgatccaaaatgattattcgaggttgcacgatctactactggaaaatgctttagttagacagagtcagtcaacttgctaaaattgccaacaagttactagttcacttcacaagttcacatgggttccagccaaaaatgtacagccagcccatgcatattttcttccattttcctcttctttatctgctcatcttgattcattcgacagaaatatatcgaggaagacgaataagcacaagcatttctattgctaaccccgtgcgcgttgcagctgcacatctctgccaccactttggaccggcccagaccaagatcgaatgaggaccaagtgacacttgcatctgctcctgcatcgaagctatggcttgagatggccaaaaccacctattctaccacacattgacttgtgcattacatccagagataaaagtagaaaacagttgcttaccttatccggggttactgacacagttctcatctatgcacacgacacaagtttccctcttccaaccttttcttctcatcatcattttatcaatatacctaatggggaacattccagatttacagggaaacatatccacaaataatcaacatccatcctaatagggattggactccatttggatctgctcaatcctaaattcaaattcttagcccataatctgagccttaatttttctcaagtttaaatgccaacttcagttcacaaatccttaaatcaaattcagatattctctacaaatttgttatccttgaaccaaattattctctctttcccaggctaaagagcccatatttgttatccttggaacaaagcaacacggtggcaatgcgccatctagtctcatccgatacaaatatggagaaagcaaaaaaaagaaaaaaaaaagaaaagaaacgaaacgaaaagaagaaagtaagcctggagtgaattttattcatcatttcctgtgtattacactatacagtagtgcttcaagatacatgcacatatatggactgcattctggtattcgcatatcacatctcgtgtatttcttgtgtttctgtcgctaaccttgtgttcctgcttcacatctctgccacgagtttggactgggcaagcgcaagatcgaatgaggagaaagagtgaggagcaagcgtgacttgcatctgctctgctgcattggaaagctggcttttgacaggaacaacctgcattggttatcatgagcaaagctttggcttcagatgaccaaaaccacaaactctactagacattgatatgtgcattacatccagtaagaaatcagaaatgtttgcttaccttattcgggttactaaaagagttctcatccatcacattgctggatgtgataacagtggcagttgatcccagtgcgttaacacgggcctgaagcccagttgcagagatcgtgaggctcactggatcagacccaaagtttataatctgcacaggagatttcaagatcaatccatgaggtacgcaattctcctacagatgtagagtaggtttataacaaaatttcttgcctttactcttaagaagctattttcagaatcctgccaagtaattgcagatgctgccagagaaccagagtagctggaagtgattgtaattggatgaaacatagcaccgctagattcacggaaaagagtctgcatccagtaactaggagttccgtattgttgccaggagttaaatacaatggcgtctgggttccacctgattgtttgattgaagcattattacagtacttgttaaataaacaaaaacacaaataaagaaaccatggagccatcaaaactaacgtttgatcattgttgttcacgaacagtggtgcataacttgccatctgaacaacatcactgcaaagaaccaacaagaagttacagtaaatatctcattgcatttgttagtagatcttaataaagccctacgcaggaaagctcaaatgtgatctgtcacacgacccggaaagaaaagattgtttcaaggaaagataacctattcttctccagtccagtaaggaaagcagcttctgccaatgaagcaagtagacttcctctacctgcatcacttctccaaacagcatattcactgacaaaagcctgcaaccaaaacatatatgaagaaatatatttaatggccaatagggatgagaagagataaataggcagcacatctgtaaagatagaagtgaataagcaagagaagcaatgagattccaaaattatccaaaacatggaaaaaatcatcacacgtgacatagatgaactgtggatgttactgaattgttgttaaaacatagatggccaaggtcatcctacgaatataccaagagaagtcctggattattaatgtaaaatataaatgaaagatgggagattcacagtgctgttttacaagcatctccataaatgaaaaggttcacacagcaatgaaagtccaggtatacaacataccttgggcccattacgagatgatctatcaaatgcactcttcatcgaaaacaaagtcttagaatcagtatagacctagagaaaaaggaattattagaatttaataaatgggaaaaaccttgacattggtgacagaatgagaagtactgcataacagaactccagaggatgagtagtttacatggaagtcatataaatcagcaggatggtcaagtggtcttgatgaagcatcacaatttgaaatcatttgaatgtccggataggcctcccttatagcattataaaacttgaggtaattacctgtataacggataagagaacatcatgcatatacctaaaaggagaactcaacagttgctctccacacagttcaagtaaaacttgtgcagtaccattggggattatgatcaaacataaaaaaattgcatcccaatttttttaaaaaataatgaaaataaccacattttagtagtttttgcttccaggacttgtttttatgtattactaatcctactttatttgcaacgataaaaaataacaacgtatattactgtgagtataaaagaggaaaaagaacatatgacataaaaaaattaatattatatactaattgaaatagtgtaagaaacaaatgtcaccttgtaaggtttttctatggagattttatgtgactaaattaatgaacgacttctcaggaaacagaaacagcatcataaagaagttgtggactatatttccctctggttcatgtagagatttattttattgagctaatattatttgaaatacacgtccaatcacaaaatcaaagcccagtattgaaagtggatagagagtgagttgagtgactaaatccataaaatatattttacataattagcatggttcatgtgcatatccttttcctcgatcatacaccttcttaattatccagacaagcctcttcaacttatgcagttatatggtcaagtggataaaatatgaaattggatgaggaatataccgcggtaaaattttttcccacaatcttcatttccaattgcaacgtatttgacagggaatggttcagggtgccccattgcagctctaacagaaccccatgtcgaatctgcactcccccttgcaaattctagactgtccaatacgtcctgtagagagacaggagacgttcccaaaacaaaagtggtgttatgataactaccatagtctcaattaaggaaaagatatttggtattttcttggataggtacgttaccgtctcaattcaggaaaagtagatcagaatgcaaattcaggttaaacatcatcactgcttgtgaactttgtgaaaattttttaaagaactctctgaactaatagtgtaaaagaacaagcccaaaccatcctttattttacacagaaaatcagctctatttcaatcatgagaaaacaaggcaagagttttagcatcagtcaatgagacacatcatatgcagttgcattcttaggatctgcacaacgaagatccttaatatttagatatacaaagataaaagatggaacactactacgatggtagtgaagatagtatcaattttctcacattccatatccatagtaatgcccagtcatagctaggatgttgcaggtaaattttaaagtggaaacaatttagcgaatcaaggtgcatctgacttaacagaaaataaaccagggagttcagaacatacttttacaaaaggagcaattgcagcagtatcaacttcatcattatggctgattcctgatatataaaagagtttagtagcaattaaggaggtcagctgtggcgataaagatataaaaaatatggcaattattaccattgttaaacacccagattggggcagcgcccaggtcctcagaaagctttgatgtagagttcaaatttttcattagaaaaaaaaatagaattcaaaggcaatatatgattagggagtgataagaaaatgaagggcggaaataatgtcaactaaactggtacctggagaaactcataatatccaaggccatcatcagtccagtaatgccaaacatccccaaagtgtccaggcctctcttcccatggaccaatagattccctccacctgaatgcgtttcttaaccattcaccctccacgaagcaacctcctacaattgtttgaatggaaatcaagtcaattatcccagacacgtctgacatatatgtgcagatatcaagaacttgattttcaattggaaaatatagctcataccagggaatctcaagaatcgtggttttaagtccaacatcatagatattagttctgtgcgaaaaccatgtccctgaatgtgtaaaagaaatgttggaagcagtagaaaaagcccatgaagatttaagtggtatcatacactatatagagatagcatgaaaaagtccatgatatcgttttccttttccagtaacgaagtttgataacaaaatataatgtaccttgtaagtgtctgcagacatgagagagacttgatcaaaccatacaactcccttcttggtagttgttatttgaagccttgaggttctatttgttcctttagcaaccaacttctgctccagttttgtccaattcgacgcaccagaaaccctgcaacaatataattctttcaactaatgggaatgggcagacatccttgttctcctgtcccagtattgagagcaaaggcactgacggtatggtacttgaagccagattttgcgacccatcagaacttgtcaaggaaactgtcaactccacagtttctggtgatttaacatacatcactaaattgtaggtctttccatcttctatgttctgcaggttgatatgacaattaagggcgatcaaagcattggaaaggaagcattgcaaaagttaggaaagcaaatgtttaccatattttgcccaacacaagtgcacgaaagaaatatcgctacatgaaaatttgaaacagaacgtgtggaggtccatgatttactaggtaatttcatgagaaaatacagcaaaatggtagcagtactatgaggaaaacaaactaaagaacaacaatacataaacccataccatgccccagaatcctgggttataaatgccaacaccaccagctgggcaattgtcacagagaacctccatccttagagcaacagtattccgactgaaacatgacgttcgatcagtcgccacaaatatggaagagtcatctccaattatggaccatggatcaatgtttgatggggtatgagggcctccagcttcaaaacctgtgcataaaactcataagctggttatactaagccctacatgtcaatatagcttccatgaaagggcatattattttgcatcccatccagtttatgctcctaatcaaagttttgtgttccaagtttacagaattacagttatgctaaaaaaaattaaactctttttttaagttcatgggaaaaacataatttagttaataagatagtagggagaattttcgagtaaagacaataacaaaaggatttcctactgtgctggtggtgcgaggcgcacaaatcggttcataagacggatcggaagaccttcgacgccggggttatcctggtaacgtggttagtttggaaggaacgaaatgcacgcgtttgatggaaaaaccacatcggcggtacacctctgtgctaccatcgctgatgagtgggaaacatggaaggccgccggcctgttgagcgcgatcgatgctggctaaatcgctgagacgattcactgtagcctaagtttgtctgtaggctaaatcgctgagacgattcactgtagcctaagccacccctggcttagggtgtacttgtaaaactttcttttcttcttaatatacaactctgccggtttttgccggcccagcaaaaaaaaataacaaaaggatttttttaaagccatgtgtttgtgttccatcggattgcagaataagttattcatgttcatccagaagcaaattatgttttatctggacgatggaacaaaataagtgcatatcttgcattaaagaataattgaagtacctctgttactaacaagttcagcccatattccaccagctcctgcatggttgatttcctacaatattagccaagaaattgccatcaggacatagtgaaacatgtagtctacctgacttattctagacatgctaacaaagtgccagaggaaaggacaaagtgatataatgcaattgtgcaaaacaaaattactatatgtatcttacggtttacctcaaaaaatattccaaatagcgtgtcggggatctgtcgagcatgttgcagtgaggcatcaaccttgaggaccgcagtctgggtcgtgtgtaagtgtaactctgaagctatacacttgcagccgaggcagaacaaaagcaagaagaagaagaagaagatggcactcaggaagggttctctggaacccatacttggagctgtaaacactagtgcaggtcgtgtgtctgttgaacaaataaggccagaagatgatacagtatgcatgagaagtcaactaagaaagataggcatcggacaagcagatgctattactagatggcatcaaaacagcgataccattagaagaaacgaaaggccaaacatagagaagacagtgatatgtccaaaaccatgtctacaatataacaacacttgcatcatttgctcaactacaatttttagaaaatcataaaagcgttgacaccagacaacaaaatgaaacagtcaacttgttaaggattaggagagcggaagaggctaaacaacacaaagaccaatcaattcccttgtatcagtcatttcgtcgaacaggtcgtccgcataaccaaagaagacaagcaggaatagcagtaaacgattttcgtcaaaatttctcaccataataaagcgcaccatccaagacgtcaggaatcaggaagaaagaagtgcggccgagggaggcgagcgccaagcaagctgccgcgaggattaggagcaggacggacagagcgcgaggctttggtgttaagtagaggagaggaggagagagagacagtggctttgaagggaagtgtacctcgacctcgtggggaggcacgcaacgcaagcagaggaggtcgcgcggccgcctgatggtgatcggacgccggagacgggcggcggcacgggtagcagttgcttgctgcggcggggttcggcgcggcggttgggtgcgcggggcccaccgacagacacgagggattgattatccctagctacagtactgtatttaattatcgaatgaaatggatcatctgtctatggctctcagacatctccgtggcccacactgcctgactctatctaatctactccctctctttttcatttaagtgcaaccatccattaccgcgcctaactttgatcatctgttttatttaaaaaaaatttataattagtgttttggttattatgagatgataaaatataaatagtattttactcgtgacttatatttttaaaattcttttaaaaattttcaaataagacgaatcgtcaaagttggacgcggaaaactatggctgcacttaaaatggggatgtagagagtacatgattggtgtccaaaagaaaacaaaaatatctcaacagagcagagcctggattcaaatacgatatatgtcatggttcctattgagctggctgtatttaaccataattggccaaagattaaaaaaatgaaactttctaaccaaatttatctgactttcatcggtttttggcaataacgttaacgactagagttatcaatggaaacggtagggagcgatttcagctatcgatcacatacgaaatcatacacagagcacaccaatacaaaagaggatcggttcttcatggttccttgctatcacaagggatgaggcagttgcgcctccgtcaaagtttgtattagtacttcctcgcaaaaacaaagtttgtattagtactaccaaagtatgagataatgcacatagcctctaatcaattgatcatttcaacaagactaaaattacaagtagctctctcctaggatttggtgagcagtgtggcagtgaagattgtcatgttcattctacatagtactaggtaacagcgcatgttcttgcatacagaaagaaggaaaaaaaaggtacaacactgttatatttagacattttattaagttcattgtaccccctcaactattgtgcttgtataaaatacccatttaactccaatatgaagtacaaatattgctgttattaataggatagttcagtaatttaccataccttcatgttttgtcttttaaaaaaaagtgctagaatgatgagtaatatgaaacagaggagtagtgtgttttgttttacaattccgtggggccgtacctaataatctgagtccccgatacgaatcataaattgatatttagaaaaatgccaagaaacaaaagaataaattgatggtggtactctaactaagtcggaagaatttttttttaaaagaaatagattttagaaaaagaattgtggtgtgatgtagtgatttatttttttttgttatgtggaaaaatggaatttgtaatgcctgaaacatatgttcgtatcgttatcgcctctttaaggtggccataattagtagtactacttaccaaagctgaagaaacaaactcattctagtcattaataaaaaaagtaagagtacttttttttcaaaaaagaaaaaaagagagtgaaagatctttaaacatattaaaacaaattggcataaattaagatatgaaaaaaattaggacctctaattagtcatccacttcgtaggtagtccctcatcgacaacgttgcaattctgatcattcatggctagaatgaaattgattaaagaaaagtggtgattagttaagaacctagtaagatgtagccatgcaggacagcaagtgaaacaaatttcccagattatgtgccgtcaaattgaggaactatattgaccgggcatgcatgaaaataacgttcatgcgtaatgattgatggaatataatggcgttgccttgcttgggtctaaacgtgaaggaacatcgatcgatcatacatgcgcgatagcgatgtgactcatttaccgctgatctgatctgattctgatcgacagaaatcactgaaatgcatgcgcatgcgtgcactgcaacacaaacatattgattcatccatggatcgatcgacagatatatctagcttgagtttgaatgttgcatatataataatactagcagctcatttatgatttctcgatatatatatatatatatatatatatatatatatatatatatatatatatatctgatgctctcttgcgtgtccgtttgcactcgagatatgattgatatccacgaattgaagaagaagttgcattgcttgcaagatatatatgcgacagtaatcgtcacatctgtcctggagaatataatgcacaagtgttcattccagttccactactctactcttgatttctcactcttctatagatctttaatttctggtattattccctaataaaaatctttaatctcttcactttgcttaggttggctccggttgacagtgacacggggaaaggcaattggatgcggttgagggccgctttcgcaaacggtattgggccagaatgtaaaaaaaagtccatagcccatttttatcgatctgatttctaaaaaagcccatagcccattaacgaaaagagcccacggcctcttctctcctttcttcctcctctgcaagccgccgacgaggcaagcacaagtctaccaccactagagagagagaaggagagagaaaatcgcagaggagagagaagaagaagaagaagagcggaagagaaggaggagaggagccatggatgcttcagcgctcagcaacccgcggctgcaggccatgctagaggtaataataaacccataatgtattagggagatttagagatgagccgcacactcgagtacccgacctatggaaccctaacacggagattaattagcagcccccttcttttgatcccatcagcccatctgtttgttgctacgctcgcgattaattttttgtcctttttagatctactcgaagattcgtgaaaaaggctgagctttgggcgaaattttgctgatttgtgccaagtttttgccctgttccttccaaccattagcttattatgtatgcattttatttattttgttcagttgttttagcaatattcttcagtctgcaggaattcctaggcatcacgactggtttttctagctaagagtaaggttgtgccctaattttggggtttaacagatgtcctgggagttgcagttcaggtggagatcggtattcgaatcctagttgtgttacttaggtatctagtatcatagcaattttattttaaagtatatcaagtgctcagagcaattgcggtatcttatatccaaggattgtttggcctcaaatctcatagccggttctgttgttgatagggtcccaaatccatagcataactggagttaatccagcttgtggttgtggcttttgatcaattccttgcggagaactagggtatgttcttggggctccttgtggttgtgactatcacccaagtacccagtaaccctgactgtgaaccaaactaatttggatagagtctagttttaggcaccatcagaatggtcctggtggttcatgaagtctttcctaaaaaatagccatagcttgaaaagtttctaacgcttcaactgaggtgatattctgtcattcccaattgcttttgtggtgctctgtatttaaggattatggctgttcactcattactaatagaagttacaattctctctcatgatatccaacaaattatttattttcatgcagtagtttcttaaattgcagtagtcccaaatcccaagtgtgctagccgctaatgcatatagcgcagtgaggtgttttattaaatttgatttgctaccagctttgttatgttagaaaatgatagtgctgggtattctgacacgttgcaaggaaccaaagatgttttcccggtgacataccgatatactcttatgtgaaaggaaatactaacatagaaaggtcatcagtctgcaaattaaacgacttaaggaaaaaagggaattgcctttttacatctagtatgctgctaggacctttttgtcctgggtttctgatatgtaatgagaatggcagaagttgcttgcttccctttatgcacaagaaattattttgtgtactctgttctttggacaatggataattaagccatgtgttcattttcaagatcccctattcaattgcagaaccgcggtgcttgttactcacagaaatgttactgacatttttgtttttctttccctcttcaggaggagaagaggaaggcaatggcaaacgagttcgtggcgaagctgactgatgtttgctgggacaaatgcatcactgggagcattggaagcagcttcagcaacagcgaagcctcgtgtctgtccaactgcgcaaaacgctttctcgaactgaagatgctcaccatgcaacgagttagcagccctaggtgaaaattcgcataggtctttcctgcgtcgagaatgtagaatctactatagttgatgctagaaactatacctaaggggcatcacttgctttttgctacattttgtcagttttggtgtttttcctgctatacgttcagtgaaaagattgcaagttttgctcttgcaaggagattaaaaacgctactgtactttgactacttttgacctgaaaagaatcagagacaagctcataggctggagcagcaaatgtgttaatgaagtgtctgtgtccttggagaaaataaggtggtgcttttttagataatgaaagtgaaatgagtttatcagaaattgaacacttccagtgtcctgccatgaatgactgtaactacaccgctgttccttttttttttacagtagatgaagtacaccgctgttctaaatttatgtttaagtaatcaccattaagtatctcactcagtatattccagccaattccagaggcgcgcatctcgagattatccgacggtagatggtgtaaagctagtgcttagtgccacactgacacgattgcctgtgtccacatacatgtatacatttgacggtttggtctaggggtctccgatagtggaactgctgtcctgtgccccttcacactccccagcaaggcgacatcctcaaggtacaccactcctcatctgatgcttcttgatcagctttctctccattgtttttttttcctagaattctaactaattttctgcaagtcctagttcctgatcatctttttgattgtagcaagttcgtgtgattgttagtgttattgtctgtgtgtactgcaaatggttgcctggagtttaactatgggtttgttgaacaaatggacgcactgtatttgggttccccagatgagcgcctggaagttgcaatgcattttgtttccatcttcgtcattctagtgcctgcatttgttttggttaatttgtaaggggggaacaagtagaactttgaaatgttaatgcttatgtgagccaaatagattccggacagaacatccatgattcatatgccacagagacttcgcattgacacatttttatctttaagtgagccatcagtgctcagccgaccgatcaatggccaaaatatgcagattgttctgtttctgattgttcagaagttgatgcagctttctgattttgcagatctattttctttttattcaatttctttgctctacgttgtatttgcactgaacgatgttttctttatatttatctcgcgtacttattcttaacatatcaagttctgagacatcattcatctgctgatacatacaagtatcatgctcagactatttattgacttctgcttttgctgctgccagaatttctccaagagttcaccatggagaactctgaagatgaagcagagaatggcaaactacccttggaattggagccattgcgctcattagcgccaaagtttcctactattttgggatatgatgtggaaactcaatcaaccaatccattgttagtttatgccacaccattcatcacaacagcctcaagaagccccagcttcattttctctgcccttaccaaagtcaccagttcctataaaagctacaccaatctcagcggcatttccaacaccgcaacatgaagatgaatcatcagatcaagattacaagcccttttgcaggcagaaaaaaccaacgctgccaaagagagccaagaggccccagcaagctgagaaatctaatgatgccaacatcaagcgcagatcaataaggaggagcctggacaacgagttcaacttgtgttcatcctcatcagacaacccaaaggaatcggtggaaggaatcctgatgatgtttgattcccttcggcgccgtgtactgcagttggatgaaaaggaggatgcaagcaggcgggctgacctgaaagctggcaccctcatgatgcagaacaacctcagaatcaacaatcataagatgatagggcatgtgcctggtgttgaagtcggcgatatcttcttctttaggattgaaatgtgcatcattggtttgcatgcaccagccatgggtggcattgattacatctcttctaagaacaaagatgagactctggctgtctgcatcatttcatctggaggctatgagaatgacgatgatgacactgacattttggtctacacaggacagggaggcaatagtcgtcacaaggagaagcatgatcagaagcttgagagaggtaaccttgctctcatgaacagcaagatcaagaagaatcagatcagggttgtgcgcagcgcacaagaccccttttgtaactcaggcaaaatatatatttatgatgggctttatcgtatcgaagacacttggacagacacggcaaagaacggatttaatgttttcaagtacaagctgagaagggacccaggacagcctgatggaatttcactttggaagatgactgagaagtggaaagcaaatcctgccacaagagaaaaggctatattgttggatttatcatcaaaggttgaacacctacctgtgtgccttgttaatgatgttgatgatgaaaaagggccaagtcacttcaattatgttgctggagtgaagtatttgagacctcttaggaagacaaaaccattacaatgttgcaaatgtcctagtgtttgcttgcctggtgaccctaattgttcgtgtgcgcaacagaatggtggtgatcttccttacagcgcaacgggattgctggcaaagcacactccaatggtttatgagtgctcctctaactgtcagtgttctcataattgtcgaaacaggatcacacagaagggtataaaactgaactttgaggtattctggactggagaccgtggctggggcctgcggtcttgggatcctatccgtgctggcacattcatttgtgagtacgccggtgaagtcattgatgaaactaagatggacatagatgttgaggaagacaaatataccttttgcgcttcatgtcccggcgataaggctttaagctggaatttgggagcagaattacttgaagaaaaaagtacggctgtgacaaccaagaactttaagaagctaccaatcatcataagagcaaacaatgaagggaatgtggctcgttttctgaaccatagctgttctcctaatctcctttggcaagctgtacagtatgaccatggcgatgacagctacccccatatcatgttttttgcaatggaacatatccctcccatgactgaactgacttatgattatggtacaagaggtgctccccctggctttgagggaaaacccttcaaagcttgcaaactcaaatcatgcctctgtggctctaagcattgtcgaggtttgttctgataaaagatatggaggctggtgtactaaagcaggtaaaacttgtttaacaatcgttccaatttataatttttaaaacaaaaactgcttcttcatgggaaatgcattcttccaacctatttatgcaactgaataatctcttttagaagtagctgattcatcactccattcatgtaagtcaagaactctcaaaacaactttatgtggttacagtcgcctgaggcacctacgtggtgattttcatgctttggtacataagcatatattttcaacttaagcttagcatgccatatatttattcaagaatgtatacgatattgacaaactgaacaattagatctgaaactatggcaactctatttctcttgtgactgcctaatgcttccatcctacatttgcaggatattaagctactctatgaatggtagcataaagtgataaaggggctctctgtatttgtggtggtgggttagtggaaatgtagcaaggactgctgctttgtgtggcatgagatgagaccctcacattttgtgctgtacattgccgatgtcgtaggcctgtagccaccaatgcaattactatatcttttgctagttgctgtggtagaattaaagctctgttaacttagtggatgagatcatatggatgtgaagctgtagcactaaaccctgttaactctctgaatgagatcatctgcattactgcaaatggttgtgctgctaagatgctatataggtcgtataggaaatatttgacttcatgtgcatatggttttgcagcttatactgctgcttgatgatatgaagattttttttttgaaaaaaaatatatcatgtggatgtggttatgctgttggtatggaggaaatatttgaaaaagaaaaggttatgctgttaaagttgctcgatgatatggagggttattttttttaaaaaaaaagatcatgtgcatgtggttatgctgttgttattgagaaatatttgaattttttaaaataaaagaaagatcatgtgcatgtgcatgtgcatgtgcatgtgtttatgttattgttatggagaaatattttttgcatgtaagtatgatgttgttattgagaaatattcgaatttttgaaaaaaaaaatcatgtgcatgtggttatcaagtgtttatgttattgttatggagaaatattttttgcatgtaattatgctgttgttattgagaaatattcgaatttttgaaaaaaaaaatcatgtgcatgtggttatcaagtttttatgttattgttatggagaaatattttttgcatgtaattatgctgtttttattaagaaaaatattcaaattgttgaaaaaaaaatggtaattgttacggagaaatattttttgcatgtaattatgctgttgttattaagaaaaatattcaaattgttgaaaaaaatggaaaaaaatattttttgcatgtaattatgttgttgttattaagaaaaatattcaaattgttgaaaaaaatggttattgttatggagaaatattttttgcatgtaattatgctgttgttattaagaaaaatattcatattgttgaaaaaaaatggaaaaaacatgtttgtgtctgagcccaggttcgaactggggacctttagtgtgtgagactaacgtgataaccaactacaccacccagacttgctgtcttagctgactgtgctcgcctatttaaccagttcacgtttatttgacaaaatcattcaatctcggaaaaggtacgaattacctgtaaactatcgcgatcgtccgaattacctcctcaaaccacaaaaccagacatattaaacctcaaactattaaaaccggacaaattacccccctcactcaatctgaagcggtatgaatctttcgtggcatacacgtggcgctgaggttgaaatccaatcagcattttctttttttaaaatggtggggcccacctgtaagacctcatcttcccatcttcccctctctctctcatcatcatcgtcacgacgcacgggcacaagtggagcggcgggcggcacacggcggcgtgcgtgcgagggcaggcggtcggccgcaatccctcgcggcggcccgcgacggtgggccagcggggacaggggacgggcggtcggcgcgcacgacggcgggcctgcgggggcggggggcgggcggtcgacgcacactctctacagtcggttgccactgctgtaggcgaggcggaggtggagaagggccgggagggagtggatggtcggagttggaggagatggtgcggcggcgtcgccattgggggtgggatgagagggagattggacggggccagctcccacctatgggc

SEQ ID NO: 38183 - DNA, 7541 bp, Oryza sativa
tagtccgcctccgcgtccacccatcaccgccggtggcacggccactagctatgcgtccgcccgccgccgcgctcacctggccgccgccgccgccacgcctcgcctcgcctcgcctcctccgcccgccgcttgcatagttcacagtgagaggagagagagaggggaagagtgagagagagatgttgagagtgagagaagagagagaaaggaatagtgtaataggagtatgacaggtgggtcccatatttttttaataaataaaatgctgactggactgccacgcgtacgccacgagactaaaaccaccgcggattgggtcgaggggggtaattcgccccgtttgcatagttgatggtgaagaatgtccggttttgtggttcggggggtaattcggacgaccgtcatagttcggggggggggggggaggaggggtaatttatactttttccttccttttcatacgaactatctagagaaagaatagaccacatatgccccgaaataattctttttcatatgaactatctagccacatatgcacgaattgcgcaagttataacaaactacaactgtttgaattctgacaactgatattgaactacgacggccaagtttcggaatttcatttcagttctttgaccacttgccatgtaacacttgatccgtcatcaataaaatgattgtaaaaaaaaactgatattgaaccatgcaaactacaaccgaatgaactgtggccctatttagattccaacttttttcttcaaacttccaacttttctgtcacatcgttctaatttcttcaaactttcaattttagcgtggaactaaacacagcctgtgatctcgagcaaatgtgtgagaccagtacagcacatcccattaccacagaattatgagagaaatctacagcacattacactgtataatgtacaatacaacacaacgagtatttaccagaaatctccacaagaacacaccccgtctctgaagtgatggaaccgggtacggtccctcatgacaatctctctaccatacacccgagatacaagctttgcgctctcatggcaatcggcacacacccggagattcttgatgatcctaatgggagctcctggattggaagcgatcagagcaaaggcaatggcgagcctctcgctgtggtaggacagtgtatccgccttgtcctcctcctcgacatcaaacaacgcagacgaggtgctcgaccggcgtccgcactcgattaacctggtttctatctcctcaaccatggtgtatatctcctttgaggcagggtgtgtcttgtcacccaccaagaactcatggagaactccattgatgtctacaaggcttgatccagggttcttgtcaatgcccatggacttcatctccttcctcgccttcttggcatcctcccatcggttcgttctcgcatagaagtttgaaatcaggacatggtttccactgtcatccggttcaagtcgcatcaattctgcgatcatcttctcaccgagctccagcttgccatgaatgccacaggcccggatcagagacctgtatatcgcggcatttggcacgatgagcatttcgtggatcagcttctcggcattgttaagtcgaccagcccggctcagcatgtcaatcatgcatccgtaatgctcaatccttggctcaatcccgaattcgatctccattctgtcgaagtagtccagaccttcatccaccaatccagcatgggcacaagcacacatcacggatagcacagtgacgccatccaccggcacgcccgcaccgtgcattctgtccaacagggagagggcagcacggccatggccatggactgccaagccatggagcatcgcattgtagcagcgcgtgtccctgtccgaagcggctgcaaagacctgctcggccaggtccagcctcccgcaccggcatacatctccacaagcgccgtggccacgatgcagttgacggcgagccggcgcttcacggcataggtgtgcgcccacaccccgtggctgacagcgccaagctcgccgcacgcgccgatgacggcgacgagcgtgatctcgttgggttcaatggctaaggatagcatccgcacaaacagctcgaggattgcatccgccgcagaggtggcgcaggccacgtccctggcacgaagacgcgcgtaggcggagagcagcgcgttccaggccggcaggtcggggtgcgcgatccggtcgaacacccggcggcatgaggcgatcctgccgcagcgcgcgaagacgccgagcagcgcggcaccgaggacgcggtcgcaggaggcagcatgggcgccgaggaatttgaccgaatgggtggcgagcgcgagggcgagggccggaggcgcggcgcggaacagcggcgggtaggtgaaggcgttggggcggaggagcggcggcgaggaggagaggaagaggagggcgtagagggagagcgcggaggggaggcagcgggaggaggaggaggcgaggaggagggagttggcgaggaaggtggtgggcgggagcggggaggagaggaggaggcggaggcggtgggagacggggaggagaggggaggcgaggcggaggaggagggagaagttgggggaatggcgcgcgaggccggcggtgaggacgagagcgtggagctgcgcgaagaggcgcgccgggagcgggagcgcgtcgcggcggcggagcgcgggcagcgggtcggcggcgcggcgggcgagtgctgcctccgcggctgcggttgctgggcccatgtgcacctgggctgctacggggagagaagcattcgtcatggaataagcctattttgcctccctcatctcttaccctttgttgaatcgtctcccttaatcgtaaagccgggtataacatctcccttatctttgaaaaccggtgcaaataaactccttcaatggttttgcaagcggttttatcctacgtggctcttatgggacccacatatcagtaagagcaaaatgaaaaaaaaaacatctcatcctttttttcctcacctctcccgttctctatttgccggcggagtagtggtcggcgagctcctttgtctacgcgcgccacggcaggcggctccttccctcacgcgcagccggttggtgttctcttctccgcacacgccgtagccgcccaggtcctctccacgtgcgtgatcggctgcagcgtgggcgcgataacgtcgtggaacaagtcggccctctcatgcttctacctcttcctcctccggttcttcttcttgaaatagactctatgcacaaatagactccaccctgtcgtccccacagcaccagcaacccatcacattggagctcctccccgcacggaatgacgccgtggagacgagccaaggagcagagaaggacgttgcggtggcgaccgcgtcctcccacccatcggtccctcccctgccatgtgctcacgcggtttcgcgtcctcctcctggaaactgcttgctctgtgtcgcgcccctcctccccccctcctgctgttgcggcgggcgcccctctccgctgtagtagtcgagcttcttctccaccgacaagagagagagaacacgaaagagagagtggtgagaaaaaaaaaaggttgagattaggatgactgacatgtggggttgtttatttttttattttttcaccgatatgtgggtcccacaagtgtcacgtaggataaaaccgcttctgaaaccaccaaaagagtcgatttgcaccggttttcaaagatgagggagtcattatacccggttttgctattgaaggaggcgattcgaccaggggcaagagatgagggatgaaaaatatacttattcccattcgtcatagttcacttttgattggaccagtctttgggccgtaaattaagcccagttgccggttgagttgaagcgaatgatgggctaaaaagctgaaatggtactgtatatcttttgtatggacttggatgagtgcaagtaattaagccagctagttgccgataattaatcaatctcaagaatataattatactgcttgactatactgcctcctctcctgtttcgtgtttattatgcatgttataattctgggtcctgatggtaataggacctgttcctgttggatacttggattccatcactccgtagataacatcaatctggtaattcggttcctgcaacaagcacaaaggttgaggaaattccagcagcccagtgaaggtgcagtcataaattcaagttgagtcactataagacctccttaccgactaggatatccagttcatgactagtcactgttgaaactgggaatgtaacccaacaattccagagtcactgttcaaacagggaatgtaacccaacaattccagagtcactgttcaaacagggaatgtaacccaacaattccagcaagacacaacaaactcaaaataaatggcactaaggatctcatcagacatacgcatcaccaacacaagtagacaatgacctttcaataccagagtggcaaaattaagttgcaagaagccaataaaaagtactccctccgtttcacaatgcaagtcattttagtatttttcactttcatactgatgttaatgaatctagacatatatatctatttagatttattaacatcaatatgaatgtgagaaatgctagaatggcttacattgtgaaacgaaggaagtaaccatcttgcgatgttgaaataaacaacgagcataatcaactgttcagtctcagacttccacaaaccaggaaaaaacagtctcaggcatttaaatttcccacgtacagtactgaaatgataccctcgatgttaaagatgaacatgtggaggtacagaaatactgatcagagtgaatgctgccctttgcaacaacagatcattgaccattcactacaaaattaagttccatcgctaaaattgcagtatccaatgaatagacgcccaaaagtgtgaaatagcctcacagtacagaaagtatgctctacaaccccctgaagaaatgtggtgcatgtctactttcattatctagaatttggaacacttcgtgtggaacgagactttcttggagaatatgtggagtaatgttcagcatgcggccactacattgaaatttctccagcaaattacccttcatgtcgtagtgaaactgccaataagatccatcaaccaagacatcaccctcttgggaaacaatatgaagaaaccaaacatcatcttctactaaacggcgaatctctatcactggcaattcaattcgatacttgtggacccataccatatgcttataatcttgcagaagccaaagatccacctttgatgatccaatatggctgtttgacatggcaaggctaccctcaatctcgagtaatgaggacacattgtgcatcttgaaaggtacatgcaaccaccgaaacgcctcatccagtgtatcgaacaccactatcttgttttgtcgacctgactgtggcaaccagtgcaggtttccatgaaacaggaaaggcttgttgaattcagtatcctctgtcccttttgtcaaccactttctcagggattctgatgatgaatgtggccaaatgcgcctctccttcctggagccaacagtggtgatgtagaatgtacgtcccaaaccaaattctcgatagtacaatactcggtattcggaaggatgtccatgtgcatagagccccacgaccttgtcatgttgaagcgccgggggggagacccaaagccattgacgtgtagtggggttgcagagatgcaaatagttgttgtaggacatgagcaggagaccatcgcaagaagcgtggacggtgaatgggctgtcttcgagtgagcagtcgtaatcttggccagtgaaccgggccagagactggaactggtgtgtgcggaagtcaacggcttcaacacagtagtccaggatatccaggtcatcgtggtgactgcccacgtcgcggatgaaggtgaggaggcgctgtggaggctggcggcggtggtgggtgaggaggaaggcgcggtcggaggtgacgtcccgccaggccttgcagacggcacggcactggaggatggattttggcggcagcaggagcagaatctccgacataatttcttcagggaggctggcaatggtgagaggcctgcgacgctgctgttcgggcagcctcaccgtctccgccattgccattgatcccccagctgacaatttggactaggaccctagtgctgctgcatccttggctccttgccgctctgaaactgaaatgcccaaaaattttccatggaaagagaacacattaggattccagaccgtcaagaactctaaagaaaatacagctcaagatgggtgcttggatctcacatgaatcaatcatctcgttttgtgatccgctattcatcctccctccgaatcgtcagagcaagtgactgatcataactgataaacaaacaagcaattaggactggatctgatcagggaaaaccaaagcctggactgaggctccaactccattccaccagcaaaagtatttaacaccaagaatcacactgaaatgaaaaggaagattaaaacactaatctaaaatacgaagaagcaaactaaactgaatcatgtctgtccctcagaatgcctattctcaacagtgcacatggaattatcgatcgatcggttccttcaacctcacagcatattgcagtggagggagcaccaactgaactgaatcaagtgctcagattactaaactgctcatcactgggacagaacacatgaaaatcttcgctaatcaatcaatcagacatgtacagagacagaaatacaggggcaaactaaaatacaggtaggtagcaatggacagcaagggattggtacttactactccatggccttgagctcgagccaggcgggcgacgggcttccgcttctgctgcttccaagtggaggaggaaatggcgctaagaggccgcgccgccgcgccgcagtggagaggatgagaagaatggaggcggcgccggcgagatgggcacagttaggttagacctaaactagcacctaaacaaaacatatattttttactatgattttacttaaaatttattaaatagctacctcattttcttaagatttcgaaagaccaaaccttatcatctatatgtttctaattatatactccatccgttttaaaatatttgacaccattaactttttagcaaatgtttaaccgttcgtcttattaaaaaaatttatgaaatatgtaaaactatatgtgtatataaaagtatatttaacaatgaatcaaatgatatgaaaataataaataattacttaaattttttgaataagacgaatggtcaaacacgttctaaaaaatcaacggtgtcaaacattttgaaacggatggagtagtttttaaaagtcacaccagctactaccccttatgtcatctccttctttatttacttgcttgatctaccgctatttctattcattcttcttgtaacctttaaaaattagatcttatagtttttaaagtttatagtc

SEQ ID NO: 38184 - DNA, 4508 bp, Oryza sativa
cactatgctcctctatgacccgtttgccgcctactctttattgtcattgtgattctaaaaatcgaacataactatcgttgaaattcattttttattttctagaagacccgtcaaccatcggcggctctgcaactatactctatacaccccgctcgctccttcttctttttattgtcgttgattatcaatggttttttttaactttatagaagtcccggcaactgcctgcttgtttgtttgacggcctgcctgtcgtccctccttttaattgtcattaggattctatttggtgttttattaacagtttttatatatcgtatcaaccgccaccactctactcctttataagcatgttacttaatttatttggtcatgtgttttagatggtcttttctctcaatagtcgttatttttatcccaaatgagttatttataaattatattcctaattgaaatcttatttttctttttataatttcagaatttttttccaaattttaattaataccgtatcgtgttcttttaatatttttattttttatttttaatttcagttgtttcaaaattttattcctacttgaactctcttttaattttctctaattttgaatattattttattttttattctgaattttaattaatctcgtattggattcttatatgaattcttctttcaatattgcttattttcaattccgaattgtagctaattttaaattgtattcctacttgaactcttcttttttttttctaatttcggactttatttttatttttactccgaattttgattacgtattggattcttatatggactcttcttttaatattttttatttttaattccgaatttcagctatcttaaaattgtattcctacttggactatcattttatttttctaattttagatttattttatttttattttgaattttgattaatctcgtattgggttcttgtatggaaacttctttcaatattgcttatttttaatttcgaatttcagctatttttaaattgtatttctacttgaactctcattttcttttctaattttagattttactttatttttattctgaattttgattaatctcgtattgtgttcttatatagactcttcttttaatatttcttatttttaattccgaatttcagctattttaaaattatattcctacctggattatccttttcttttctaattttggattttattttatttttatttcgaattttgattattctcgtattgggtacttatatggaaacttctttcaatattaattatttttaattccgaatttcatctatttttatattgtatttctacttggactctccttttcttttttttcctttttctccgattaatgtgagaatttttatcccccacagcaaacgtggtgcctcttttaaagctgttttaataatataatataatagatagatagataaatgtaggtgggccaagagcccaacaaggaagccgagagcccaaatatgcaaagcccatcatccattgctagcatcttcgtctacctcatcattttctccccaaaattgcaactactagtagaaccctagtccagtgcgacccaaaacccaagctcctcctcacaccattgcagttgcagcatcagtgcaagcaccacccatggcgatggcctccaccctcccgctcctcctcgtgcaccgctccacccctccgactccgaggcccaccgcgccgccgctcctccactcccgccgcctcgccctccctccccgccccgcctcgctcccggcgacaaccgccgtcgtccacccgcgcaagggcgtccgcctctcgaagctccatgccgcctcctgctgcgattccgcctccgccgccggagtcgccgccggaggaggaggtggtggtggtggagcaaaaggagaaatggattggcgtctcctgctggcttggtaaatccaattccgcctcttcctgattcccggtgcctcctgcggccaagcactgacatggtcttgtgcctcgctttttgcaatactcttatctaaatgcaaaattactgaaatgcgccatgatttgcaggtacctgctggctcttgataagcatcccatcaccactaaggctgttacctctgccgtcctaaccctgaccggagacctcatctgccaggtgacttgcagttgttttctatttgccgcattttcacatccatacattgcagcctacttagtactacttaattggttgacgaacaatgaaccagtagtctccctctcttgttgtagagggcttcctattactctgcaatagcacatagccaggcgtgcttagatgggcattagcatcaaatggtcaaatcataccaattttccttcaaaacaacattgaaatgttatccattgctaataccacttggaaatcaatttactgagttatggttcttttctgccctagctgcactcttttagtttccttgttttctaaatatgacatgatgtgaaactcttaactggctaggctgttacggtcttatcaaatttcaggtccatatctttttatccaatcctgtgtcaaccataatctgaatatattgtctttactcaactgtgtcggtctttagcctatgctaatctgtaactcatattatttgattcctcaacggactttactccagcaacagtgtcctattccattattaaaaaacaatgtctattccaactgggttgcatccatggattgggcaaaatatttgatatttcacctgttcttgttattgtggtatcttgttaaggtttcttacgagatatttactgttgccattgtttggtactgctccagctcgcaattgataaagtgccaaagctagatttgaagagaacgtttgtattcacatttttgggactcgtcctggtggggccaacattgcatgtctggtaatcttatttatgctgaacaaccaatgtttatagaggatagcatgtgttctctgcccagtgctgtttgtttcattacttgttgccacatgcaggtacttgtacttgagtaaattagtgatgatcaatggtgcgtcaggtgcaattgctcgcctcttacttgatcaggtatatgcatatccttttcctttcccttctgcccccaaagagagagtgttgctgcttgttctgttctagctcttttatgcatttatgtatttattttttgatatttttttatctcctcctttcagttcattttctctcccattttcattggagtgtttatgagtttactcgtcaccttggagggaaagccttctcttgtagttccaaagctcaagcaggtgacatgaacctcttctgattgattctctcatctccctgataatatgtgtgtgcactcatttactgctagctaattttcagttgtaattttacaggagtggttatcatcagtgattgcaaattggcaattgtggataccttttcagttcttgaatttttactttgtcccacaaaaatttcaggtctttgaaatctttcacattttcatttcatgaaatattttagagtgcaatactgtactctggagctgaatttgcttctttctgtctgctttagcatgactgaatgttgttctcacctagtatactgctaatttttccaggttcttgctgctaattttgtagcccttgcgtggaacgtgattctatcatttaaagctcacaaagaagttactgtgaaataggtaatctgggatggtatatatatatggatatgttatatgatatccttacttcaggctctcatattaatttgttgaggcgggtgtctgatataataacttttccaacaagggtacgttggtgatagtgcatatatataacttatttccttatttatatataggtgatatcaactacatttcattacacgtagttgtaggcattatgaacatctctgagcatacttttatttcctgttgttttcaatttcaccagccatgtgagacactttgacttgttcttgtaaccttgcacaataactctttgccagtgtctcttattcccggacttatttgctgccacccctgaaaacaaccatgtggacttgttatggaattgttgtagcttgacttccccaaagccacacaaaccacctttttgtaccttttgcaatttaaaatgatgttgattggtgctaaaggtgccgtttgttcttttgttactcatgaggaacaaccagtagtgtctctggaggcaaaagaaatggataaagtcaaatgagactgttctttcttgtaattctacatagctagtagcaaaataaatcaataaacccccagcctggattagaatctgattttcttgttgtgtttaaatgttccagcatttctcactcactcattgattagatttatcatttatcagtactaatttttgctctttgcattcgttctaggtttaggcagattcggatttatagttggcgacatggagaagtgtacgtagtggcttgtcgcagctgcagtt

SEQ ID NO: 38185 - DNA, 40394 bp, Oryza sativa
gtaagcaagggtcgctgttgatccagctgagccgacagtgatgtgtttagcatgaacaacacagtattgccttccgttttctgaagatgttgcagcgatgtgtaaaaatgttcatttatgacatgagcatgacgcaatgatggtgtaagcattggggccgggagggaggtcaggtcaggtgggctgtgaggaatcacatgcagtgtagaggtaagggatgctgggtccaaacaaacaaatgagaagtgattgatgaggacggcagcggagaccggagaggaggcaaaccaagcagtcaattgcatcgatcgttgcaagtgcaatggtggtgtcccctcctgcgtggccggccggcggccaacatccatccctttgtcgctctcactgcgtagccatatactccattcgtcctaaaatttttattagatgataaaacataaatattattttatgtgtgattttttttaaaaatattttaaataagacggatgatgaaacgttaggcacggttactcatggctacacatatttacacatattttgggaaggggtagtacgtacgaaaatatgaactacgaacccataagaggagccgcgaattttgactaacagcggcatgctggagtgctggaccatgaattctcctccttgttaattttaaaaaaaatatgctaattctactattattagtaagttattagtagtacggtaaacgacatcgataagtaattaggacagccgttggtttgtattgtactcctatgtgttaacatcgtccaggaacggacccagacttttggcggtttggaccgactgcctgaccatcatctcatcaggaccaggggctgctaagtgctagccagagccacacttgttgatggcacagcacacgtacactgcaaattgaggagaaagaaatcacacgcagactcagtagtcaacagctcgtgcctctgattcttcctctccgttgatatagtcctttccttgtcaacttccctttttgcattgtattttaggggcaatctagaggtagttacttgtaagcaccaaacagctcagctctagatcaagcctacatatgtgtttaacaaatacacttcatatttgttttttcttcccattaagcatgcatgttgattccacacccaatttgtttctttttttttcctttcattttccgccctgcggtgttttatagtactctttacaatgaattatatctatttatactatcacatcaattattaatagtacaattatgttaatatcacttctactaacgatgttactggtagatcaatgtaaagttagttgtgtaacggtggtttttagctggtttttctgtaattaaccgtgacagttgtgtagttttcgggtccgattttttttataaactgggtcaattatcttcttctaaatataaaagtggaacaaagttccgccttaggtttttttaaaaaaagttactcttccgctgaaccttaagttgtgtttagttcacgtcaaaattgaaagtttggttgaaatttgaacgatgtgacagaaaagttgaaaatttatgtatggtcctgtttagttcacaccaaacttcccctaaactttcaactttccatcacatccaaaactttcctacacataaactctcaaaattttttttccaaactaccaactttccccaaacttctccccgatttcagaaactaaacacagccatgtaaaaaagttttgatgtgataaaaaagttagaagtttgaagaaaaacttttggatctaaactcagtcttagtatgcgtgtgcatatatgattgcaatactttatttttctaaaaaaacctggctcgatgattacgatattattattgttgtatctcacaatcaatcttttccaagtactgattctcaaccctgctctgctccaattgaactgttagcttcatcctaacgtatcttactgtctaagcagcatttacatgctactgccccccacagtggtttggtgcattaattaattaattatatagctaaagctgaattaatgcactaagcacctctctaaaatgtactaatataaaaaaacatcttttgttacattttgttcaccaaatgatcagaaaccacatgttcagtgagatggtgctggagcagctctactgttggaaggaggattcatcaaagactcaaaatcaatagaaaagcaagagccaactaatcaaacaaagcaaaagagtttcacaagaacaaaaatcctgcataaattaagaaccttgaggctgatgcagtgatgctggaatcagcagaaggaagatcaaaacgaacttaacagtcgcacttaataattaaaagaaaaggaactctaaattaagtaagatcaataaaataacactactgataaaaaaaatcatccatgtgtatacgaggcataagcttaaaattaacaaggacacgaacagagaatcaggtagatagatgctccaacctgttcattgatctcgtcttagttaattacagccatgaagaatcagaaatcgatagaaatcgacaatatatgatctagatttacaggagatcccatgagtccaaggtggggaagccaccaccacagttgccgctgctgctactgctgctaatgctattgttgttgctgccgtaattacccgctcctcctcttaccaacgccaccgactcgtcgcacggcggcgccgcggccgccggctccgcgcggcggccgagcaggaacgccgaggtgtcgagcgtgggaagcatcagcgcgcctgcagcgccgggcgagcccgctggagcggcgtgcacggccgggaggaggagctccgtcgtctgctgtagagagagcgatggaggagggggagggaggtcgtcggcgccggtgacctggtgcaccatgcggcggaagtttgccgggtcggcgctgatgtaggtggtgggaaggcgccgcgacgggcgcggtcggcgcttggcgatgcggcggcggccgggggcggcggcggcggcgcggaagtggtggtggagagtggcggcggcgggcggcggcggcggcgggggaggcatgaggtcgggaggaagccaaggggaggaggaggtggaggagtcgagcatgtgcatggcggcggtgagcatcgacgatgggtggatgctctgctgcgagtgttgcgcgcggcgaacttgactggggatggacggacacttcaggggagacgagggggtggcctatatatggacaactttttttgttatttttatttatttttcaaataaatttagaaataaccccttgatatttttcttcttaagaaatgaatcttttaggtatggtttggataccaatatcagtgttcaataaattaatataaatataatgataaattatgtcatcaaagtttcatatgcaaatagatttagaaaataatagtaattagagagaaaaaaatgattatcatgaaaaaaaaactcatctgtctttactctttcttacatgaaaatgatacatgtaaaaaaaaaaacttgcaaactctttataaaaactacgtggcaaattgtgacttcattttgacttttattaactaccaatcggctagatcagatggttgagatcttcctttgtaagagttttgaaaaaaaaagtatatataaccttacttttccttaaaattattagggtttaaccttatttaggaaaagagagatacatggccagtatttaaaattgagcagaggtgcctaaacataaaaattgtatgttcaattccaccatcttggtttaatgaaccacaacaatccaaaccccgtttgaaccaagttgatcgatgatgtagcactccatgtaggcaataattttgcatccaccctcctccatgtcatggcgtgacggtaattttgcttttagacccctacacggaatccccccaaatccctcccattctcccccgaagcgaaggttgcaagggagagtggcaagtgggtgggcgacattaccctcgccgtcaaaactctaaccatcggggagaaggtgatggaggtagagatttagagggtttggggtgctttggggtagtactatatgtggagggggccacgctatgacacggaggagagcgaatgcaaaattgttgtttgcgtggagcgccatgtcaacagtgagttcccgtcaaacgaggtttggacttgttgtggttcattaaaccaagctgatgcatttaaacgtgcaattttgaaattttaattttagttgacctaagtgacaactccacccaagtttaagaatcaatatatatattactcgtagaaagacaaacttttaaaaatgaaattcatatatagatggggatttggcatcaaattatttgtttctgaagcaaaacaatcttttggttgcctcattaggtgttgaaacgtgatttaattttgcttcaaccacaagtgatcatattacaagagtttggtatgttgttggactaatccacaacatgacaacaacgatatgattgcattcagctctgatatcaccagctaattaacgagtgaaaagagagagtgatcgatgatatgtgtccttagttgcctacaaatatagtactacgtacatgcttatttgtacctaacttaataattactaattattaatgaactgaaatcctagctagtcctatactaatcgtttcaggaatttcaaacacgatctaatcgctcctcagatagtacaatatggacggatcatcaactgcgtacaatgtgcatatatgaggtcaatttgattggagaatacacatgtaccattgaacgacaatacaaacaaattaagaacatgtgcttacgtacgtacgtacacgtagacgtacagaatttgcgaatcaaaattgaccaattaaactaggtgtgatctcgcgtgcatgcaagctaagaagctagtgctagagatttcaactaattttctcaacgctaactaactgactaacgcacgctcgtgcccatagttttgatgtgtcgtcagatcagaatcgcgtgcccctgttctaaactacgtacagagtacatggtgatatgatatttcgttcaattcaaacattgattcattacattatatatattttcccaattcaactgtttaattaattaggttaattttgaccgtgtttatatataacggccagtactaactagtacatctcatacatgcaattaacctaattaaatcttgacctggcatgaatcagagtaagcgcagaaaaagaatgaaatggacgctttcagtttcagcaatatttcgaaatcaaattatgtaacattaatccatcatttttcttgtacagaaaccaacaaaggaaggtttagcaagctcatttctttgcgttgtttatgttgttggcaaatgtgaaaatggttgggtgtaagctgagacttttcatcaccaggtcaatgtcaggtacttgcaggctgttggctttgcggcttgcttgactcctcttttgagttttgaatagctcgtgctgttggacaatactactcctacatcgtcaagtcacgcacacatgtgagtagtatcctcaaatcgttttggactgcttaagtcatgcattaccgttaattacagcgttcttctccttcatccttttttctttaattctgcttggatttatcgatttgtaatcgctagcttaatttcaagttgtgttcttcctggccacttccttgggcagagttgttgcaaacactataatttaatttcgatagcatagtcttactagtagcaaatatgccacagctagtgtatgttctgaatcattcggttgtgctgaaacagtggcatgctccaaatgcatgcaagagattgtggctggactttcactgttatacatgtcagacgggtgtttggtcgatcatatatgttgccgtttcttcagtaatccaatggacaaggaaattaagaacgcgatcgatcaatgagccccttttgcttttggagtcaaacagtcaaaaccagagaaaatttcatggtgccgacctttagaatggtgatgacgctctagtgctacatcagtcagctgattaaggtgtgtttgaggagaaggggattgaggagattggggagatacgcaaaacgaggtgagtcattaactcatgattaattgagtattaactattttaaatttcaaaaatggattaatatgatttttaaagcaactttcctatagaaattttttgcaaaaaacgcaccgtttagtagtttgaaaagcgtgcacgtggaaaacgataatcaatctcccctatctcctcataacgaacagagcctaaagagttctttctgtcttgtctgtctagattgatccttctttttctgaaaatttgactggaggcatgcattttctgaaactttaaaagttctttctgctacatcagtactgtcttgactgtctagaatgatgatgatgtaatgctaatcaaaattgaggttcaggcaacttggaatactggctggaatcattgatcaaaattatggaagaacctgactctagtctagcatacagtattcagagaggaaattcaacagttggtagtagtatactacatctcgaacgtgtagtgcgaggaagtgcgaggacaaatggtctgcactgcagtgctgcacctgctgaaatctgaagcaaaaacggagccacgtacgtacgtgtatcaactggtgaagtcaagtaaaaaaatgtctttgttaggccgtcagcttcctgagctcaccatacaacacgctactgtctcaagtgaagagagtcaactaatacgtgagtcaaatggccggttcctgcctgttttgatcgattggttcggatgtctctttcacttctccatgattcaagatggcacacatgcatgatcattaattagcagctagcattacgtggacaatttgcttcaagatgcattccgttttcgcgttgctttgccaaaacgtaatgcaatcactctacctgtttctgttatgaacagtagtgtgtgactgtacttgttccatcccttgctgtttgtgtttctgtcaggatacagagcaagttctgaatcacattggtactgaagctatgaatgaattggtccccccaactgaatagcagatgagatgagagagaccatacataagaagtctagttgattgtccttgttaggcttactgatccactgcgtaacaggagtagtccactttcaatttccacacacctgcttagtctagctcatgaagcacacacagcaccggcaaattgtgtctgaccataagctaatcgggcactacaagttgcagccgttccaagtgactttcatggtccgagactccaaatttcttccagagtctgaatatttctgaatatcaatggatatgtctgtaataaactgtcactgccacctgacctgcaagaaacaagatccagaacatcgaattcagaaggcagagcgcggatatatatagttcgcaagtagcacgatagaaatcagaattcagaatcctcgggtgcctgtgaaatcctctcaaagcggagacgtcttgtggcggcgatcaaacatgatggaattgataaacagaggggttcggagaagaaaactccgaactccttaggatctccgtgagacgtccgattaagaatatgcggcacagattagagacactccttcgtatcacttctttttttgggccttcaaaatctgggcagcccgacccatatttatgggcttttgggccttaatctgaatgtttaaacgggccaactttgcgaaacgggtcatatgctgtgggcccgacccaaactggctacccaacaagcgagcggcggcgccgccgccttcgctctcaactccggcggccggcgcaactccggcggcgaagacggtgcgggcggagccacggaggtggacgccgcacgtggatggattcaacggaaacgtaatgcgaggaggtcaaggagaagtttcatctcgattctcccctctcctcgacccgagatttccgcccctctgctggttgcttccattggagtgcccctgccgcgcatcaggtaaagactcttctttctcctcctcttcctccgcctctcggttccaatgtaccatagatttgacaataggcgttccgcacttgagttgctcgtgggatttattgaggaaattaggacactgaggagggcactagattcagttccggtaaagttccaaaattcggtggctccagtgactcagtgagtccctcgctccgccatgtgctgctgctttggttcagttttttttttttgacatgatgctttggctcgtcagattctcctagtgccacccgactgaaatcgcatgaattcactgccgaatttacaggttttggtcacaatttcgcaggtgtttccatggcagcaagattgggttcagtaacactggcaaaatgcgcaaatgagactgttacatatggaggtaaaatctgtttctttgacctgcataaggtgtgtcaatgtttggagtccacaaagtgaacccacatagtacagatgtacgacaaattgtttacttacaacttttgtggtccataaacgtgctttctttattgtacagctgatcactaaaatgagctgagttgtgttgtccctttttctttctttatcactattcacttgtgctttttttaagaaaattatagcagtcgcatgcattgatccatacaggctttctccccacagaaaaaagttgagcacattatgtgctatcattgtacttgtcccgtgcttatgagaacatgttcaaaggaagagctaagcttgcgcctgtaaattcagcttggaagctgaaaacaagatggatgagcttctacgggtacagagggagcttctacgatttcagtgactgctatccaagcatttccaccgatggggaaatactgacatctaacttgtttcaggcacagtaatagctttgacaggtctggtaaaatagccagattctagagggagtgaagactgtgtgcaacgaatgaggtgaaacttaaaagtgagagtgacagctaaagataccaagattgctctccactttccctacaaaacttctctctcatggcggtactccaaagcaaagaatcctagaaaaaaagggcgcaagcacagcactgcagcttcctatctcctttatttggtcttccattgcttcttgttgctgaggttgccttcctattgcccccttcccttttccactcttctaccaacacttgcttcaggctactgagggctttggcttctcggtgttgtcgctacaggtgagcttggcattctgtgcatttttgcgttctactgctaatctggtcttgtgctaagctccactattagcctcttgtgtggtcataggtggctcctaatttagcttcttgtgtgaatctgatcgtccaatctttttctaaatgatctgtaaattcgctttgattttggtctgattagattattttgtttatttctttgttactttcctctcttttatgggttgatagtatacaattatagcccaaaaatactgttgaattcagagatcttcattgtgataactgactgaacatttaaagagatggtgcttttccacctacctgttgaatgttaaaccattgcagatgatttttttttttgaacatgcaatttctatagatctctaactaaggaagctggaatgtcaccttatttgagcagtttgattgtattgcacattattaaacttgtgtttcaagtataaatctttttttttttcgccgggctggcgtaagatacgcggctgaagtttattaagattgggaagaggttcaaactagtacaacaattacagctgccatggaggctaagagctgtacggccgctattgttcaagtataaatctttacttgtttgaatattcaccataatgttatagtgatgaattgcttctctctttcctatttccaggccaacgttttatctgagggtaaaattcaagaagatatatatggcttttggtgcaaatgacattgtgttgcatatcaagagactaatgtattcatctgtcagaattggatatcaatttgcttgtgattaccctatagtactagctgctggcgttttgttgctgtttctacacaggctttgcccttctctattcaacttcttgctgtcttcatctccagtcttcctgttaactgcacttctgcttggagcacttttgagttatggtgaacctgctgttcttgttcttggagagaatcaacaaactttgtcctttaaatccaagatttccattactgactgttcgattgacaaggttgagactgttgctgtcgaggagcacttggataaaacaactaccagtaatgaagtatatgtcagggaaagaaattttgagggtaatatacatgacactcactgggaagagaaaaatggcacctacatgacagttgatactgctctaaatgaggaaatacatacgaaggatggaacttctgattatgatttgcaggatacccaccgtgaaggaaaaggtatcacatcagtggaaactgatactgttccttgtgtggcgccttcaagttttgcctacagtggtgtaactgtggaaactgaagacgttggggagaacagcaagaagaatgatgagctgcaagaacttggaagcatcaatcctgaaagtgataacaataaagtacaatatcaatatcagttaggtgagtttatgagttcatgttgggaacctgttatgagacaggagccacaggatgcttgttctgattctgaatctgatcttactgagagttctcctgatgcatcaatgactgacattattccaatgcttgaagagttgcacccattaatagacttgcaaactggccacccttcattggtctccagagacaacttgaatacttcttcggatgatgatgaagatgatcttgaggaggaggatgctagcacagatgaaaatcaattggaagggaaaatagatgattttgctaactggaaggatgttattgatctaaattacttggatatggacaataatagcaagctggagggtatgatggatctgcaaagagcaaagaacattctgaaatttgaacttgacaagaggttaatggacttgcaagcagctgatgcagtacagaaaatggaggaggcatcacgcttccgtgtgcaggttccctccatttccactggaaggcagaacccatttgattcttcaaatggctcagatgaaataatcgagttaccacatgttcctgattcagcaccgtcttgtctccttccacggaaaaatctatttgatcttgcagtcaaccaaaatatggcccatgatagtccattgcaagaaacttggactcctctttcgtacttttcagcaagacggcatagaaagcatggaaacttatatgttaggcactctactagcctgcatcacaatagcttcaaactggagaaagatgaaataagtgaaaatgatgcccataaatcccataatagtcagtcagacggtgatgccaagcaagaaaggaacaacagcacgttatttggttcactggaagcacatataggcgaagaaatcaaaatattaggcatggcaatttcagaggtgggtgtattagaagtaaattctggaatggttagcagtaaccaaaatgctgatttcagtgatgatatcagttcatctcctttccagaagcctagacaaagcactttcgaagctaaggatacagtacatgcaggtaaaactgttttttaaccctaagttatgtattgcaattttcctactggaaatgataactcaactgaagttgatgtcatgcaggtattgagcaattaacatcgtgttccccttacaaggtaaataattttgaggcacatattgttgaagcagactccattgatgaatttaactcattgtttaagtgtcgtatggaggaagtactagtgcaatccatctcaaagtccagtatcagtcaacccttgacagttaaacttgaagatgaattgagtgaaccattatctccagattctgggactgggacacatttcattgacgggagttcagttgaagattcggatccacgatttgcacagctcaatgatgaagcactggtatcttctacttctaacgcaacatgtcgtaatgagtcaattgaagagaaatcaagtgaagcattactggcaggaaacgaagattattcagaactgccaaatgaactgttaaaatcaggagatccacagactgcagatagttctgagattcaagtgcaggttattgatgctacaggtcactgaatgatgagacaagggcctaaaacaaggccaaacagccaatttctcagagagatctgtaaagcatagatagtccagtattagctctctgaacaggtttcttgcccccctttgttccaacttgctctatggcgtctggatttaacttttcctcttcttaatacaaaatgtgcagcaatcatgctgtttttcttcaaaaaacttttctcaggaagtccgtaatgtcagaaatatccaaggaacaatggatgtccatatggtttctgcttgtttcttctcttttgtttatgcttatttggtttcggttttgcgctaataggttagctatgagagtagatgatattgatatgaaacaccagttgcagttgcggtgtgatatccagttagtcaagacgatctttctgtcgctgcctatggcatagtttttcttgtctgccagactggcattggcaacccctgatggtaaaccgctggactggagttgcagcttctgcagtttgctccttcaacagttatccagtcagtaattaagtaatcaagtaatgcttccatagatttacctcctcatgcttatctgcttgttgtttgtggtttcgttaagaaaatcacagttccttagttaaaaaaaattcatagttcattacattacattacatgcatgatgtttatgttgggtataccgatctggatctgaggcgtgttttgttgggaaaattgaagatacgctactccccaggaacctttttcaggaaatcactcctttagcttgactttgctaaaatggattgtttgcatgatactaaaaaatacatgaatctttggtgtagaatcgcattgatgaataaatctatttttttttcatctgtttatagaaccatatcttacagatgagagcgtggcattcttcgactgttattctgttaaacaaataaaaaaattaaatatgtactgaacatagggtcaaacatttgacaactagccaacacacaggaatatcattattttcaaaatcacttcaaagttgaccaagacaccttcagcagtacacgggggccaccaagcttaagctctttcatgtcatatccatgtcttctagctttgaatggacaattttcagagacacgatacgagccatctccctgatcaaccttgaagaccaatggacagtattcagggatatcataatccgagccatccctatgaacagccttgaagattaaaaacaaaggtgtattctccaccacagcaactacaaacctattcaggtcacatggcttggaaatgacaccatcaaagagccgaatcttttcaggaatttgaccaatataggaatataaagataagctgaagccattgccatgcacttgtgatatgctaacttgtattgtggcctccactgcttcgtggaaaagggctcgactaatgtcgaccgcaccacaatcaccctcaatccgttgcgtaaacactctagatcacatttagatttgtactaggtcttaaatctcccatgtgtgcaattcgttgtgcgtgcaatcatgcaaatgtatcattgtctgttgcttcccccattcccaacttctttagtcatctcatatatccaatgtttgttcacattgactaatgttttctcggtttggagatttctgaggatttgagaggtcaacgcattgctttctcttagtgtttttgtttgctctttgtcattttgaaggtctgctcatgtttgacagagagggcacaagaataggtcactgtcactttcattggaagtttagagagatggaatggtgtaggagaaatggatgtttctcctaattcataatttcttactgtgcttatactccaaatttacagtccatagtatttgtaacttgtatttacttaactacaaattcatcatgcctaatgaattgtaagaggccaaaattttggatttatcttcttttgcgcaatgcgagtaatgtgaatacttgtcctttttgatcgcttgcagactgtttttgtttttgaagaaaggcagactgttattgttatgtgtatgtattgcagtccatctctgtctctttgattaatactgaggaaagttcactaatctccatgtcggttgattacttatcaaactaactaggttgttaatacatggttttgtactttgcaggagcagcaatgtgatacagtggaacatcagttgcagttcctcggcctcactgtgaagaaacaatccctgcataagtctccgacgacgacgacgacgaggacaagaggaaagagcgtaatgagtcaccgtgacgcaactctgttcagctccgatgtcgcgagccttgctgccccaaacttcctattagatggcgtgattaactttgtgatggcgcacatgacaaccgagttgggtgatgagagccttctcctggtgtcgccatccgtggcttctctgctggcgaacttgcaagactatgagcctgagactgtcgctgatacagcccaggcactgttactggcatctcgcaggatggtgttattcccggtgaacaacagcgagaggttggacaaggccgacgatgggtcacactggagtcttcttgtgctggacaacatcaccggccgcttcgtccaccacgacagtatggacggcgccaatctgccggcggcaacccgcctcgccgacgcgctccggccactgctcccggcgccaccgcagggaccgcccatctcaggcccgacaccgcagcagagcaatgggtacgattgcggcgtctacctgttggcagttgccctggccatctgccggtggtggaagaagcatccaaggacagaagaagcggcgccctgctggtttgagtcggtgatggatcaagtaagtgctgagagcgtcgcagccatgagactcaacttggcccaaaagatcaacttggagctcattaagcaaggagacacaaccccctcctcgtcttggcctagcagcagcagcagcagcagacagtaaactgattagatagcgctatctcattcattacacagttcctctctgacttagccttgcttaatctcttagatagctggttcagtaaactgagctgaacacttagtaactccagtctctgtccctgtcagtttttattgtctggcagattggcattggcaatccctcaccactttactactatttcagtaaacataagatgattggatgtctgttgcctgttagtaaaccgctggactggagttgcagcttctgcggtttgcttcttcaacggttgtcctggcaataattcagtaatcaagcgatgctttcataaattctttttttttcttttctacaccccctcatgctcattatctgcttgctgtaatgctgttggtggtctcatttttgtaatgttgttggtggactcatttttgttttaggtaacatgcgaaaggttcacacgtctttgtattaaggagtagaacttgtttagttacaagatgccaaactgttcggacacttggccgaccaaaatacaaagaggaaaaaaatatcattacaaacagatggcaaaaaaaagttttattcatcaatgcgatgctacaccgaagattcatctattatttattatcatgcaaacaatccattttagcaaagtcaagctgaaggagtgacgtcctgaaaatgattccaggggagtagcatatcttcaattttcccaacaaaacgcgccccagaagcagatcagtattacctaacataagcatcactatttcacacgcagacacaatgacggaacaaattaatggatgatcccttttctcttcggcactcttgcaagagtatattgtgtaagttaaacattagaattccacaagagttgcatccaaaacatttggtaaattcaggtagcaataccaaatttaatctgcattaatatgcaataaataagaacagataagagtgtggcatccttcacctgtcgaacttctacaacaaataaaaaacttaaatatgtactcaaaataaggcccaaacatttgcctactagtcaatacacagaaatatcgctatttctgcttagcatagattatgtataccccaggaatattcaaaatcacttcaaagttgaccaagacaccttcaacagtacacgggcgccaccaagtttaagctctttcatgtcatatccatgtcttctagctttgaatggacaatattcagagacacgatacgagccatccccctgatcaaccttgaagaccaatggacagtatttagggatatcataatccgagccatccctatgaacagccctgaagattaaaaacaaaggtgtattctccaccacagcaactaccctattcaggtcacatggcttggaaatgacaccatcaaagagccgaatcttttcagggattcgactggtataagaatataaagataagctcaagccattgacatgcacttgtgatatgctaacttgtattgtggcctccactgcttcgtgaaaaagggctcgactaatgtcgaccgcaccacaatcaccctcaatccgttgcgtaaacactctatcgggaagcacgaattcgctgcagataatggcaccatcgatgagctgaaaatcatcgtcttgtgtctctccgttcttgatcttcatgtcgaactcgatgagcacacgaacttggtttccaatgcctctcttggggcctgacattggtatcaatgaattatccgaatcaacgccattgtcttgccccatgatgaaagggtcatccctggtgcggttgaagatgtagttgcgtagcgggtccaaatgatcccggacagcaaagtatccatacaagtgaactgggccatcaacagcagcagtgatattggatagcttgagcgagaatatctgcatcatgaattgcacactgtgcgccttgcaagcccacatgtgtggccggcaattggttgggtttgacagcatcattgcctccatacgagctgaacagccatacacatcagtggatgattagaagttagattgttaaccccaatattgaaatgagcaggaaagaaacaaatagatacgaataaggtttaaaacagcaaactccacactatcatggacccaaagcaagatataccatatcctagatggtgcctttaagagttttttgaagtagtacttaaggaatatctagtgttacttagaactagattatgttatgaaaggtctaaatttgacatcaagctagacagatatgttatgaaaaaaagggtttaatttgacatcagttccatagtactgagcatacacaagaacaaattagattttattattattattattattttgccgtgctgaccaaagacccctcagtccaaatttccttacgatgtacaaatttacaagtttagaattccaacaagaagatgtcgaaactgaatggagtatgccggagcgccctcccaaaaccaaaataaaagggattgcatctctattctttaaagactcctgcttccttccagattgcgacctcttctttgattgcacccaagaggctgcccgcctcctggggaacaaattaggtgacacagcaatatagtataaaattgaagttaaaagagcatgaattaaatagcatcgatctgaggtgctaccaagtgaagctaaattgaaagggaactaattaagggcagatgagaggattgtagatgatgcaaagttaaaattgaaaaggaactaattaaggagatgagaggatggtaggtgatgcatggtggagaggggaaaaagctagggtttgcaagaagttaaaagttaaaacttactctctcgggtatcggcgacttgtaaaatctgtgccaaaaatcgtcgccgctgtagatcgatccatcgctatgtttgctgcactcgaggatgaacgcgcgattcaccccgtcctgactacctgctgctcgcctcccattcttctccgcctccgcctccgcctccgcttccgcttccgcctccaccagctcaagctcggactctgcccgccgcttcgccatgacatcccctcgcgattccacccggcctcaagctcgatctctctcgtttgcttcatcttctccctcctcctccacccgggttttattttgatttttgcggcaacaaatccgaaaccgattcgtattgaagaaaaagaatacgattcttatatcctctcaaataaatactactactagcagtcaaaatcgatatgggctgatttatgggcctgtatatgggccgtacggccatctaccggtaaggcccataaaagatgagccttcatccctaacctccggtcgactccttgatgctgcgcctcgcgatcgagcggctccagccctaaatagcctctccctgtctcagaatcataaatcattccatcccccttcatggctaccttgctgggatcaggagtctgctgattggattgggctgcggacctgcggtggagggattcagggtttctcttgtccctgatccactgcctccacgtccaacaatggaggacaacgttcttgtctcctcgaaaatccatggaaggtgactcccaactcatgcacctttttctttatttgcttgtgattttaatacgatatggaatctaaacaaaggcccccgcaaaaaataaataaatagagaatctaaagaaaggcatccttacatggcagaattccatcacattatatgcttatattcatttatttgtgtactgttactactaataataatgcaaaataccctctgacatatgtgttattttgctaaaaaaaaagtttcaagaagtcaattctgtgtgctacttaaaacttctgaaagaagtatcattgcatactggcagagcatgctgattgttggtttcaggagtaagagcacaacagccaaaaggaattgtataatttgcggacaacgtattagtaagaggagaagaacacaacataattttcagaagataagtcgggggcagctaatttacagaggacaagaccatgtctgcttaattttcagtctcttcccgaggtatgtcatatcatgacatgaagtcatgaaactctcaactccttttgtgctaggactaggaggctgtattctgatgcttgttcaaaatgcattgtcaggatattgtactaagggtaatatcaaaattaacattaaaggaagtcgctcggttgagtgttgtgtcaacaaactggagacaggcttggacattccatcctaatctgtactttggtattaaaacagtccttggaaataatgccaagagaaaaggaacaagctctgatctgaactgtagaatatcaagtgctaacaagttcattaaaagggttgatgctattctggaaaaacattgtggaacaatggtaaataagtttgctgttaagtttggtttgtcaaatgagcatgctaaccatgtcaatggctgggttgcgtttgctattgcatcaaaggcaagggttatcattcttgacttctccccagattggaaatcacatgaaaacaactatgactttccttgtcatattttcgacaaacataatggatcttaccttgaggctcttcggcttgacagtgttactttgaatccacctctagatttctgcggatttgcaaaccttaaactgcttgctcttgacaatgttaggttgcaacatttagagcagttaatatcgaaatgccatgttctagagtggttaagcatccaatcatgtaaccagctgcataatttacatgtgtcggaaccattatgccgtctgcaatgtttgtcaattcagggttgtcatttacaaagaatggagttacatgctccgaatctcacaacatttgagtacgacggttccctggcattggtaacgctcaatgaatgctccaatatcaaagcatcaaccatcagactttttgatgagaaaaccctccaaaatatattaactggaattccaagtgtattacctcatgttgaaacgttatacgttgaagttaatgtcaaaactcaggtctgattattcttgtactctctatatacatttaattctatttgattttctgtttcacatcttgttgtttgaacctatgtgtggcctggtcaccctccagatgtctggatttacacaatcgcctctcaagttcactcaattgaagtgtaactttggaaataacttttgagagaggttcattcgatagaaattcagtctccagttggcttatcttttcgtagcagctccatttttggaggatctttatttggatgtaagtagctatatcatttgtgttaagaatatatgtattagtgtgtatgtgttaaggggtatttctgtctttttgcgttgtactcttctcaacatattagcccttagggccaactcaatggatgaacagtttaatccccaatttcattatagaattcacatggtatcagagcctctctccaaaccctagctgccaaatcgccggcgagccatcgttgtcgtcgttcatcctcgtccatcagtcagtcgtcgtcttcgtctccaagcagcaagcccgcggctcgtcgtcgtcaccgcgttcccattcgccggtcgcagccgccgtccgttgcggcgccgcgcccgcttctccaccatccactctcgctgccacgcccgtcgcgtcgcttatccacgccgctcgtccccaccattcttcaggtcgcggagcgtgtcctagctgccggcggcaagccgccgccgtcgtccgcaacggctccagttttggccgggcgtccttgcaccgaggtcatcgctgctcgtctccattgctgggcagcatggccgttgtggttgtctgcttgtcgcccagccgcatgaggcttcgggagagtccttcgtgagcaaagcagcagaaagctagaaacccatctatggatcatctccctgtcggagctggtcctcatcatcatcagctccccgtcggagctggccttcattgtcacttcatcatctccacatcggagcttctcatcatcatcatcaatcagtgaaggtccgaagaacagtttgtgaagggccttcatcaacatcaatgtctcatcatcagtcaaaggaccgaagaacaatttgtgaaggtctattgtcatcatcatcaacaacatctctgaatcaatgaagagccgaagaacggttcgtgaaggcttcaaggtatcgagggccgaagaacagtttgtgaaggctccaaggtccacttcattgaggaggggatacatcttttcttctccatcatccaagaattggcacacttcgacgatatcatcaagactttggagataggctaatatttagtttgtgttctcttgtttagttttcactccaaatgcaatgttattgtatacacattgcatttgagtgggggtgttaagaatatatgtattagtgtgtatgtgttaaggggtatttctgtctttttgcgttgtactcttctcaacatattagcccttagggccaactcaatggatgaacagttgaatccccaatttcattctagaattcacaatttgtacttcactacttttattgccttcttccctagccagttacagttcgccttttgtattctcattgaccgattacctcttttttcctatttaatgttatttcattggtttggaaacccaatcagaataacctgctaagccagtactgtcaatctaattaggaattacctgcttgtccaatgtgccctatgcatgatccatgaactcataagtcccagaaactggaacattcgctgcagactattgatcctttttaacgatcatcagaccatcgaacatagctttggcaaagtaatattgttcggcccggcgaaagtagtattgttcagcattagttggcaactgcatttttttccatttgacagtggactttgtaaattttaatcataattatttgggacatctgtagaagcttttgctatatcgatatcactgtttaccctgatcatcacatcaccatatttatgcactgtacaagataccaaatagtatgaatcaaggtgataatatgtttggaaaccgattagccatgtgtttccttgattgaatatattcgtatccaaacagagcaaaagcttcttttttctaacaaaatctcagaattccatcccccgcatttgttttgacaagatatacaggctatccttctccttctcttcctcgatcatgaatctttgatcttcttttccctaattattacgtgttagctttgctccttgttaatgatgacataaatttcttgcagatgtattgtagcttgaacaggtgccctttggatttggatgacatcgtggatcagcctcactatcatctcaagatggtgtgcatatttggattttgtggcaacacaggccaggtggagctagcaaaatacattctcagaaatgcgttaatattggagcaaatgatcatcgaccgaaaagggagatatcggttggatggatgttttgggcgcgaggaggcagatgagaagcttgttccagaagatatggatggtgtactcacaattctgtaacttatactccgtacagtagcaaacaacagtcacaagttaaagtgttgttccttcaaggcactagtaactaggattaagtttttttttaacagagtttacagagattattcggtactgcaagagttgtggttcactgttcaatacgattatattagtatgtatcccttccgattaaaaatgtttgacatttaggaccatatttagttgcatttttaaaaatctagacatcaataatttgtcaaatgcttagttttcaaaatgatatacgtagatttgtctcataatattataaacttattggattatataaacttattctggtgtaaaatagattgccaaaatttttaaagtgtggctgaagtttgtgctaaacattaaactacttgagaaagtatgcactattcatatgttacaatgagttttaatctccaacccatggaccattttttttaagcttcaattcaaaggatgccaaggggttgggagttttaatctccgtcccccaagggactattttttctttccccaagatcgagttttttttaatgtagttttgtgcaaacacatgtggatagttttgaactactagtatattacatagtaggaaataattgattactatggaagtattcttcacagacacaaaaagcttcagttttcacacatgtacaacacatgattgtttagactagcaatgcatataagaaaaataattacttcctcgaatatgcggatatcttaagttggatatagtagaatactagaatagataaacatctcatcttacgcagagaagtgcaagataacaagcacattcagacaggatcatataaaaattaggtacagtatgaggcaccttgagaaaaatcagtgctagaacggaacgttctctttcagatgattacaatctacggagtagcttgtacctaattccgtagtaaacccccataatatttgactctttcattcacattcatcatcgaacccacgctattcatttccttgatcaaattatcacaccaactcctgcaggacataagtaaataaagtagcaccttgtcttaaaataatactactccacctttgaatctcataaatgaataaacggagaaatagaaaaaaagtctggattctaatagtaatgcaagtgcaaagcaagtgatcgaaaacacaggaaaagcatagaaataaccgttgattggacagctagaaaaatacaggaattggatgagagagatagactcaaagaaaaatttccaagagattatccatttcataggaatttaaaaggatatgataggatatgatttaatattttgtttcaaaagcattcataggaaatttttctatatggttgaaatcctccaaagttcttatgtttttcctccaaattaaaaggaccctaagcatttttagtatttaaaatttgtaccacaatatactttctttattttagaatataagtatttctactatttaaatttcatatacaatataagcatttccaggtactacttcagaattcagatacacggaaagctaagtatttttagtcacttaggtaattaggaaggggggctaagcaattcacaaaatcaaccaatgagacaactgagagggaatatttatcctttagcttactctttactaaataaactaaaaatatgtgtcctttgcagtaagtttaataatataatcaactattagcttcaaaaattgaaacatcatctaccaactcatatactacataattgtaatatatattacatcaataatacataatccatccatctccgtcacatagtttattgaagccagtcgtgtagttggctacaaatctagtccgcttttcttttttcttctgtcctcccttcttcacgtaagtacaaatctgatgtggcaacttttacatcccgcttacgtcactatgtaccaatgcataaaaattcatgcattttcaaccaatcaaatgcttgggaggagaatctaaataatttaatattttaccactactttaatggaaaggaaatctttttacttaacctttataagattttctaaacaacctaaaaatactcatattttaggacgtagggagtactattctctctctttttttaatgtctgatgtcgttgatttttgacatgacgtttgaccattcttattattaaaaaaattatgtaaatatttgttatgatttgttttgtcaccaaagaaatcttaacttctaattttacatatttacactaaaacttttaatatagtcaaacgttatacgaaaaagcaacggtggcatacataaaaaaagagtactaactatcaatagaaaaaaagatagtgaaattatttaatagtaccagagtatgaacaggatatcgtgagatttatctttataaaagaaaaaaaataaaaagaataccgtcagatgaccgtttcccgcgtgtttgtctgtttgttctcttctcacgcgttctacgctacgcgggcagcatatatatccggcaagcaagcgaccactcccactcgcacgccacgccactcggtcactcttcatttcgtcgaacaccttgcctcacaaccaccccccatggccgaccggcgtccaccccatgcccgctccaccgccgccgtcctcctcccctccgccgggacacaacgccgccgcgccacggagaccacgccgctgcatcccagcttccgcggcgcgccgccgccgtctccgggcacgtacatcatccaaatccccaaggaccaggtcctccgcgtcccgccgccggaccgcgcgcgccgctacaagaagctcgcggcgcggcccgcacgccgccgccggctccgccacgcgtgctgcggcgccttctgcggggtcctcctcctgctcctcctcgccgccgccttcgtcggcgtcgtctacctcgtcttccgccccctcgcgccgtccttctccgtcgcctccctctccatccgcggcctcgacgccctcgccgtgtcgtcgttaactccgcagatcgacgccgccgtgcgcgcggacaacggcgccaacaagaagaccggcatcgactaccgcggcggcggggaggtgaccgtctcctactccggcgagcggctcgccgccggcccgtggcccgcgttccaccaggcgccgaggaacgtgacggtgttctcgacggcgttggccggaggaggcgtgagcctcacggaggagcagaggaagcagctcgccgcggatcaggccgccggcgcggtgcccctggctgtggacgcgatcgtgccggtgaggttgaggttcgggaaggtgctccggacgtggacggtggacgtgaaggcgaggtgcgaggtgacggtgaacaagctggcggcggcgccggcgaacagggggtgcatggtcaaggtccggccgctctggtggtggtggtgatcgccggcggcggcggcgccgccgctgatggttggatgggtagtacattaacggctacagcctagtatagctagtaacagctgtgcattgaacagagagatattacagtacttattatacctgtgaattgaattaatttcataattagtgtccaattttggggtgcatttcaagctgttgatgaggggattagtggattaccaccagtgtagcattttgcatacttgcagttgcagatgtaattggtgaaatacagatggttttctctgttttctgtttgtgcgaatgaagaatgaattaatcggatatttactcagtttcagatgtaactgatgaagttgtggttacagataagtgtctgttattattgtacaaaataagcgtaaatttgatcatatctttgatcttgctctaccaaaatggcacctcccctgcatcagtgatgaagatgaagttgggtaaaacgagaaagccattagcacatgattaattaaattttaattattataaacttgataaataggtgtatttgatattctaaagtaatttctatatagaaaattttcgcacgaaacgtaccgctcaatagtttgaaaaatatgctaatgaaaaccgagataaaatttgattcgaacatggccagtgtagttaatcagaaaagaacaatgtaagtaagtttcagttgccgttggtcggtgaccttgcctgtagttaatagtaagtcagtcaagtcgtgtgcttgtgctgttagctttcgttttaactggtgtgctatcaacttgcctagtcgtccgtgtaccttcgctttcttcatttgtccattaattgacgcagtgcaattgtgctgacgacaaaaacgaaatcgtccaacgaggttgctgagagttttctgcccccgtctcttttataattttattcaccaaacgttagcaagcagtctgaaactttgtttgattgtcctactccaaggttatgttctagctgttgtcattcatctcttttcaaaatttttttaaggggtatacattatttcaaaggaaataaatcgtatccttgaacgctttctgaagatccctggtcatgtataagtaggcagtagcataatgattatgatattgagctgtcgtgacctggtttagttaattatgacaagaggattaattaggatgcaaagtatagtgggctagtggcggagcggctgtccatgaacgtgtgctgggtaagcgggaaagaatgaaacttagggaaatgtaggtctgcatgacgagtaatttatagctgtagctttgtgccttaggatatactaggctcttgggtgtttcttccttttctcttctatctaattaaacggtatgatcttactcaaaccgcaagaaatatactccatccgattcaaattacatgtagttttagttttatcctaaattatacatttgtatctttgaccatcaattttttaaaattcggatagtttaacaacatgcggatgctatattatgaaagtgtttcttatgttgattctaaaatgctaaaccacatgaagttttaagaattaatagtcaaaaaatacaaatatttaacttacgataaaagctagaatcataaataatttaaaacggagtatatactagtttagcaaagtatgtatcttagttcttaaggctcagctcatctggggccatcaatcaaatcaagagttgaacgtttcaataactaattgcagcgcgtacgtgttttcaccaattgtcgccatggttgctttcgcctgaactcagtcatcccctgattttgtctagatggcgactgcccaacttcagtttgttcgtgcaactagctgtgtgcatgtcaacatactaggaatttccagcggggtggttagctatatagtaatatggtaaatctgcaggacctgaatgatgcatgcaagaaacacacatctagtaaaataatagcagccatcttttcttcttctatttttctttcttttctccgagttggaccgtacctcatgcaagctgcctatgttcgcgaatagagtaccatagctgcatcagcaagcagaatacgccctcaaaaagagaaaaatgaaaagaacaagtagaatacgtcaagcaagtaagtccaggactcaacaagctgttctccatcatctatagttaagtcagctgggtgaggatcatcttcatcttcacactcatataatgatataaacaaaaatacttgtgacttggctgcccttgttcaggatattctcaaccctgaaactaacctcactcagttttttctcttttttgccggatccactctgttttttttctctatttttgggttttcctcctgactcctaggcaaccttccattcagtgtttataccagtcagcaaccacacaatgctggctgtgctgagctttaaattgtcccttttaataagagacacaaaagtccccaataagcgaaacggcatatttgcaaacgaaaaataatttgtgaataaaacttttatatatgtgttctgatctaaaagcaaatgctgaaaaataaactttgatgagaaaaaccccaaaatcaactccaaatttaaggttgaaaattcaatttttggctgataagcataagcataaccgaaaagatggggccgaaagaaacaagcaacatagaggataaaaacagcatgcatgaaactagcatcaccaagcaagagagctattcaaacagttaactgggctgtcacaagcaggcttgctttgccaaatgaaagcattaagcttctaatacgttctaagagttagtaacaagagcatcctaaagctatatattcctctccaactagaagttgcaattttgcctgccacttcaaaaggattacctactgctactgtctgtacatgacaaaaggaacctggatatatcactagcaagcacaaatcaatctcattagttctttcttctcttagatgccctggttgactgcgaaggtcctgctgcagatggcacctcttgagcagcctcaactgcttccgctttagagcttctcaaactcctccttgtcatcctcgctgatgggcctgctctttcattttcttccaccagttcagatttgactcctctgcgtctagtcctcgaatgctggttggctgatgggacctgatcttcctcaggttcgttaacatcctcagcaccgtcatcttcaccctccaaccgaggccattcagtaccacaaccacaagctctcgaggcctacatacacaaacaatttagaaagccactcctgttcatatgtgtaaagtggaattaaaaataggtaactacctttctctgagaaaatttcttcttcaaacagtacacgtgaatccttacattgcatccctcattaggacaagatgatgcctgttttaaataagtaatagaaatacagggaatgacattagtggagtatatgaccatgggtaacaagataaatgcaaatgtagaatcgtaattcgtaatcacatatctgcacctttatgcaagcttcattgcagacctcacatgatgggatatcattactacgtaaccaacttcggagatcaagaaatgatcgtatgccaagaccaatctttcctgtgggagtgtatgacagccaacgatcctgtatgagttcattaagagttttctccttttgggacaatgagaagttggtaatggaagtaggcagacgggattgactgccctgtgaagcgtctgcaattacaacctgggagcagaacaccaaataattcgtcacactaccataaaagtttgcaacaatacaaatataaaacatttgcttaaacagaaacaaaagctctcatagtgactgggtattactagtacgagatacctggttctcaatccgtgtgttaagagcatcgatatttgttatgctcccatcatttccagcttcatgaactattgcttccaactgccagtacaattacatgaatatagcgaatactagattgagctggattaaccaaaaaaaaggcaaagtgattgcataccaatcccttgtagaatgcaatctgtggcacagaaaactttgatccaagctttgactcttcatcagcaatgttattgaccactccataatacacagtaccatcatactggtttatgcctgctcttaactcaaactgcaagtatgcgagctccttgttgatcttgaggagtgtatcattgaacagatgccgatgagtggctgcaagcagtgatacagaacatgaatggtcgcaaaccattttgttcaattatgggaatattaacaccccttaggccggaaattatataaaatcacgcatagtatttttatgatttgtgaacaatattaggtaataaaaccaggcgtcaatggtgaaatgaagcagaaattatctgaaactgagagaagattgggacaaactaagattgtttccatttgagatgatagtaattcctaaaggggcattacgtcgaacacctgtgctacgagtaatgagacaagcgctggcgaacagcaggagaaagatgagagtagcaagcggagcaggcagaagcatataccggggttcttgccgccggagatggcggagaagagggcgtggaagtcgcgctccgagaggggcccgcgggagagcagcgcctgcaacagcgtgtggtggcgccacgagagcggcgccatcgctctccactcgactgacttgcccctgctgctggatcgatctcgtaatctgtggatgagaggtagaggaaggaagaaaccctagcctagcaagagcagaaggaagttttgggatagaaggctacggagcgaggtgagatgggggaaatttggcgattggcgggaagaggcgaaggagacgcgggaagagaagaagagattggcagcgcagcggcgcaggacggcaggacaggacaggttggtgtgtgcgggccaaatacaaggcccacgaaatcgagcccacccgtcgctgttggtgagaattaagcccatgtatattaccggcagatcttgttgggtgggtcggcccgagtatttgcaatgtagcccattgtcaaacccaaggaaaacgcgaaagaaataagtccaaccatcccttaactttacgtcaagttgattggcatcccttattcccatacccataaatctttacccctaaactatataacttacatcccataacagtatagaccttttttttcctttgttttcgcttatatggcaaatatccagacccacttatcagcacaacttggagatgagggtgcgctaggatctgcacatggcgcggcacaggcataagtggtcggggaaccgggtgaggatgtcgacgacgatatcatctaggaggtcaacgagcgatatagctcttggtttcatggtaacggtggtggtggaggtaggccaatagacagagagttgacagtgaagcagactatggtgtgtggcatcttacttttcccttgaactcaccgtgtcgtggtgctctcaatgtcccaggggtacacacagtgaggaagtgggggtattgagggcggagatcgaggttgaggccatcgagtgcagcgagagtggaccgtacacgcttcccctagcacgtgcgtacatttgactgagctccctgcagcacagggagacggaagcaagatgtgggtgggcagggaggtggatccgccatcatctcgtcgccgtcgctaccgccgccgccatctccttgttcagcaatgttgcatgaggcaagggtctctcctacctctatctttctatctctctagcggcggagacggcccgagctctgatagtgcgggaaaatggaagctaagacatgggtgggcgaggaggcagatccaccatcgttggtgttgtcaccacaacgccatctccctcttcgtcggcgttggaggaggcaaggaagggcttcacgctcggcgtgactgcccaccggtcgcccatcaaaggccggccctcatcgccaatttccttcccaccgttgctgccgcctccacggacgggtgcaccagccatcaccctctctccctggcagtgcgctctggtgaagagagggaagaggtggacggatagggaattgagggatgtgtggaggttgaaggccacttgcatgtgggttctactttttttttttgactagggtgccacataagctaaaacaatcctccatattgttataggatttgattcaaatggtttcgtatagtttagggagaaagatttcgggttccgtggtttagggacgtcaattaaattgcccgacaggagggtttagaatagacttattccaaacccgaaacgctgggaaaactggctaggccagatgggctgttgcttattgggcctgtagttagatatttttgtgggtttgacactttgactcactccattgattggttctgcatgcacgagtgtctcaacggctcacctctggttgagtccacacgtcctcctacgctactacatcacacgcgcgcgattcgttcaccggacaaaagcagagcaatctccgttgaattcctatggcgccggcgctggcgccctgccgctccgccgcttcgctgcacgccgcccggctactgccgcagcagcgcacgcccaccgcaccgcggatactgttgccggcgggcggcctcttgctccgcccacagccaccgctccaccacccgcagcgccgatcctcctctcgtcgtgacctccgctgccgccgccgcctcctcacagcgcggggtgactacgacttctacgagaactatgccgatgaagaaggagatgaggaggaggagtcggaagtcataggtgggagcttcgacgcggcggtggcgctgttcaacggcggcgagttccacgcgtgccacgacgtggtggaggagctctggtacaccgccgaggagcccacccggacgctgctccacgccatcctccagtgcgccgtcgccttccaccacctcttcaaccaagtatatatattttcatcgtctcattatttccacatttaactatgcatagtaatcagtaaacacttctgtaaaattcgtgattagacatgatcgtgcacaaacacagaaccaccgtggcgccatgatggagctcggggaaggcctctgcaagctccgcaagctgcgcctcgacgacgacgacgacaccacgagccccttctcccgcttcgaggaggaggtcgccgcggcgctcaacttcatctaccgcacacaaaaggagctcgcggcgtgcaccgacgatctctgcctcaccatggatggctccgcgacctcctaccagctgcttggcaacttcgccgctggccagaagctgtaccgccttgaaacagcaactggtgcagatggagatggagatggcgttccaaccataatcttctctgcttcttcacgactcgtcagggtgaagctccccacattgagcgctacggagcaacatctagcagcgcttcaatgtacaagcgagtatatttagtttctttttttttcttttctgtatctatctacttcctccatttcacaatgtaagtcattctagcattttttatattcacattgatattaataaatctagatagatatatatgtctaaattcattaacatgaatatgaatgtggaaaatgctagaatgacttatattataaaacggtagtagtagataaaaagtttatctcttcggatccgcttggtaccaaattgtagttttctgtacttgggaaatgaggaatggagttaaatggactgtagtaccattggtttcccttttctttccctttaattttttatgtacatcctcttaatatacgatgatattacacttagcataacggttgaccatccatcttaaaaacatagtagaaatatgttatatttaaagtacctcaaattataaaatgagtaaatttcataaaacgtgaggtcttgagccatctgtaacacaaaatcctaaattttacaatttattttcatgccctccatgtttcggggtaaaatgtttcatactattctagctacgagtatatcgtccattttactaatacatttgattataatatttgtaaaaagtgtaaagatattttttaatgcacatgttatgtgatcatggttttattgagtgaatttcactttagtcccctatgttatcgaagtttcactttggagcacttttatctgatttttttttcactttggatcatctattttttttgttttgttacactttggactattcaaactctctttgtggcacatcaacaacctcatgaggacgatctctcctatttacgtgcaagttacatcattactgagggagagattggatgtgattatacataagcattagggctaaagtgcaacctaatatgttgctaaaatatattctctccgtcccaacatataaaggattttgattggatgtgatacattctatgactatgaatcttaaattcagatttatagtattagaatgtgtccgatccagcccaaataccttatattttggaacggagggatgtagcgagtattatttggaaaaaataaatgaacgaggcttatcataacattaaatgtgtaaggatatcaccaaaagcgatatgtataattcaagcgataaatgttatggctatatttaatatagcccgcattgtacgctaaacaaataacacgttttaacgtatgtatattaatagaaaaaagtatagcatatttgtatacacgttttcaaatctcacatgaataaaaccaatagtattatatatttaatttatttttatagctatctttgataaaattccaatccaataacattatcttcagttttttttcaccctctcatgttctgatgtgaaaaaccctcacccttgcttgttgaacccaagaggcttgcaggttgcagcgaacacacgcagcacggaaaggggaaaaaaaaaccaaaccctctcgtcctccccttccccgcccaccccggcctcgccgcccccttcccgtcgttcaccggcggcgaattcaagctgacgagctcgccaccggggtacgcgtcactctccctcccaaaacctccccaagcttcaatctctcgcctccaaattcctgattttctcgccttttttagggggggatttaggattggttcgatcttggccggccaagaagtacaagtttcttcgggggattagcttgttcgcgagggggaggagttcggtggtggagccttcgccttcgtgatggcggacaccaaggcggaggcaaaggcggaaactatcggcggcggcggcggcggctctggctcgttcagcgagcaggcgtttgttgagaagcttaacaagctcaacaacacggcgactaggatccagagtatcctttcttccggttgtttatttcttgtgcgcttgcaaatttggtagcgctcgtaccttatctgtctcgtggttttgattgatttactgttccagatgaatagaaccctaaattgcaatgtggattagtacaactgacctaggatatctccttgccgttccatatattggttcttgcgctgtttgtttggttagtattcaccttcttatgttcctaactgtgcttattactgttagacagcatctcgtggtttatgtattgatgcatatggatataacttagtgtggcaattgtttctgtagcttccggatcattcttttgggcatattttgatatactgttttgagttatagctgtataagtgtatatagatgtgcatggctacaagatttggatttcttatcagcattatggtgtatcagcaatgaaaatttgtataataatttctgtttgatgcattcttactgtatacatgctttccattcttttttgtttcttgggaaaatatgtttttcaccatcctttgaggatgattatctttacaaaaatgacaagtaatggcatgaactgttaggtattatgtgaatagtaccccctctgtcctaaaaaaaagaccaatcctacctacgaacctggacacctgtgtgtccaggttcgtagcttggaattcgttttttttgatggagtagtatctttctgtttgatatgtaatgatcttttgtttattgagaaatacaatgtttttcaatgcctattgaggatgactgtgtctagaaaccgaaaaatgatgataaggaacattcaggctttgtgttacattttactaatattttctaggtggtctacttagtacttatacaggtttcttgtacattagaatggaatattttacctgttcaatttgcaaattaatgagcataactgatcatattgccacatactttggttccttttggttggtgctattagcgtagtggtatgctagtgctattaggatagtacttactttggttgcttatattatctgtctggtagttttgattgatttactgttcaagttgaatagaaccctaaattgcaatgtggattagtacaactgacacagcttatctccttggcgttccatatattggctcttgcactgtttgtttggttaatattcaccttcacctgttcctagctgtgcttattgctgctagagttagactgcatctaatgttttacttatcaatacttattgatgtgtacgatgatacaaatataacttagtgtggccattttttctctagcttctggatcattcttttgggcatattttcctatattattttcaattatagctgtatatataaattaacctcgctaaaatatttgtagttcttatcagcattacggtgtattgggctattggcaatcaaatttatattacaattttggcttgatgtgttcttactatcaatacatgctttccttttgtttttgtttcttgggaaaataagttttcactgtcttttgaggatgattatcttttgaaaaatgacaaataatggcacgatttgttaagctgttgtgttacaattagtaatatcttctattcttctgttgatgtgtaataattttttgtttgttgtgaaaaattatgtttttctatgtcttttgaggatgattatattttgaaattgactaatactccctccatttcatattataagtcatttgactttttttcttagtcaaacttctttaaatttgaccaagtttataaaaaaatatactaacatttttaatacaaaacaacaaattatgaaaatatactcaatatactcaatgttaaatttaattaaactagttaggtgttttcaatgttgctcatttttactataaatttggtcaaatataaagaagtttaactaagaaaaaagtcaaacgacttataatatgaaacagagggagtaatgataaggagcgttaggtttgtatcacattgtagtagtgttctcttgtggatttgaatatagctgttttcctgttcaatttacaaactaatgggtagaatcaatcatatatcacatactttgtttccttttggttgctgctatcagggtactgatatgctagttctactttttttggtctcttgatggcttcttgtacaatctttgtggaactgctttttacgatggtatccattaatctatgttcgaaatacaatgtggtaatatttggttgcactaatgttgtactccatccgtcccaaaatataacaatttctagccttcagaatttgtcccaaaatacaacaacttcttttttttttttgacgtggaacagcaggaggggctcctactgcgctatattaaataattaataagaaaagatttacaaaaggaagagagggagaaaatacaaaattacaaaggaatgattaaatataacaacttcttcactaacattctctttccaaccaatcacaatcatccattcaattttcccacctagttccacttctcatccaatcacaatcttcctccatttaattctacctactttcttaataaccgtgtccaaccctaaaatttcttatattcttgaacggaggtagtactggcaaatgaataaacaaccttttcgattcttttatgaccatttatcttcatttctaaatcagttaagcagttaggtcagggcttatcatatactgtcatcaattaaacaaataacagattccctatggttgtaaaaaaaacaagtcgcaaattgcaaatttttggcatttgaagaaggatatatatagcatttatccatttgcatccataaattcacgctacaaagggggtgggggattatgtgatggttgtgtcatgtccgtttgcttacatattagcaactcgaatccctatgtaatatcttctgaacgagtcttaccacttgctttcctgtgtttgatgtcaatgccgtaaaaatcatttacacagtcatgataccaaattcccacagcatatttttaacaatagcatctagattacaatagcatgccttttttattccttaattcttaagcagcactttcaaattggtgcatttttcaccgaaagagagccagaaaggttgttgatacatgggagaagcagtataacagtgcaaataaggataagaaagtatcattcctgtacctgtcaaatgatatcctgcaaaatagtaaacgcaagggaggggagtttgtgaatgaattttggagggttcttcctggattattgaaagacttttatgtcaatgggggagaagatggaaagaaagtagttggaagattagtaagttattcttaattccgttacattggaaaagtctatttacttcattttctctatcacaaggccatagcccaaaaagtaaaaaaaaaactttatttttaaaattacagatagatatttgggatgagcggaaggtctttggaacccgtattgaaagtctgaaaaatgacattcttggtggtagcactcatacaatgggtaacaatgtcaatagctcaaatccaagccctaacccctcttcagtttccaaagctgcgcggaaagattctggtacagtaacaagagtaagttgccagatcttgacctgctaaaaaatattttcttgtgctaaggatggatgcagtatattgtcatgaatttgatagagatatttttgttgttttgtcttttgatgtagaaacttactgttggcgggatgccagaaaagattgtaacagcatatcagtcagtgcttgatcaacattttgatgaagacacagctttaaacaaatgcaataatgctgttagtgttttggataggatggataaagatgtagatgatgcttgtactcaaggtaaagcatttttctcacttcaataggtctgttatgttatggatatgtaccgtcgaaagattggcacttaatgcattctgataccttggcctgtattgcatcatgattgttccagcgctattttacttctagttccatcatgtacttgacttgagaaaaaaggaatttacatagtatttccggttttttgttgatctgccatgtaaattctagactaaacaaacatctcaaatacataaatatgatctagcatgttgacaaagaaaattgctgtacataattttataattatgttaaaaaaactataatgatgtgattgtagcatgcattggcatataaagggaagaaaatcaattttctggcatttgttttcataggtggtggtctagcatacatatccttattctgtggagcacatccagcagcttaattattttacttgtgatagttccttgagtcctttatagtgcacactaggcctgtaggccatgattattgacaattgctgacttcaaatttgactaaatattttaatgagttacagagtaaaaaatactgtagtgcaaagtttcctattaaaaatgctcctagctctaatgatctgaaagagtaaaatacatggcgggtctttaaactagagcgttggtattacttaggtccgtaaacttgaaaattgcacatttacgtccatgataacgaaccacagtaggtctgaacctcatttgactgggggctgactgccgacgtggcgctccacataggcaacaattttgcatccgccccccttttgcaggacagcgtggtggtaaaattgtagttagcccctttcagccacagtaccaccccgaaaccccccaaaatccccaaatccctcctccctcccaagagctaaatgcaattttaccgccactccgcgctgtggatgaggctggatgcaaaattgttgcctacgtggggc

SEQ ID NO: 38186 - DNA, 14998 bp, Oryza sativa
ctttcactgcagaatcacatgttagatcattctatttcttatgccatgtctgttattactcattataatggaaagttagggtcaaaattatgctgagcattttcatggatccatatgcttttgtatttgctttgagctagactctattcttgatgcctagcctaagaccccatgagtccatggcatgtgagcacaaccagagttttgctttgtcaacgacattcattcatgaatttatatcacacatgttcaggatgagtagagctaggaaatacaaaagcaaaaatgagaacacataagatgcacattgtatgctctgacacgaagagaagcctctaaactggatagttgctgaatctgctgtacaattcagctctatgatggaagtagtagactaaccatggtcagcttgggcagcacagatgatgtctggctcatctagtatcctgcttcaagcacaaacctgcctcttaaaagttaccatggcaaccctgaggcctactctggataacaaggcaacatgtcatttcctacttgttagactgcttctcaattccaacttatgtttgcttatatatgacatttctctctttatctgtttcaagagaattaggtccagcacattgggaggtctgactatctctacagcataagctatacggttaaggtggcccttgcacgagctaatataaagatatgcctgcagtgatatacccatgcgcatgcattgttattaattgtaacctaggttctatgtagctaacctgctaactccatggtgcaaacatgtgtcattgcatcttaagttagaaatttccaatcacatatttctgttccctatgtagtatccatctcgctggcttttgttaacattgctatctaccatctcagttaaaaccacagcatctttcctgccactgaaggggtggtttagcagctactcaagaaattatttagattgatttttggctaaccctgatttaattaacaggtggctcgagcaaaggctgaacatgccatgcaactaaaacaacgacttggtagtgccttgaacaatggtgcaggatctagttctagtccactgatggttacacttccaccaggacaaacagctgccatgatgcagaattcagcagcaatgccgatatttccccagtttcaaccactgcatccagcaacctcacttcctgccacatccagtgctgttggtgatgagcccaaaaaaactgcagcagctatggcagataagcttgcatctttgtcagctcctgagaaggtgctctcctccattttctcttcccttgctgctgaacaagcaaggaatagtggttcgacttctggagatctttctgcaggacctccaggctttgagagcaataagaagcctaggcttgacaaccccattcatgctagtgacatgagtgctcccccattctttgggcaactgccgcaggtgcaaccacagattggagcaacagctgctcttggaggcacacagccaccaacccaagcaaaccaagcagctggttcatttccaccacctccacctccattaccacttatgccacaatttgttcaaaatactggaggaatgtttggaatgggaccttttgggatggtgagtggctctgcgccacctccacccccattgcccaacattatgtcagcaggttttccaagactaagtgtgcctccacctctgcctctgcctacacaatctcagaaccagagccagccccagcagcagcagtctccacaggcaccacagcaatcgccgacctcgactggattttttcaaccaccaggtgctgggttcttcccaccagtgcaggttcagcaatctccatctgcccaacggcaatgatgattctacaacaattgttgggctataaaggaagcaccttgtgctaactttgtatattaaacaataatccctgaggattgatctgatagttggcgagtcctgcatcgtgaagcaggattaatgcttatgaattgggaggatttgtaggataggcttgcggcttatgtgatgtacaactgttccttttggtctgaggagtttgttcaactcttcttgattatgtgaagttagttagactttacttttgtttgcatagccagatcttattgttagtcctgaggcaaacaaatgtcggcattacatttgttacttaaagaggtgcccaagtgaaagaacttttttgggctcctcaatggtagaacttacctgtggctctgttagtttgctagagaagccatatatccatagatccttacttgaagttgtgaactgcaaatatttgtcatattcaagtttatttgtttacttaattttttattcaaaatgattgctatgcaagtttgctgttttcctttccttcattcattctgaggatgtggctgcgttgttagctcagactcagagtggataattcaggggaggtgaagtctgtaccctgcattgtgaatacaagtacaccatgtcctctgtggcaagattattgtttgttcagaaatcctgaaaaaaaaaaatctcctagcttaacaaagtaaaagtaagccagttggaacatatatttgctgggtgcttcaggtatatgaacacacaactttgagtctttgatatgggcatcctgagcaattgtggatcaggaatacagagttacagactgctgtttctgttgattcttgttccagtctaggcagcatggtcacaggaaatagcccattagcctgtgaaacagatggggagaaaaaggaagccgaaaagagcccacaagtatcattcacatactgatttgaacgacggacaataaattgctgttaattctccaattgcttcttctcggtgaattgaaggatacagcagattaactgattaagctagcttacctaacggccagaacgtgagtcatccagctgattaagctacaagctactaagctagcagtgtagtggaactaatgataaaactagcgacacgatcttaattgtactaaagaaagctgggttaaaactatctacaagttgataaaactcatctgcaaaacttttgctaactaaaaatgtagagcagaatccagaaagaagcagaaggtagccgggccggatgcttctaattgtgcctgggattgaagttggtcccggggttgtgcttcatgctggcgtcgaactccaccttgggctcgccgttcgcctgatgaacgccattgactcggaaggtgttggtagccattgccgccgtcggcgccgctgccctgggctgctgttgctgcagcagcaatctcctgctactcctagcagcaacagcagctactgcattgttgttgccgtcacgcaacaagccggtgctggtctttggtgatgcagcagcagttacagcgaggagaatatggagcaagaagatggcagcgaacatgcggtgcaaagccttcttcttcatggtgatgatgctttgttgatcaactgtgatgtggtggtagttgcagtactgtgtgcgtgtatggcagttgggcatcaagggggagcaatgctggcttatatatattgttcttgtaacttgtgttacacagactagcttgtttgtagtagtaacatgcagatgcaatgtgcaggcacgctgcatccactacttgggaacatgcagagaacatgccacacatttccctgtaaattttagcttctgtggaatattttgttaagaagacaggagccatgcatcaagtgggtctggaacatgccaccctgagacctcagttttgttttgcagacctcaaattgacaagctaataatagtgctgtttctctttgactgaaaaatctccttttccttgagcgtctcagatgatctaatccattaaaatgcttcacattaagcatatgatccataattctttctagggatatatgcgtgagtgccgaccatgtgagagatgcttctatttgactaatagcatctcttgcagagttgcagtcaggccggccgtatacaaacaaccaaatacaatacgttcggtcatgtgagcagatcggacattcatttttttcaagagtacattcaggatgtataagaatctcaataatgatgcatgcttcagattcagatcggctagcatagcagctaacttcgtcgtggagagtacggccgatcggctacaaacatatcgtacacagatagcactgtccacagtttcagaatcaagtttttagacccgggcaagcctaacaaaaacatcagaaattcagaattccttccttccttccttcctctttgaattttgattttggatagtatatattcagctcaatgcttatttcagaataaaattatccaattcagtattgaatctacattttgtctgaaacattcgaattgtaggtctatatttgcaaaactgaaacaatgttgaatactatgttaagaataattcttactaatgggatgccctagttaatcatttttttcgccgggctggcggaagccagccgaagtttattaagataggggaaaaaagtcacaagaaacaaattacaaaggtgcaagctgcagattcaggctacagaggatgctgcctgccagacattaaagcacgtctgtactacagagcagggagctaccaccaccggcttaatgttgctctctcgccatcaggttgcttccggcttgcagtggacacagcagccctgctgcaccccaagtggtccactcatcttccatcgctgcacataagtgcgccgccagaatggccttgttgtcgaaaattctagcattgcgttccttccatataagccaggtcaccaagataactccagcatcaaaagtcttacggtcttgtttagaaattgatttccgcgcggagcgccaccaggaggaaagatcagccgacggtgtagtgcaggacagaccaaggttaatcataccaagtggaaatgccatgatgcatccagtactacataaaaatgcctgtccacatggaagaggctggccatggaccatctgtctcctaagtaaacatgtttgaccataaactaattgccaagtgaagtgctgagcctttgcattgctccctcttcaatcattgcgaagttcatggccgcttctacttgactgtgattgtagatggcaatatggaatcacatggataatgcatttcttcatattccaaaaaaacatcaatgcataccaaatacctgaatctgaagacagcttgagtacatgactattattattatgtcattgcagttttcatagtttcaaagtttcccacaggcaactgtaccacaaactttgacaatgaggtagcaactattgttaatgttttaaatatgttcaaatactatcttttttgttttttcgttttttgactagcaaagttcagccactaccaactcctctcttcaatccacgtaagtccacagatttgatcagccatttgtcaggtttaacttccaagttggttctagcccctgtcaatcattctaacattcttggacttccatagtagatggcatatggaacatgggacattagaagagtggaaatcaacttgtctacatttctaattgtgtcacatgctcattgtatgactgcaaaagggccttctgaaatgaatagaaccatctgcggtctctgaacttaaaattggaatgttctaaaggtcagcaaggagctttatgattacctacacaatttgcaccatggatacacattttgtggcaagaatcgtttttgagacaagctgaagactgataagaacaatatatgtcatcagagtcttgacaagctagaagaaaaaacgctagacattcggcaggagacgtactgaatttatatgcagaaaagcaaccgacagtaagttcatacggtctcagtctcacagatcatgcgcatgtggttagaaataggccaatcttgtacaagtggaatactggaatatgatgaaacacctatcatttaggaaggttcagggaataaatatcaaacaaatatgtttcttttacatgattcctgtaactaatgcatacatggtgttttcgtgttcatgtctagaaacaaagatactttagtcttggaaaatatacaaattttgatgatattcagccagagataagctaatccgctgcgcctcaaaacacaaagggggttcggagttttagactccgagcccccttgggtctctgggctaccgtcggataaggcttgtgtggcccagattgagtggatccactccacagcgtgaggtgtcagcgacttgtttgggccgtcgtgttgcttgctggacctcaagcccagcacggacacatgtgtaggcccaacctcacacttcattgcgtttaggtgtgatcaagatttgacttcctgtgatggcatatgatctgtatactttccatttggtaataactattttttaataataattactccctccgtttcaggttataatacgttttgactttggtcaaagtcaaatttgaaataagtttgactaagtttatagacaaatatagtaatatttataatactaaacttgaatatattttcataataattttttcttggattgaaaatgttactccctccgtttctaaatatttgacaccgtcaactttttagcacatgtttgaccattcgttttattcaaaatttttgtgaaatatgtaaaactatatgcatacatataagtatatttaacaatgaatcaaatgatatgaaaagaattaataattacttaaattttttaaataagacgaacggttaaacatatttaaaaaagtcaatggcgtcaaatatttagaaatagagagagtattgtttttttctacaaacttggtcaaacttaaagcaatttgactttaactaaagtcaaaacgtcctagaacctgaaacggagggagtaataagtatttggcgtttgggaacatcatttatccaaacctttatcggacaaactttcaaactaaatatttgagttcagatcaatgatggttacctgccaataaccggttatttttttccgaaaccaccggctacaattacaaaaaaagaaaatgcagctacaatatattactccctccgtttcacaatgtaagttattctaacatttttcatattcatattgatgtctagattcattaacataaatatgaatgtaagaaatgttagaatgacttacattgtgaaatggaggaagtagtaaaacaactgtaaaaatttaaatttgatgtttaaattcgaatctagaatactccggccagcctagagaactattggtgatccacgagcctagaaacacacgattgatggactcagcctaaacatgagatgcactttcacttggccatttgtgttgcgttaaagcagaaacatttttgttgaatgttccctttattctgaacgagaacagcaatttttgatgaatatccgaatgcgactaaacagtttgctgttgctcaagtaaacatctattcataatgattttcttagtttcatttcaaacatcaaaggggatgtagctcaaatggtagagcgctcgctttgcatgcgagaggcacggggttcgatcccccgcatctccactctaaatttgtctattttagttctcttctccttttcttttgtctaatttaattttgtgctcttctaaattctagtctaatttagctatgtgttcctctaattttcttctaaatttttgtctattttatttctctttctttttattttgtctaatttaattttgtgctcttctaaattcttgtctaatttagctatgtgttcctcttattttcttctaagtttttgtctattttagttctcttctccttttcttttgtctaatttaattttgtgctcttctaaattcttttctaatttagctatgtgttcctctaattttcttctaaatttttgtctaatttagttctcttctctttttgtgtgccatatgttgccttttttggtctagttatttaattttctgctcaccaaaattttcagcgccttattttgtacgtgaatgtgacacgatgaattattttgacttttttttgtttaatttagttttttgagcttgtaaatttgtataacattttttatgggattctctttagtagtagtccctccgtcctaaaataagtggagttttacactgtttatgtctcacgtttgaccgttcgtcttatttgaattttttttatgattaacatttttattgttattagatgataaaacatgaataatactttatgtgtgactaacttattttaattttcttataaattttttaaataagacggatggtcaaacgttagacacggattttcacggctatacttattttagaacggaggtagaagcgtctttagtgacagtgactgacagcttggtcccatcccacatttcaacgacatcggctagagccatggctataggtaaacggggccatcgtttggccaaacggcatattggtaaacggaatataattcatgaataaaagttttatatatgtgtttctagcgatctaaaagaaaaatctggaaaataaactataatgaaaaaaaaccctaaaatcaactccaaatttaaagctgaaaatttaaattttgacttataagtataagaaagtatggtattgtgtatttctacatggtcattctgttatccaccatgaatttggttttcaatgcttgttttaagggtagttttaaagaagagtaaatttccgaaaactgtaactttagtgataaaagtatcagtttgctgcaacaataacgtgaaaaattatcacaaaactacaacttttacgttatactcgttctgtcccaaaataaatcaacttctggaattcaaactttgtcacaaaataaatcaacttctaccttctcattcacacttggttcacaaatcgaaaaagtttatttcttcaatactccttacctacctaaccatcaatactaatatgctattaataaggggtattttggtcatttatctatctctttagttttgcattgggaatctaggaattacttctttatgggacagagggagtatgctgctacagtaaatatagatggttttatcattaaagttgtagttttctgaaatttaaagatacgataagtgcagttgctcataaatatagatggtctttgtatttgaattgacctttgtttccatgttgtggtaccagagtagtgtagaacgactgaaagtatcgaagcatttggctgaagaggcaatgaattattttgaggaatgtgtatcgatctcgacattggatagcactgatttctcatcactggaggaccctcaaataaactcagttgtgaacatcccacaaaagaacagaaatacatcttttgacaaaggtggatcaagcattgcagaaacccactatccaactgatcgtcattggcataatgaggttagcaaatcaatgctggttcacttcactgaggttttgagatatgaagtactttttaggaatatcaaccgaagtacccaacaacctccatcaacattcttttaaacatttaaatttttttactatgtggttcagaaatagtacagtctttgctctccattaattggcatcttgtagctattttcatattcctattgttatccactcaaatattcctgaattgtctacaatctacattgtacttaatgtgttgtatggaatcatattacatactcttgttgatttgccagcagcattttagtagaaagacaagtaggtatatgatgtggatagtaacgatcattctcacactgtaacaagtattttttgccctcccaggaatctgacaaccaaacccagtgctcagttagcttaactggatctgatgtgtctggaggccatacttatagtcatactatgatgacccccgtttcaagaactacaaatagctccagtgatgatctcgatggctttgacacaccaaaaggcagaagttcttgtttctccttcactcatgaaccaacaaaaactgttgagggcgatgacgttcaacaatatttaagaagttttggaaggggaatcagtaaagatctaagagagataaggtcaaattattgtgatgatgactatgtatttcagaaaatgaatgcagacttaattatggatactgtgacatttaagaacatggtaaattttgggggtctccttatttgtaatattagaagatactgagaaaacatcaactagtgcgctatggtgggaggactgatattcatattagcaacgtgcaattagtactactagagatgtatacatgttcatatgattctatctactaattgtgatttttttggtcatcgactgatatcatgtgatctgcatgctattttctttttaacctgggaataattatttgtaacatcagaagatcctgaaagaaaaaaaaatcaagtagtgcgcagtggtggaaatggaacgtgcaattagtagtgctctattgtatatatatccataggattatctctactaatgattttttcgtcattgcattgctctcatgtgatctgcatgctgttttgttacttgggaataatctgttagtattataaagaaatattatatctattcttgtggacagctctgaaacagttcgcatttgattctacaatatccatttctatttgcaatatctttgcacatttcatcctttctaagttataccaaatgaaaaccagaagtttgcatcgactgctgttggcagctgtctctgtaggactatgttacatggaaggacacatgttttaaatccaattcatgatttaatggtgtttcttctgaacattgaaatttgatcattactacagtaataccaggagagagtgtgtgctttattggatattataacaaattggagtgcaagctcattctagagatggtttggttccatgaaagcttcaggtttgactagtgctgttttgtgttacagaaatttttgtacgatatgcaatcagtccgtggacggttgcattgtcaggtactccctccgtattttaatgtatgacgccgttgactttttaatcaacgtttgaccactcgtcttattcaaaaattttatgtaaatataaaaatacttatgtcatgcttaaaaaatttgatgataaatcaagttacaataaaataaaatataattacataaattttttgaataaaacaaaaggttaaacgtttgtcaaaaagtcaacggcgtcatatattaaaatacggagggagtagcttgcaagcaagcatgtttctggtctaatgagggagatgttagatggaaaagcttggaatttcttttatcttgattgaatatttgaataatctggcaacctaggatttatcttcactctagcacctcaaatgcaggcaaagtagatgagaaacgtggttaacaaccaaaccgtactgcctgtactacaagcaacatgtcactctttttttttgtagtagaatttagagttgagaatattaatatttctgcatcatggaccactatatggtacataaacctagtgttaattgttgtgattgcatgtctgtctgctgaggaatgtgaacaagctggacggacatcatggtggtgacagaagacgtcagtcggtctaatcgacagtcagtcaggttgggccgaaaagaaatttttttttgagtgtcacatcggacgtttgatcagatgtcggaagggattttagacacgaatgaaaaaactaatttcataacttatctagaaaccgtgagaagaatattttgagcctaattaatcaatcattagcaaatgtgggttactgtagcacttatggctaatcatggactaattaggcaccaaagattcgtctcgcggtttctccctaactgtgcaattagtttttaaatttatctatatttaatattacatgtatatgtcaagattcgattggatggttttaggaaaaagtttttagaaactaaacatggcctaattatctgggcaactaccgtcttgcagcagactgtctagacaaaaatgtggtcagaaaacagactcgtgataaaccattttggtgagtatgatctactacaaaacaaataatttggcagtcaggtatgggagcttaattgggatgactaatttactcaaatattgaggtcatcacggtcagccatcaaaccatcatccacagtgcaacacaacacatatgtttcacatgatctgtacgtagtactacagcattagtgactgctgaatatttttcctggttgaaggatgaactgtttgtttgatgattcttcatcgaaagggggttgctgcattggtagctactgtagatgcttgttgtgtacagtaattgactgactgcacacagacacagtaggttgctctgaatgttggggacaggtgttgtggttgcggggctagtaggatgctttcctctgaatgaggaattgcatattttgcatggctgcagagctctgccatttggacacatggcgctaatttgtttgattttgcagtgttacatgttacatgtgtttgtttctttttcacgtcccgatgctattcgtctccttgtgtagctgctatgctatgcaccttccttcatttcaattcttcagtctaaggaccctggcaaagaggcgtccgtccgtccatttctagtttaaaagttgcttgtcctctttctgtagaatcaactcactgcaagtctgtaactgatctgaatcagaggtgaaagctcttgcagtaacaatatagacaaaaaatttcatctccagtaacgtttaatttgcagtcatttatgagcttgtttacttcctagtgtaccctgctatgtaaaaatgaagtgtagcttgggcaaaaggcagttcaacatcggcaaatattgccagtgactcggtgtagtctccgtggaaattgtgtccttccagaaagaatctcaggtgtgtaccatgttggaaatatagtcattaatcggcatattttaatccaaaaagttaaagcaatgatcatggcataagcagtgtagggtgatcttaacataaccagtagcatattatgcgcatcatgaatgtcaggaacaggaacataacagtaacgcgataacatgctagaggcatcatgtagaacaggaacaagaacatagcgcgcacatagcgcacatagtatagcgatagcgctaacaacagtagcatgaggagaagattataccctgagaatggccctccgctggatggtgaggcagaattgcctccgttgttgttgtcgttcacggcacctcctggcgcaccagctccggatcgagctcctgtcagcggcgtaccacctccgccagcagtggcggtggcaactccagacatggcgatgagcagtcgtgcgggaggcactccccaaaaacctgatcacccgcctacccggtgcagatctcaggcgaaggtgtggtttcggaggcactgctccttccaatctctcgtgcgcgcaagagatcagaagcgaggaagcaagagcaactcaggcgcggagaaggagaaactaacaccgggaaagaagcgatgaaaccggatcggactcgcggcctccttatctatcacgagaaagaacgtggacgcgctgttgtggagggaatcgtgggaacgtgggttagtggctgcaaaagcatagcgacgtgacgcatgcacgccgccagccagccacgccacgcccacgcccacgcccacggcctggcccggcgcgcgcgcgtgtggcattccgacccccacctcaactggtcaacagggaacctccaataactccctatttaggttaagatatttctcgcttaaatcctgaggtggtattattatcctcaacacttattatggacctttgagatttaatattataagttgggcctagcccaattattctaacaatccccaccaaatttcaaggctcataagaaatgttctcaatgttgtgcctgtttgatataccagggttttggtggagactgttaagttgaacttccacctaggaaatgagctacattagaccacaactgaacaatggactatgccttgaattgtgagttttgtgtgatcaggtttcactcagaaccttgactggtactgggctgccgttcgcatcccctctgtttggagcatataagtcaaactccaggcctttcatgagtatctagagatcgcccaacctcatagactgtgactagcagttgaactcatataggtgtgttccttctgagatgttctgcaggtcaacatctctacttggaaaagccactcggatcacattaagacataagccatcctaccatgcaggaaagaagagaagcacatcataaaaatgagcccttttcaagggtctcttctctcagtcacacaatagtttgtttcaccatccaaattcacgggatctccgatcacaatggacaggtttccactattatgcaaccttaggtgggtatcaagcccatttccctcgatgcactgtctatcacattacgtggtagccccttggtaaactgatatgccagatttctagccgtttggacatagtccaatgctatcaccccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgttagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtgccctttagatagcgcattactctttccaaagcttgcatgcctgc

SEQ ID NO: 38187 - DNA, 3200 bp, Oryza sativa
tggggtgttatcagtatagaccattgtaaaagatgtcatgtacggtactttgtaagggatttggaccgtctgtttgatccaacaaaactttcatactattttaaaaagaaagcatgaatctgatataaaactataaaaaattcaaacattcacagaagagaagtagcctaccttgataagctccgaggggcggaagccgcctatccagaggaagcattgctctacggcgcccttccacaggccggagaggaggtggagggggtcagcaccaaccagcctagccttgtgagccatcagcaccccatagtgtgacatggcttcatcgacatggggctgcagctcgccatccggtcggtgctcctccacagcggcccggagccggctgatcacttggtggtgtgcctcctgccaccgctcatactccaagttgaacaatgcagcgtctgaaacgccctcacataatgtatatataaatgcatttttgttagatgatatgacatatataaatacttatggtctttgcaccaagacatgcaaataactattgttgctaggcgtgttaagtttaacgtgagatggagcagtgtaaatctctttattatgattaaatgctagttcgaaagtgttaacctgggcttagaattccagcaccgcagaatgcaccctgcagggagatacagaaacacatcatataacttataaattgttttttttacaaacacaaattgttcgttcgagataatttgttcttaattttagatattgattatttgcctagtagtagaaacttcgattctcctacaaatattggtggtttataaattgcgagtagtaattaatatttcccaaaccaaatccgtcctctgtgagatgattcagttctttgctgcttattaattttcacctgagctcttgtgaattgtatctcctgttcaagatgcgccagcctgatcctgcctgtctctagctgctgaatgtaagcctgtcacacagacaaaaataaaaagagaacaaattaaggattaattacacatgataatatgaagcgaaggtatcagattctgcaaagaaaaaacaaatgcaaagcccatgcatgtgtctaacacacaactcccattaggtggtaggttaacttcactagctacttccaccatctctttgcttttcttgctagctccaaagatttttgtttatttaggcttctgagggctgactacttgttcatttgttgactgatattagtacaagagtactagtactaattaactagcttagcttgctattgagctggttaatcaatggggtatatagtaatagtagtaactatagtaagtaatcaccttcttccttagcctgctctttcttgcggcctctctattctgcgccagccttctcagcgttttggggtccggcgtcttgggccccttgagctctgaacttgctgacgctgccatggcgccgccgctgccactgccaccttctttctagttgccatatggatacaaaattatagtaacatctaagataatggaaactttatttaactcacccagttataccaatgtgatacaactatccttttttaattagataatggaaggtttattgaactcaaaagtctgagtatactcatagcctctgtaccacgaaagtgcacacagccaaaacacccaacatacacaactaaaagggaacacaagattgatcaaaagccatctatccaaagactagaacgccacccatatgatggggtaaaaaaatgatacaactgtctaaccgagaaaaattccggacaactacagaggcgtacgtgtgtaaaaaagttaaaaccttgaatgctgccttggaggtcttgcctagggtgagtggcctgccatctgccgccgctggcgccggcgatctcctggaaaagccggcgatgggcggcgctgacatcgaagccttaagaggagaactggcaccttgtgaacaacacgcttaaattgtgatagctagctagagatacatatgtgcacatattaacatatatacctttggtgttggagttggctctccatccattggctgggaggggaagatgttgagagtctctgcatgcacacatgaacaagttcagtaattatgcattatgacttagtaatttacatagtttgtaggcaggtgcttgcatgctttcatgcacacatgcaactgatgtgtctcccagatatatatctgtgctaatttttcaaatgcgtgtggccaagatcttcaaaaaagtggggcaaaaaatatgttctttttggttgcaatcttctagcaagatcctgcgaccatatcagctatgtttgttacgtgtcactcttctccaattagctaataaaatcatgtatgactataatgaccaaaaggaaaagaaagggaatgagaagattggtagccattcaaaatcttacacatctagctataagctaaagcaagtcaaatcacagaaatcaatgtatgcatgacattctttgtattttcttcgagccatgtgtgtaatatactatgacaaaatactcttaacagtagatcgaccttttacaaaattaagtggtttgtggggttcatcttaagtagatggcttatcttgttcctggccatcaaagtagaggaggatagcttgatccaaatcagatggcatgtcatatccttcagggttccttcttctgcatttacacattatgacaatataccattagtctctgttttgcatttagtacgtagctctactgcgactgatttagagcttgatttttcttaatggtatattgtccgaatgtggtccatggaattagaaaggccaatattgatgttggaaaagggtgcaaaaagttaaacatactcattgctttacaaaaaagagggggggggatggaattagaaagccgctcccgccgcccccaagctgagctcgccggctcccctcccctctccttctccactcttggctcttcctcttcttcctcttggctctccctcgtccttgcgacggagcgcggtggcggcaggccacggggtgggcggagcagcgacggacagtgcatggccggcggcgggcgacggcacgcgcggcggcgcgcgaggcacgtggggtcgatggcgacgtcgcgccgcgcgaggaggcggtggagcaagcggagcttctcgtcctcaccaccaccaccaccaccatgatg

SEQ ID NO: 38188 - DNA, 1506 bp, Oryza sativa
aggaaataagccaaacgatgggacctttctatctttgtgttaacaatggcttgacctgaccagaccttactctgactcaaatctaggaattaggatgcggcaaattttaggctttggcagtaagaaaatgacaaggaattaggatgcggcaatttcacctcgcaattctgtcgtttcagatacgacacatccaccttggataactcacctctatccacgtcacctgtttgttggtttgtttgttattatatattttgcttctcttcccgcgaatctcccctctataaaaccccgcgccccacctcacctcgccaccaccaccacgacgacgtacttttgctgatcgatcaatgacgcggaggaggagcctcgccgggggtgcggcggcggctgtggtggtgctcgcggcggcggcggcggcggcgttcctgtccctgctcgacggcgcggcggcgctgcacctgtgcacggacaggctgttcaacgacacgcaggggaggcactctgacgggctgccgcacctgaaccaggcggaggaggcgacgtggatgggcctcctgccccgccgcgccgggccccgggacgagctcgactggctcgcgctctaccggagcatcacccgcggcggcggcgacgtcggcggcgagccggcggggttcctctcgccggcgtcgctccacgacgtccgtgtcgacccgtacggcgccaacatgtactggcaggggcagcagaccaacctcgagtacctcctctacctcgaccccgaccgcctgacatggacgttccggcagcaggccaagctccccaccgtcggcgagccctacggcggctgggaggcgccggacggccagctccgcggccatttcacaggtctgtatcaccgtatgccattcttgatctcatcttgcggcgatcaattttgttcaccgtttttgtggtcacttcacttcgatcgatctctactccatctgaggtgtttgtgttgatttgcaggtcactacttgagcgcggcggcgcacatgtgggcgagcacgcacaacgacgcgctgagggagaagatgaccaaagtggtggacatcctctactcttgccagaagaagatgaacacgggttacctctcagcctaccctgaatccatgttcgacgcgtatgatgagctggccgaggcatggtcgccctattacaccatccacaaggtacattgtgatgaaaacttagatctgttcctgtaattactctgcatgatctgattctgattacataaacagagtggtgaacttagatcagctctttactctgcatgatctgattctgattacattacatagggatgaagttagatcagttctttactctgcatgctctgattctgattacactacatagtgatgaacttagatcagttatttaattgctctgtatgctctgattctgattacataacttgtccatctggtggtctgtcatctggtgttgtgtgttgctgtgggttgtgactcttgtgat

SEQ ID NO: 38189 - DNA, 1784 bp, Oryza sativa
ggattcaatgatgttatgtatcagctttatgccataacggtaattgcaattctgttgcatctagtatttggtaatttgtgtggaagatgtgtttcttacaaattaaagtcgttcctgtcttttgtgcagaaaaaccagaagcatttgacgatggcacatcttttcgacaaaccgtgcttccttggaccacttgggctgcatgtgagaacttgagtttcatttatggtattttgttttcttttgcgaatcgagtcttttgcagcaaagacaggtgatatcttttgtttgcttttcaggatgacgacatatcgggattgcatgttaacacacatgttcctgttattgttggtgcacaaaagagatatgaagtagttggggatcaactttacaaggtaaactgatagtagtgagtaaattcactgtgtacccctgaaaactcactcaatccctttcatacccctaaaatttacccgatcccttctgtacccctgaaatttcaatttgatcccttccatgcccctaccgttacatattccatcattttactgttacgtttggttgcaaatgtcttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaaaataaaatttttatttgaaattttaataggacaatggatttttttatcaggagcattcataaaaaaaatgttgtgaacattggtatacctatctttatatgaatgctcctcatttttatgaccttttttttaaaaaataaatacgtattttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacgtcaactgacgggaggggtatgcaagggatcaaaatcaaatttgggggtatataaggaagtaagcaaaattcaggggtatagaagggattaggaaaaatttcaggggtatataagggattttctcggtagttaatttgggatttgcaccaaaagtcctcaccttgatgggcttataattgtgccctaccatatcggcttactcgtcaggcaataaaaaaatgatgcagcatttaaaacttttttcaacttgagttagctgactttgaaacaaaatatatggcacaggaaattgcaacattcttctttgatgttgtaaactcctctcatacatttgcaacaggaggcacatctaccatggaacactggtgagtgataatccatagccatatcaccattttactttcttaggctctcttaccattgtccctacttaagttcatcctacacgtcaggcacgatccgaagcggctagtagatgagatcaaaatcagctcaaatgaggagacttcgccacatacaacctgcttaaggtgagccatcccttccatcaacgcgataattctacagaaggaagctctgaatttgcccccgtctacaattgcaggtctcacgaaacctgttcagatggacgaaggaaggtaaatacaccgatcactacgagaggctacttatcaatgggatcatgggcaaccagaggggaaaagagcctggtgtgatgatctattt

SEQ ID NO: 38190 - DNA, 5678 bp, Oryza sativa
  unsure (1)..(5678): unsure at all n locations
ttcaatcttcatttcttcaaaggtaacttaattctaaatcacctcttcagccatgacgtaattaaaggtgacatatttttccttcttaaagaatgcttgatactttgttttttcttcaattttctcatatatgcagggagatgcccgaccggcaaatgtgaatgtgaggataccgtcatggacatccgtggatggagcaatagcaactctaaatggccaaaaactcaacttgacatctgcaggtaacttctgttgttgatttgatgtgctatttcttctgctcccatgggtgtgattcctgcctcaatgtttgtttcatgttcaggcgatttcctctcggtgacgaaactttggggcgatgacaccttatctctcaaattccccatcaccttaagaaccgagccgatcaaaggtatgaaatttacacgatcaacatcttttttggcccaagttaatgaaatttatatgatcatcagaactctttttcacggcaagttaaaagtctctgaaatatagtctgaaatggttgatgaaatttttcagatgatcggccggagtattcgtccatccaagcggtgctgttcgggcctcaccttctcgccggcctgacgcacggcaaccagaccgtgaaaaccagcaacgactccaacagcggcctcacccccggcgtctgggaggtgaacgccacccacgccgccgccgctgtcgccgtttgggtcaccccggtgtcgcagtcgctcaattcgcagctcgtcaccctcacgcagcgcgacggcgacgcgcaggcggcggcggcgttcgtcctgtcggtgtcgatcgccgacggcgcgctaacgatgcaggagtcccccgtcgccgggagcgacgcgtgcgtgcacgccactttccgggcctaccactccccctccggcgccagcgccatcgacgccgccaccggcaggcttcagggccgcgacgtggcgctcgagccgttcgaccggccgggcatggccgtcaccgacgcgctcagcgtcggccggccggggccggccacgcggttcaacgccgtcgccgggctggacggcctccccggcacggtgtccctggagctcgccaccaggccgggatgcttcgtgcagcccccaccacggcctacctcgccggcgccaaggtcaggtcagctgccggaaacccaccgccgccggcggcggcgaagacgacgacgacacggcgttccgccgcgccgcaagcttcacccaggcggcacctttccgtctctaccacccggtgagcttctcggcgacgggcaccgacaggaacttcctcctggagccattgcagagcctccagnacgagttctacaccgtctacttcacgntcctcaccaagtgatccaccgccatgtgacagcgagcccagccttgccatggacagaatgacagatcaccaagcttgtccatggcttacagtacctgtaatggatatgaaattaaacatagttagtacctaagacctgattacctaattaacaatcttcaccatggccgtgatgattcaatcaatgcgtgcatgtgtgctcgtgatccagaaagaaagggaaaggcgatccataaatattgtgccgttcaattaggccccaattgattgctgtcgtggaatcttggagaatttttgttgcttctattctatcaacttagtagtataacagtactactaccgtccaatattattgcagagccgtcacgagatcggtagtaggagtatttttttttcgcttcacgaatctttaggaactactatcactgattgcattgccctgacaccaatctgagttcttggctttctgctgagctgatgctccgacgagaagaaatgagaatcagatgtggcaaaaagataaaaagaggtttttgatgctgggatgctggctgcctctccctttccatctctgttcgatctcacgggcgcaagcaagagcaaacgcaacgtgacaaaggggacgcaacgtgacaaacgggacgcagttgtcgtgtgcgacatgtgagtttgcgaccgaggtgaaaaagggacgtagttatctgttgtgtcttaataaggaactaaggaagggcccctcctaacatgccttctccttcctactgtaccgtaatttttttttaaaaaaagttagaaaaaaaataacataataaaaaaatctaatacccttaagaaaatattcatatgcatagactttacacccataaatatatatagtaaacttcgtatgtataaactatatgtaaggaaatattgtatataaaaaatatttaatctgaattcgaatttgaatcaggtatataaaattttaagctataaatttttaggtgggtaaactttagatatataaacttataaaaagaaaaattatatggtgcaaaaataatggagaaaaagaaaacgatcccccaagcgatcgatcgctaattagcgatcttgtcttaataacaactggattaattactgtttctttttttttttatcagaaccactgccgaaaacgatatcaaaaaccaaatgcggaagatcgatgtaaaagatcctaacttgataatgacattaaggcacaatattagttaacgagatttagccgaaacctagcttctcatgtattgattatggtcaattggtcactcctcccgtatctaacataattatagcgtagagttagtacgaccctcaatcagcacgtcctcaatctatcgtccactctcacagtctcacacgcgctaaattatcatgcggtcacaataaatatgtttatctatgtattaaaagagagcttataataaagtccaacacctaaactataatcaattttgtatccatattcaatacaaaactcttgacacttttctaattgtgtgacgatcggctcggctctgcatgcatgagtgcttgtactttgtgcaacccattacgccacatgatgctgcctataaatttcgtttgatacataaaaacgggtgtccttttcgctgtgggcgcaagcgatagaaagtctttggattcttggtagtttttttctcaccatatccacacctgtgctgctggtttgtgtgtgtgtgcctgtgtagtacacgctattcttcttaccttgtgagcgagagagctcgctctcggcgtcggcgtgcgtcgcggtgcgccttatccagcaaatggcgcggcggcgcgcggcggcggcggtggtgatggtggtggcggtggtggcggtggcggtggcgaaggagtgcacgaacattcccacgcagctgtcgtcgcacacggtgcgggcgcggctgcagtcgtcgtcggcggcggagtggcggtggcgcgaggagtactttcacggcgaccacctcaaccccaccgacgaggcggcgtggatggacctcatgccgctcgcggcggcgtcggcgtcggagttcgactgggcgatgctgtacaggtcgctcaagggcgccgccgtcgccggagacgaagccggcggcggcggcggcggagggtttgggttcttggagaaggtgtcgctgcacgacgtgcggctggacatggacggcggcggcgacggcgtgtacgggcgagcgcagcagacgaacctggagtacctgctgctgctggaggtggacaggctggtgtggagcttcaggacgcaggccgggctgccggcgccggggaagccgtacggcggatgggagggccccgacgtcgagctccgcggccacttcgtcggtgagaaaaaccacaacgcccccacgccttcagcttccaactaacccatggccatgtcccacatgttagattagtgtttccatagagactaaatttcagaaaaaccaggtcagttttatggttaaagttatagaaaatccacatactccctagaaaaaaaaaggttttatggttaaagctacagaaaaattacatactccctccgttttcatatgataaatcgctttgaccttttttgtttaatcaactttctttaagtttgattaaatttatataaagatttaacaacatctacaaaaaccaaattagtttcaattaaaactaacatttaatatattataataatatgtttgtttgtattgaaaatgtttatatatttttctagaaatttagtcatacttataaatgtttgattaggaaaaagtgtcaaaataacttataatatgattttcaaatttcacaaagcttcacgcttatacattttaaacatgaatatattgaaatttttgaaatatacagtgtatataaatttttaactaataaattcttgagtaaggttgatagtttaattctttactattttcaaaattttgtttaagatattctaaatttgttaagatttcaattaagatgggttttatgaagtattgagatcataaaacctgtgataatatgccataccttataacttgtggtttttcacaactttgatcgtaaaaacatacagtacggatggaccgtaatttactctttcccaaactagattagagcccaacttaggcccatttatcagttgggcctagtacggatggaccgtaattccggcccattcaagttcgagggcttggatttgatttaaatttctggcccaattacatagatgtaaaaatagctctgctacaatgtagtactaacttttttgtttaaattttcatcaagtgggtcaaaactcaagcaattttattcggcagtagaaatttaaaatttggttcatgaaaaatgcagccagatttttgtgcatataaattgtttaggaaccatttaaacaaatttaaacgggacaaaagttactagtaaaacacaaaatttggcgcgcagggcactacctgagcgcggcggcgaagatgtgggcgagcacgcacaacggcacgctcgccggcaagatggcggcggtggtggacgcgctgcacgactgccaggcggcggccggcaccggctacctctccgccttccccgccgagttcttcgaccgcttcgaggccatccgccccgtctgggcgccctactacaccatccacaaggcacgcaacgcaacccaaagcatctgcatctccaccatggccatgaatctcatctgttcgtgcaaatgtctgaatgaagtcatgaagatctcctgtgcctttcttcttcctctgcatcgcgtgtgcagatcatgcagggcctgctggatcagcacacggtggccgggaacggcaaggcgctcggcatggtggtcgccatggccgactacttcgccggccgcgtgaggagcgtcatccagaggtacaccatcgagaggcactggacgtcgctcaacgaggagaccggcgggatgaacgacgtcctctaccagctgtacaccattactgtaatcgttcttgtcaatcttgatttgtgctgattggaagcacgttttatttcagcgagttaattgtgttgctattatgaatgatctccaattttgggcagaaagaccagaggcatttggtgctggctcatcttttcgacaagccttgctttctaggattgcttgcagttcaggtctgaagatcttaattcccctatggcactctatgttctcctacatgctattcactttgtaattagtaatttattgtacaactaatccagctagaactcgtaatctgacagaatataactcgtaatctttgatgttcaggctgacagtcttt

SEQ ID NO: 38191 - DNA, 1547 bp, Oryza sativa
  unsure (1)..(1547): unsure at all n locations
tttattttcagggatagaatcattctccaagctgggggattctatctctttggagaataagagacaagccaggctctcctttttttaaattttttctcgccccagagggtttaaaccaaatttaaccccccggggaaaaggggcgcaaacccaattttttttttaacttggnaagaactgcagggtctttactgttactcaacaaagtgaagcccctcgagctcatcagatcagtatcttcaaagtctcacttttcattttttgctgcaaaggtacaatttatcttggattttcactgcatgagagagagagagaganagagagagagagagagagagagcaatcaacaatgattagtcttggatcatagtttaatcagtttgatttttgtgacacagacaaacgggcaatatgcaacactgaatgtgagaataccatcatggacatcaatgaatggtgcaaaagcacctctgaatgacaaagatctgcaattagcatctccaggtatgctcataagaattgagagagcacggtaatttgtcgcccataatatgttggaagaactacagatataactctgcctcaatctcgatcttattcagggactttcctcacaatcagcaagcagtgggatagtggtgatgatcacttgctactccagttcccaattaacctaaggacagaagcaataaaaggtatggaattttgagttttattttctattcagcttgaagaaataaatcaaaggtttatcgatcagtaacaaagcccacacacaacaatatatcaaagcaatcgaatactacttgctttccctacttcaacagaccagtatccagaagtcagaatcagtactatccagtgattttgcatttcaccaacatttcggtgaatttgggctttactatcggtacaagaaatgttcatacctgccaaaattttatcccaaattctaatattgaattcagtgtcaattctaagttgacaatcaattaattgttttcacatctattttacttatgttcattatccagatcacctctaccttgtttaattttttttcctaaaaaaatcgaaatgtcaccatattaattttttttgaaaaatttgaaaaatgtacaaaattggaaatagaattcaggataatacgtgctctcatttggaattagtgtgtgtttagttcagcgcaaagtttggattttggttgaaattgaagatgatgtgactgaaaagttttgtgtgtatgacaggttgatgtgatgggaaatgactgaagtttggatccaaactttggatctaaacacagccttaggggcttgcatgtgcttagattgaaaaaaataggggacctgaaccgctgaaaaaaaaactggttgttacatggatagcaaaaaaattgcaaaccaaaatccaatgcatctaagatggtaaattggtaattactactaattaagatgaaccagaattttcacaagagattgactgcaaaatggtttatcttcatcttcagacgatcggccacaggtagcatctctgaatgcgatcct

SEQ ID NO: 38192 - DNA, 2530 bp, Oryza sativa
ccactgcggcggtatcatgcgatcagcttcttcgccagcggcgtgaggaggagcttcctcctcgagccattgttcaccttgagggacgagttctacaccatctacttcaaccttgcagcctgacaagtgagtgacaacgacatggcaatctctctaattttttaaggtggtggaagataattaatttgggctaatttaattctttgatccttcaatgctcaatttagtaattagtacaaattagcatggcaagtagcagttgaatgggaaaatgagtttggtttacatgtacactctgcctctcagtgtttactggagtagcagtgatgttactctgcaatttcagctctttatcttgccattcttttcttagaaagagtatatacctcttgatgcagttgagtatacacaaaaagttctgcaaatgaaagagtacttaaggatcaaggatattcttgacctgattcctaaagcgtaacttctatgtgggttaaaataaaaatctgagcagattcagatattactttgtttgcacttcattcaaagctatctgatgttaagtggactatatgaaatctgagcaggttctgaatttactttgtttgtactctattcaagctatctgaattaaagtggacaatatgatatagtcaagtttgacttaaggtttatatgattccatgcatcgaggtgggtgaacaagtagagcaggttcttttcattatctgatgcctcattccaaatgcattatattaccatcttggtgtataaaacattatctggaggccatgattacaacatactcctctctttctcagataactatggatcatattgcactaatctgattggtgcaaattgctgcaagtctgcaattgtgatgcacccttttgtgtctagagaaaacttttgatgtgtcagccagtgaagaattgatcatcaagactgaaaatcaatcatacagttgcgacagatgagaatacgagatccaagatctggtgacagcgaggagacaatcgagacattcaatggcagatccacaatcaaaataaagaaaaagaacaaacatagaacataaatgaaaatttgtgtagctgtagcaagcgaagatattgatcacggaacctaacatttatgatattcaccttttgtttgatcttttttaccatctatttcatttagttgcatattcaaacctaacagacaaccaaaaatagatcacatagagaagctccacatgcaaaagtatatattccagtgtataatatccaggtaaagccaaagcctacacaaaccaaccacagaaccacattctcaccaggtcacctaaacttctaaacaagtctttgtgggagatatccaggtagtatatatattgtgaatcctcacccagagtttaccatgtagaagattgagatgtactgcacacaggaatggtcatcagtaccatataacggacgattgctgattactattactggttgcaatgtaacacttcggatacaatagtacattacagagctagctaaatgcgaagccacaataccgtcagcgcaagacgatcataaataaagcttacacaacatagccaacatgcaaaccattcggactgaccagagatgagggttcttgaagctgccgtggtgtgccatgcatcacaaatgccgaacaactagattgtagcagccaacatgaaaggaaaaggcatggataatgcagcaaagatggatgatgaagaccgcagattgtgacgcttcgttcaccaaccatatgaaacccctaaattttgtcaagtttctccgccttcaccaccggattagccttggcaatagcatccctagcagcggtccgatagtcaaactggcagtcatgcttatcggaatagcggtgcattgcgcagtacaagttgccacatcggcagttgaatccggtaagaccaaccctcttccgacaagtggagcaccgatttggtccttccctccccttggggttcaccgtgaccccctcactaggaccagcaatctcagcaggctgcgcaacaagcgtcttcacctcgacttgagcaacagctacttcagcgtgaccagcaataattggttccttcccggaatcaccaccattgacaatgctgtcgatagaggaggctgccagcttggcctgctcctgcttcattatcatctccttgtggcactttgagcacatgttcatggtagccgcactgccaaagaagccgcagttattgatgcaaaggatcgggccttctggctgctggcatccagtctccttgtgctccatggcttccttttaactataaatcagaagaagaaaaaatgcgtaaatacaagactaaagaagaaaaacaggttccatttttccactctctaaaagcaaatgcattacaatcaaatgttccacttcagggtagcaaaactgagcagacaatatctgccaatgatggcatatgttcttgattgcgcaaaatacaccgcgacaaaaacaagaagcatagcatacatgtcaaatttcactc

SEQ ID NO: 38193 - DNA, 3482 bp, Oryza sativa
tgcatcacagaaccccccatcaagaacccatcaagaaaaagaaaagaaaagaaaagaaaaaagaaaacccctcaaatcaacagcatcccggatcggccagggaggagcaccgggggcgagagatcgaggcgcgattgaatcgggggggggggggggaaagggagtaggaacgaaccctagaagggggaggacgaggaggcgaggggagaggaatcgcgaggaatggaattcggtgggcttcgaaatggggggcgaaacgtggggagttgggggagagagataaagcaaggaagaagagaaggtggaggccgcgaaattacggaaatgccccttcccttcccccggagcggtggggcccacctcgatttttccgtgcggggtgggccccccaccgtcaggttgccgggttacgattcttttgtgtgtgtgtgttcttttcttcttcttctgtagatggacagtgagggagaggagaaagagaaagtgccgtggctgtacaactcaaaagttggaggactatatgtctttttttttctttttgagaaaagatcttctgaaccttgttttagttaagttttttaaaacacacttttttattgaattattttttaaaaagggctatttgtcctgtcatagactttagcacatgtgacaatgttgttttactttgctaatagaatggtattgtggaatagagtagcttatactcttggttgactgtccatgaatttagagtttaagaacttgtgcgaaatgaagattttatgttgctgcaagaatcttgaacttactaaattaggaatgtaatcttcatatcataaatgaagctctctctttaacattgtcgagtttcatattaaatataaaaaaagggtattcaagggttttgtttttataattgtattaattatatggtttgttccatgggagaaaaaggtaaggttggaggtatagaaaccaaaaggttagtttagtagttggaagaaattgaaagatttaattatattcactttttttttacatttgacttaacacaatacacctcaaaaaaaaattatatctgccttccatcccgccacattgtatgcctattgtttccttgatgattaacacctgacctcttccttttttattccctaaggagctttatccctattgtcgcttaaattatcatccatatgttatacccatatatcaccggggtcttataatgggtgaccattcattgggcgtgcactagtggatcgcccacgcttgtgtatcatattagcatgtgcacgttccatagttaatcacaaggcaaatcataacctaagtgtcagatgaaactaaagtttgaattacaattttaatgaaaattagtcaaaaaaacatttttaatgaaacattttacctattaaccttttatatattatgtttacagacttttcatatataaaaacttttgactataaatcccattctaggaattaatagagctctcctgatttcagaactcgtttatagaagcattatactgtaaaaaaatacattaaatgtaaaagatatatattctctatgtgcaaattttagcacaaatttactataagtaaaggtagagatttccaaatgcaaagtttttttttgcaaaaaaacaaaaaactagaaattgaaacgaaaacaaaagcccaaaagcctatgcggctgaactacggccctgtactcggcttgcacaaagctgcttgagttgggaagcagcgccgaacacctaaaaatgtttgcgtgttattctcacgtatttttcaccctactttactgctccctctatcccaatgtttgacgccgttaacttttttaaatatgtttgaccgtttatcttattcaaaaaaattaagtaactattaattctttttctatcatttgattcattgttaaatatatttttatgtatacatatagttttacatatttcataaaagtttttgaataagacgaatggtcaaacatatttaaaaaagtcaacggtgtcaaacatttaaggaagaatggagtattttgatagtgcgatcacgcctcgctctcgatatgttgcctaggctaccttcatattaattattatgaacttctttttaacttttaaatatagcatttgaccattcattgattagaaagactgtacatgtttttatcgtgacttgtttatcattaaaaatattttaaacataaattttatatttatatttaattcgtttaaataaaatgatctatcaatgtaaaaaagaacggtagcatatatttgaaaacagagtatacgacgccctagccggcctatcgctagtacgttctaccctcaagcagcatcacgcgtacgtataaactactcttgcagatcggtcgagctgtgtgcatgctacgcggcagtacagcagcggacgagagatcgatgggaagaatgagatgagcgctgggcatatatgtatgcgatgatgcataggtggtggctggaaaggatggcgattttgtccgtctctagagcgttacgttttgtacgtggcgagctggcaatgatcatcttgtactacgtgtgtatggtagtagtccacctgcctgtacgtgcaccaactgcatctcccgcacccacatttctactgcctctactcatgcataaagtactccaagttttaggatcagccacgaatattagaacgaaaagtaaaaaaaatatagaaatatattctaggattcaattctagaaattgctatatttgagataaagaaactaaacaatagtcgaaatattttcctcttgtatgttaatcacattttacaccatacattctgcataaagattatcgcattagggcttgttccatccattgctaaaacgaactttgccatttgttggtaaagctaaaagttaggaatgttcttttttttttatttttccaaaatgagatatgtggaggtaatgtttggtttgacacttaccaagattttaatgtacttatacttatgtggcagtgtggcactactacaaaaatcatctttcatggcggccattttggcttttcgctggcggaaatcgcagccgccacaaaccaaaggccagtgaagatcacgatcttcgctagcggttttcgaccgccagcgataattcatttttgctggaagtcatcttaagccaaccgccagcaaagatccattttcgctagcggctgacttaagacgaccgccagcgaaaatgaattatcgctggcgggttacaatgtgctagccgccagtgttaattctggccaaatttaaaaaacggagcgacaccgctccgtccgccctccgtcaacgctccaccattcaaaaatttcacagtaatttatccaagtattcaaaaatccacaaaaaattacatgaaaaatttacaatcaacaatttccattcactcaagcattcaagtatcacaaaaatcaacacattaacaaaattttgaagtccgctgccgagccccg

SEQ ID NO: 38194 - DNA, 4187 bp, Oryza sativa
gctccaccccctcccggcgctggatccgccgcgtgcacccgaccaccgcttcgagccgctgctaccgctctctttgcagcgatcctctctgcagcgaagggataaagaagtatgaggtgaggagtgaagggataaggatagggtggggagatatattttttttatagctcgagtaattttttcgctggggctacgtggtgaaaccttttcagaagcggttgcatgagtggaccgcttgtaaaaaagacgaacgcaagtgaagatctgccatttttgctagcggtgtattaagtgtgccgccaacaaaaaccataatatctttgatggcggccctcttaaatcaaccgctaacgaagatcagtttttgctggcggttcgaaacttcctaccccttgttatattttctgttgtggttttcataaatattcgccataaaaaatgatagggtgacgctgtgaaaaattatttttttaagtaatgtgggttgaagtttctagaattaccaaatattcttttaataattgataaaattaccgaatgttagtagggattggtaatgttgcgaagataaagtttgtttagctcgttaccctatccaacttaatgttgttggtgattttgtcaacagaactattctgagctggagggagtgagacggagaataaaaaaccaagctagaatctgaccgaggatttaaactgttattattttttttaaaaaaaaactatagccgatgttcttcaaaattttcgatccagaccttggcacgaccataccgcagtccaccccccaacttgctcattttgacgaagggctcggagacacgatcgacggcgacccagcatcgatcgatttcgccgccaccgccgcctggcgcgacactgcagtaactgtgggcggccgccggcggcgcgagcacatgaaagccggcccgtgccgtgcgacgtgcgttgcgggcgtgatccgcacgcgacgcgggccgtgacagcgcccagtgggcccccctggtcggcgaccttttcttcctggtctggcgccgtgggcgggtgaaagctgatcttgggctttggctgacttctcgtccagtagccacttttttgggcctaacgcggcctgaagaacactttcaaactggacggattcaaaggagcacgagcacgagaactcacgtttgtgtatttttgttgttggcaataatgtgaaggaataagttcactctaggtccctctatttgtcacctagtccgattttcgtcacttggtcgcaaaaccggttacaacgcatccctcaacttacaaaaccgtgcaaaaaaggtccctcgacagtattgtgcctggttttggatgacgtggcgcctacgtggctccctttaactaggttctcgtcccacgtgacattgacgtggcaattggatcccggggaaatataaaaaaccgtgggacccacatgtcagctacacaaaaatatttttaaaaaggagggacccacgtggtctcacatgtcagcctccctcttctctctatcccctctctctctctccctacaaggcaggagaagtgcgagcggcagcgagcggtgggcatagcgatggcggcggcgggcggagggtagactagaggggcggcgggtggaagcagagcggcgacgggcggtgggctgagcaacaacgggcggcgggcggcgtggcgagagcgctgcgagggaggaggcaagctcgtcggggcggctggcgggagaggaggcaacgcgtgccgtccgacaggagggagggagaggagcatcggtgcgtgggggacgccggtcgacgggagggcggaagagtagcggcggctcgccggcctctccgcgctggtcggcatccccgtctcctccctttgcaatccagtgtagagctcgatggcggggcgccgtgggtgcggctcaacggtcacgggcagaggaagagttgcaccgggcggcggccagcgacagtctccgcccccttgccggtgatgcgtcgcgtcggccagccgcgccacgcacgcgccttcacccctctgctatggtgtcattctctcaccactgtcgcgctttgcttcggccgtcgccgctctgactggtgccaatcctccgccacagtccccaatccaccacgataccaccagtctgcttcgggaccgctgttgcctccgccttcgccaccggtaggcggcaacggaagcccggacgtcgagggcgtggcgctggccgacttcttcttcggccccaagttggatgacttgatgcagtggctaggagatggtgacgccgggcagaagggcacgctgccagcctcctcgtcatcgtcatcctacgcgcagcggggcggggcggagcgggcgggcggacggcggccctagaagaacggaacggagcggggcaccggtgggcggaaaggggagatgggaagaggggagaaagaagaggtagcggtgagaatgacatgtggggcccacgtgggccccaccatttttattaatttgtgtgtgaaactaacatgtgggtcccacatgatttaatatttttccgggatccaattgacacataagcgtcacgtcaatgccacgtgggatgatgacctagtcaaaggagccatgtaggcgccacgtcggtcaaaaccgccctccatactaccgagggaccttgtttgtctggttttcgtaaattgggggattggtagtatctggttttgcgatcaagggacgaaaattggattgggcgacaaatagaggaaactaaagtgaccttattcctaatgtgaaatgtctgactgttttctgaatcacagctcgaataaaggtgtaaacgatgatgcgattgctgaatgtacacggttgtttcttttcgtattttggatgctcatcctgacgccgttcgtctgtctgtgtccccctgctttcgctctgttttctctccctgacatcgtgttatctatcataccatttggtgacaaagcccaatgtatgctcagtccatcaatactaaagtttctaaaaaaaaagaggaaagtgtgcggtggaaacttccatgcgttaaatagtaatccccgataaaatcaatacaaatacaaaatattaattactgaactacttaagtacacccttcgcgttaaaatataaaaagttttggttacatgagatacatcaaaatataaaaaatattaattgctgaactacgaatctggacatgatatattctatccaaccaaaacatgtcaagatttgtatagtactagattgtgtctcatccaatcaaaactcatttttcggatggagggagtatatggttaacggaattactaatctcccgtcgacaaaaaaatgcattaccaaattttgcagattttggatcattagagtgcttcacggttcatgttccaagtgcttcttctccaactccaacaaccggcgacaacccaaactccgacagagggctggcaaattaagatcccagtgtgaggaggaggaggggtaagaaaagggagtcgtcgggcttagaggaatggtcatgggagttggcagcctggcggtgggcggcgggacaggtggacagtgccaaagctatggggatggaggagggcggtgagctgacgttggtggcaggagcatcctgctgtcgacggctcgaggagaaatgagagaggggggcgggggagggaaaggaggccggtggggagaggtgtctcactggtgctgatgacgtcttccggcgagaggccgagcggtggcacggttgggcggtagcggcgatgtaggaggggttaggttcactgcacgaattttaaagtgatataatggttcaaaattcacaagattttaagagatgtttttttagtatataccgtcccattaattaaaggaaaaagtacgaattacccccctgaactatcgaggtcgaccgaattacacccccaaacttgaaaaccagacattctacaccctcaactattgaaactggataaataacccccctgactcaatccggagtggttttgagtctacgtggcagtccagtcagcaatttttttttaaaaaaatcaatgggccccacctgtcagttcccctcccctctctacccctcactactctatcccaatctctcctctctctcctcaccagcacggtggcgaccgctcgagggcgggatcaggcggcgctgccggcggcgga

SEQ ID NO: 38195 - DNA, 1444 bp, Oryza sativa
  unsure (1)..(1444): unsure at all n locations
atgcagtgacgatgcatatgcacacacactgtgattagtttaattaagcttagcttcgatcttgctctctagaacaagttgacagtgcatgcatgtgatgcatcgatctgcgcaggtactggcggacaggttattcccggcgatggcgacgccgacgacgcgtggccccgacgacgacgacgacgtgtggacgcacgtcacgccggcccaccggcacgggtcgtcggcagcgcccccgacgggtcgtcggtcaccgccgtcttgaacgccagcgccaccaccgcctccacccgcgcgcctcgagtcgtcgtgggcggcggcgcgtcgccgtcgacccacgccgcaccgcctccaaagcctacagacaacagatcgatcggccgtggtgcgccggcacaatgccgtcgccttttcggtacgatgatgacgagtaggagagtggcggcctggtccgggcatggacgtccgaggagaggaagttggcgtcgccgtcctacccgctgcggccgcgtcaccggtcgatgagnagnaggtcggagagcgcctttccccccccccgggggcccctcttnncccgccccttcccaccaaccggctgnccgggcgagctccgcctcccgctgccggccgcccgctccgcctccgtctcagccgcccgccgccctccgccttccgccgctggcagcgacgcctgctcctgctctcgcgcggtcgccaccgtgctggtgaggagagagaggagagattgggatagagtagcgagggacagagaggggaggggaactgacacaggtggggcacactaattttttttaaaaaaaaattgctgtctggaggatccaaaaccactccggattaagtcgggggttatttatccgatattaataattgagggtgtagaatgtctggtttttaagttcgggggtataattcggtcgagctcgatagttaggggtaattcgtacttttttttttccttaattaaatcaataaactgcgtttgtgctcacttaatttatctcaacttttatgagcgtgaagacacaagcaacagccatgcccatgcacgctcctaaccacccaccattaaccaaccgtaaattagctcctaaccacgctcctaacctctcgttctcgacaccctcctccccttataaactcccctcctcttcaccctcttctcctccaacaacgacgcgcagaagagattggccacccgcctctcgattcgctccccaataatccagagctaccactaataatccccctccgttccagcgcgcgcggcggcgggagctcgtcggagaagaagaagaagaccaaaccaggccggccggtcgtcgtcgtcgtcgtcgatcccctcccgccaccgcacccgccggctgtgatactatggagatgaagaagatcgccgtcgcattcgccgtcctcgccatcgccttcg

SEQ ID NO: 38196 - DNA, 672 bp, Oryza sativa
agccatggtttgtatctcatgagcctgttcgactacagaacgtttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaagtgcacaccggtgaatttatccggcctcagtgcatcgacaaaaccagccatagtaaaatcacagtgcctataataaggtttttggattgttgagattataggcatataatgatttaatatattctataaataaatcatgacattgcagatgtatactagcattaacgcatcattagatctacacatgtaaactaagcagtaaaacataaacagatcaaatatgcgcaacatattgaacacgtaccgaggtggtagaaagaacggctgctcggtaggaacttttcgcgattgcaggcatctacgaaggcgcgcagcacgcgagcgaagagg

SEQ ID NO: 38197 - DNA, 4672 bp, Oryza sativa
  unsure (1)..(4672): unsure at all n locations
nnnnnnnnnnnnnnnnnnnnnnnnnnnnnnnagcccgaaaggccgaaccatttaagcagctcggctgttccaaagcccattacaggttccagacccggattttagtaacaaggaataagtctacggctctcatcggatggcctaatcagccaaagaaaaaaccaaaatttaaattttcaaacttaattttgagattgattttgagatattttcaacgtaatttcttttacaacattagcttttaagtcaccaagaacacatttataaaagtttcatctacaaatttatttttatttcctaagaagcaataggaaataagccaaacaatgaggacctagtagccaactggcaaggaataagacgacaaccgttgccgcgccttcacccgtccaccgccggcctccggtggtcgtccccctccgcaagccttcgccatggccaccactcggcctttatcataatcgttgcttagcttcctcgtaccgacagtaagggcctatgaagaggttttcactgacacatgggcactgaatttatcatttttttattttttgcaaatataataccacttcaacttaccacgtcaacaaaactacttcccaaaccatcgaaatagtcgatttgcacagaattttaataatagaaaatgtgttataccaggtttaacggttgcgattcaaccgagaacaaaacatgagagaggtcaaatagacttattccaattggcaagcggtgattcggcccagtaacaagggccatcttctcttgcacggtaggagtttgctccgtattctatttctgcaagcgcagactagggctctgtttggaatattagctcagggctaattttgagagctaatgtttagtcatgaattggtaggctaaacattagcctagggtggtatgtttggatccatgggctaattcaagactaaagggtgaagagagtagaaagagaggagagagaaggagagagagagctgctttttatggttctcacataaaattagccccattaacatctcttggaggggctaatgttttgaggggagctaattcacattagctcaaaattagcccatattttagattcttaagagttaatttgagactaagaggtgagagctaaatattagcccatgaaaccaaacaaagtgtttaggtggagagcacgaggccacccactccaaacaaaaaaacgttatcctgccgtcccacgcaggccaagtcaaaccgttgaatcgccagccttggaaaagttgaaatactccgccacgtcccacgtacgcgtggtgaccgacgcgacgctgcgttgctcgccgagacgccgaccacccgccgaagttgcaccaccaccaccgtcgccggcacgcgcagatgggagagcccgacgacgagatcacgttcgagttcctgccgctgatccggtgctacaggagcggccgcgtcgaccgcctcctcccggacacccgcgtcccgccctccgtcgacgccgccaccggcgtcgcctcccgcgacgtcaccatcgacccggccaccggcctgtgggcgcgcctctacctccccgacctcgacggcggcgagaggaagctgctgcccgtcgtcgtgtacctccacggcggtggcctcgtcgtcggctccgccgcggacgcgctcgagcacgggttcgccaaccgtctctgcgcgcgggcgcgcgccctcgtggtgtccgtcgactaccgcctcgcgcccgagcaccccgtccccgcctgctacgacgacgcgtggtccgcgctgcagtgggccgtcgccgccgcgagcgccgacccgtggctccgcgaccacggcgacagggagcgcgtcttcgtgctcgggtacagctccggcggcaacatcgcccacaacgtcaccctccgcgccggggccgaggagctcccccgcggcgcgagcgtcaaggggatggcgctgctgcacccgtacttcatggcggccaagaaggccgacggcgaggtgaagaacgcgtggctgaggggcaagctggagnaaatgtgggcgttggcgtgcggcggcggccggaccacggcggggctggacgacccgcggatcaacccggtggccgacggcgcgccgagcctgcgccggctcggctgcgaccgcgtcctggtctgcctcgccgacgacgagctggaggtccggggcaaggcgtactacgacgggttgctggagagcgggtgggcagaggacgccgccgagctgcttgtctccggcgaggatcacgagtacgtccaccgcgatcccgacagcgccaaggccgtggttgtgatggaccggctagccgcgctctttggcgggaaaaattagaacagcaattaatcacattctagtgacctgcaatgttgttgatgaatgctggagttttgttgcattctgagctgtttgagctcacaaaaaataagaagaaatgaagagagaaaaacatgttgtgctgtgcacgttccaccttcagtaatcagcggtattatggagttgaataaaatggaacaagttgtttcttgtttgacttattatgagctttatttgctcatggagcagagccaagggaatcttgcacatgagctccctctattctatttgctgcattctcaagaaacagcgactcctcactgctaaccatgttagtatattctttggatcaagcttcggaatgaaggaaacgttgagaaaagaaaagatttaagaatggaaaaaaagtcacccttgtacgaatgaatctcatctgaccaaatttaccccccaaaccgataaaatttctgggcgaattggtcagaatttcacagctcttccaagttgtaatcattttaaaatggtttttagtagcagtaatcccattaattggaagatttgaacagcgacttggcaactactggtagatttggtatatacacttgacgaaacccaaagtctaacacgcgcccctcctcttgcgttctcgcctcggtctccaactctgcaaccaccgccgtctcttctccagatctccaccgcgccatggacgccgcacccaccgcgccgccggcggcgtcggccgacgacgagatcgtgtacgagtcgatgccctgcatccgcatctacaagaaccgcgtggagcgctacttcggctccgagttcgtcgccgcgtccaccgacgccgccaccggcgtcgcctcccacgaccgcgtcatctcctccaacgtctccgcgcgcctctacctcccccgcctcgacgactccgccgccgccaaggccaagctccccgtgctcgtctactaccacggcggcgggttctgcctcggctcggccttcaaccccacgttccacgcctacttaacaccttcgccgcgctcgccaacgccctcgtcgtctccgtcgagtaccgcctcgcgccggagcaccccgtcccggcgggctacgcggactcgtgggaggcgctcgcgtgggtcgccggacaccccccgggggatggcgacaaggcgtggctcgtcgaccacgccgacttctcccgcctctacctcggcggcgagagcgccggctccaacatcgcgcaccacatagcgatgcgggtggccgaggaggggctcccccacggcgccaagatccggggcctcgtcatgatccacccctacttcctcggcactaacagggtggcctccgacgacctggaccccgccgtgcgcgagagcctcgggagcctgtggcgcgtcatgtgcccggccaccacgggcgaggacgacccgctcatcaacccgctcgtggacggcgcgccggcgctcgacgcgctggcgtgcgaccgcgtgctcgtgtgcatcggcgagggcgacgtgctccgcgaccgcggccgcgcctactacgaccggctcacgtcgagcgggtggcgcggcgaggcggagatatggcaggcgccggagaaggggcacacgttccacctcctcgagccgcactgcgacgcggccatcgcgcaggacaaggtcatcagtggcttcctcaaccgttgactcgccgtcgccggcgatgacaccgtcgtcgtcggaatcggagattaccaagattagcatcggttcatacccagaataactgcagctacgtcgccgacggatgccgctgccgcgccatacttactactccactactacattttacattttggattcaggattgtgttgcatcttttgcaattgggtgtatggatggaaggaaatcgccattgatttaggtgagggtattgtagtatcaggaagttgggggagataaatgataatactacagtcatagacttcatacagatgaaattattctgctttgtttgacacattgattcattttctttggaactccagtgaaagcattgttcttaactctttgcatcaaagaattacttgcttatactcttccaaaagaatgattgcgcgattctgtatttccgctgatcatatatttgtcaactgatgacctcacatggagtgatgccctccatcaaattctttccctaccttccatcaattccttttcctatcatcatcctttgatgatactaataggcagttctttgaaattaaaatacttgctggacgcatgaattctttgattttttttaatcattttggcagattattgccgttcatcaaagaattgattgttaactcttacataaaaaagg

SEQ ID NO: 38198 - DNA, 786 bp, Oryza sativa
ataaaaaaggctctattcatgcatttgtcaaggacggtgcacacacattgattcattttctttggaactccaatcaagcattgttcttaactatttgcatcaaagaattacttgcttactcttccaaaataacaattgcgcgattctgtatttccgctgatcatatgtttgtcaactaggatggcctctgatggagagaccccctccatcaaattctttccctaccttccatcaattccttttcctatcttcatcctttgatgatactattaggcagttctttgaaattaaaatacttgctggacacatgaattctttgattttttggaatcattttggcagattagtgccgttcatcaaagaattgattgttaactcttacaaaaaaaagggctctattcatgcatttgtcaactaggacggcgcacatggagtggtgccctctccttcatcaatttcttttcttattatcatcattagataataagcatttctttgaaattatttatacttgttggaatcatgaattatttgccttttatgaagcattgtcatcaatgtaaataccttgcatcaaagaattgctttactcataaaaggttgctctgctaatgcatttctgaaactaggctgactcacatggagagatgtcctctatcagtttattttcatattatcacgctttgataataagtaattatttgaaattatttatagttgctgaccacatgaattcattcccttttatgaagcattattgtaaaatgcagtatcatgcatcaaaga

SEQ ID NO: 38199 - DNA, 918 bp, Oryza sativa
  unsure (1)..(918): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagagaggcaaggttgttttgcaaatcttttatttgaagacattttgaaatcactaagtgatttatttctttctaagtttgggccgaaaagagacttgcgtctcgattcgactttaagagatgtttttcaacagctcatttggcaatgtaccgacctcccgggtcagatcattacttctcggctcccagagccattccacttgattaatcggctcccagagcctttttcattttctcggactcccagagtccagctacccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccaaggttacctcatgccacatagaaggatcaaatcctcacgtaagtataggccattttaggcattcacaaatcaactccaaccaccttgatcggtaagtgagcaagcttctcgtccttgccttaccaggaacccggtttgtccgaccccgccccggcgttcccaactattggcatgcgaggtttccctgaaccgactagttacttagccagggtg

SEQ ID NO: 38200 - DNA, 617 bp, Oryza sativa
ggctttctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgca

SEQ ID NO: 38201 - DNA, 1472 bp, Oryza sativa
tcacctcacatccgcccatgaccgtgggcacggctgttcgaacagttttgttaacctctgcagaggggggtacactttacccacacgatattcttaacccggatcacccagcccgtggggatcagccacgtcggaagcctcccaagctttcatgacaaggcatttcaaaagccgacacaggtttaccatatgccgacgagaggggtcccagaccaacaacaggttaggtcccagaccatactgtgccagaaagcccaggggtcctccccgacaccaccccggtgaatccacatgtctctcggcatcaaagctcccccgataagctatttactcagccaggggcgtcccattccacccatgtggtcgtacttgtcttatgttcggatgaaattccaaggaaacggtccttaagtgcaagagcgggaaaccgtacacccggtaggatccccggtccgcggttttggaaattcatttggttcggaggcaccgacccaggtgtcgggttttccaagtcttttgtaaaactccagttttacccaagttgttactcagattttaaggttgaaggcgaccgtcgatacttgcacagagtgcacgagtatcgaggcgcaactgggtggttacaaggggacatggtatagcaattaacaaaggaaggatcaaatgcgacaaattaggtaggtccgccaatctgccttgtagacgggacaaacagattaagtgcgatcctatcaatgcataatattttgcaagcaacataattaaatttcaaatataggctcaagatgttcaaaggtggcttgccttgctcgagatctggagcttgatcctcgaaatcctcgcactgcgggtcttcgggctctgaaactatacgcgaaatggaacaactcaacaaacggcgaaaataaagccctattaatgacctctaagcgtgccattagatagatctcgagatttggggaattttggaagttgaacggagtcaaacggatttacggttgggaagatattgaatttctaagattattgaatttttgatctaaaggaaaaggatttaaataaatcctttctggaaaagaaaaagaaaagaagggagggagggaatatagacttttctcggatggctagggcgcggcccaagagaaatggagcggtccggccgagctaaatgggccggccggcccaaggcagcccaaactcgcgcgcgcgcgggaggagggagagagagagccggtggaccgggctcaccatgcgcagtcccgggtgggacccgcttgtcagtggctcggctcaccgtgcggagggagtacgcggctcatgcgcgcgggcggtggagggactcggtgcacgcgcgcggttcgcggtggacgcggatgcatccggcccacgcacagcctcacggtttgcggtggaacgcgcgcacggggagggactgaccggggtcggctcgacccggtctaggctgagctggc

SEQ ID NO: 38202 - DNA, 4181 bp, Oryza sativa
caagttctaactgttattaaatgatcatgcaaactgtcctcgtattataatgttattacttattagtcatttctaatgcagggtcattaatctctcattgcttgttttgagttttgttcgtttttcttgcttattttttaaattttattttaggtacttcagatgaagagaatgaaagtgagactcagaagcttcctgaatattctacaagtgattcagaaggtgaatcgagctaggttatttctaactgattgttaccaaattatcatgcaagctctcagcatgttataatgctgcttattgatcactaccagaacatgtaaattaatcgcttcaccttgttgcaccagatttctgggaggaggaattgtttcctgaacttattaagcccttgccagatgatggtcagtcattgctttcagttttgctagctattagtatcacatgatcattatttactcttcaccttgttgcaccagaattcacgcagcttttgaaaaaggatctaaagtctcgtaattatcccatgccaatcaggttttggggtgagtcattgctttcacttttgctggttacttttgttgcacattttgacggtattttctagcaaactcaactgtagttttatgtttttttaaccagggggtatgcgcttgaaaaatacttttgaagaggaatttgctgaagatacatggtgcaaactgagtaaaaaggttgctttaaatacatcccaaagtgttgtctcacttgcttcgttcaaaggtgagattacaatgttatatgatctttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacgcgcgcgctcgctcgcctggctcctggcaaggcaggcggcgcgcgtgcacgacgtacgcgtcgaatggtccgaaaaattggctcctcacccttgcgcagatgcagcctccttttgcagtttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactggctgaacagcagaagcaattcgaggaagccaatactctctttgtgggatgcattcttagcgttcttggcgatcgtctggtcgaggtgtatatgcatatgaccgacgctaaggagttgtgggatgcactgaatactaaattcggtgctactgatgctagctatgatctgtatatcatggagcaatttcatgactacaagatggctgacaaccgttctgtagtcgaacaggctcatgagatataaaccatggctaaggaactcgaacttcttaagtgtgtcttacccgacaaatttgtggccgggtgcattattgcgaaacttcctccatcttggagaagtttcggtactgcactcaaacacaagagacaggaatactctgttgaggggttgatagcgtctcttgatgttgaggagaaagctcggaaaaaagatgatgcgtctaagggcgatggtgggcagtctagtgccaatgttgtgcacaaggcccagaacaagagcaaggggaaatacaaagctcagcagaccaccaacttcaagaagcagaagaagaacaacaacaatcctaatcaggatgagatgacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcttgttccgcttttccctttctgatttctgcaataagtctgtgaaccatatttgtggcagtgtggatgatgaggctaatgtctggcactcacgtttatgtcatattaattttggcttgatgtctcggctttccagcatgtgtttaattcctaagttttccattgtcaaaggttctaagtgccatagttgtgtgcaatcaaagcaaccttgtaagcctcacaaggctgctgaggagagaaacttggcacctctagaactcctacattcagatctttgtgaaatgaatggggtgttgacgaagggtggaaaacgatatttcatgacattgattgatgatgctattagattttgctatgtgtacttgttgaaaacgaaagacgaggctctagactattttaaaatttataaggcagaagttgaaaatcaacttgacagaaagataaaaagacttaggtctgatcgtggtggagagtttttctcaaaagagtttgacttattctgtgaggaatatggcattatacatgagaggacgcctccctattctcccgagtctaatgggattgctgaaaggaagaactgcacactgactgacttggtgaatgccatgttggacaccgcgggactacctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtagttctagtcaaccctctgaaataattcccagttcaatcacaccaccagaacaaactgaacatacacatgaacatgtcactgaggaggatgacagtgaagctcctcgaaggagtaaaagacaaaggacggctaagtcctttggtgatgatttcactgtgtacctcgtggatgacacttcctaagtcaatttcagaagcatatgcatct

SEQ ID NO: 38203 - DNA, 2898 bp, Oryza sativa
tgaggttaaatcattcttgtctcaaaaatttgatatgaaggatttgggagtagctgatgttatcctcaacatcaatctaattagaggtgagaatgagattacactcttgcagtcccattatgtggagaagatcttgaatcgctttggctacattgatagtaagccttctccaacgccttatgttcctagcttgttgcttcgcaagaacaagagaattgctaggaatcaactggaatactcccaaatcattggctcgctgatgtacctggctagtgcaactaggcctgatatctcctttgctgtgagcaagttgagctggtttacctctaatccaggagatgatcactggcgtgcgcttgagcgagtaatgcgctatctgaaaggtactatggaattggggcttcactattctgggtaccctgcggtactggaaggatatagtgattctaactggatctctgatgtggatgagatcaaagccactagtggatatgtcttcacactagttggtggtgctgtttcatggaggtcttgcaaacagacattttgacgaggtcaaccatggaagcagaattgacggcactggatactgctactgttgaggcagaatggctgcgtgatctattaatggatctgcctattgttgaaaaaccagtgccggctatccttatgaactatgacaatcaaacggtaattgtcaaagtgaatagttctaaggataatatgaaatcgtctagacatgtgaaaagacgattgaagtctgtcaggaagttgagaaactccggagttataacgttggattacatccaaacaactagaaacctagcagatcccttcacgaagggactatcatgaaatgtgatagacaatgcatcgaaggagatgggtttgagacccatgtgagtaatactatggtggtaacccagtctatgtgatcggagatcccgtgaattagatcctgggaagaacaaaccattagtaaactagaggagagtacaaatatatataccctatccaagtgaagatgcatatactcttgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctctatcgaaccgctggtatataaacagtacattggaaaaggcaaatctcagtgggattttgagatttggtgggggattgttggaattaatggatgggccttagcccactcgaagattaattctttggaaaatcacaacagcccacctcatgggatggtatgcatgtggagtttagtaccaccttgcttattctaggagagggggacctccttaaaaaggaggatgccctcctagccacttgaagcatgtgtggtggagagaagagggggaacacgtgcgcgctcgctcgcctgtcctagtcgggcacggcaggcggcgcgcgtgcacgacgtacgcgtcgaatggtccgccaaaaattggttcctcaccttgcgcagatgcagcctccttttgcagttttgttttgctgcaaattcggattcgtttttgttttggaaacgttccgaaaaatccggtgcgtgaaaacgacgtggagtccggataagttacgcgcgacttatccggttcggttacacgcagtggagatcgtgcgggcgacctgatcaagcgacccttctctatacaaaccgacctgccgtcttcacgcaacacacgaaaaaatcaatctagggtttgcctcctactctgtgctacgccgtcgctcgtagattactccatctcgctcgccggcgtgcaccggcgatcgggagagcaggtctccggaacctctaccttcgacgtcctgcaccgggagaaggcggcaataatgtttttgggaagcgcttagcgcgactgctccctgttcgtccgcgacggctcgtcttcctcttcgctcgcgtgctgcgcgccttcgtagacgcctgcaatcgcgaaaagttcctgccgagcagccggtctttctaccacctcggtacgtgttcaatatgttgcgcatatttgatctgttcatattttactgcttattttacatgtgtagatctaatgatgcgttaatgctaatatacatctgcaataccatgacttatttatggaatatattaaatcattatatgcctataatatcaatagatccggcgttcctgcctgtgccgaatattagctatatactgtagctgttcttctcccgagaccgcagtcaccgtacgcgtgcgtgatgatatatatgagcaaatctatccaactgtcgtattagggacctagggtgcacttctgatatctaaattaatgacattaataaggatactatttaaattaaatatatacttaaatatagtgtatatatgtatgtctgttattattaaatcaatgcagtatgtccaataaccataaggtggctgccatttggattgggaagattgttcaacgacagatgaagtcgattcagtgaatggatcgcctaattgttatcgatgagctcttcagaaccaaatggtggcatgactttcatagggatcaggtgtatgcttgcgtgtttatagaggtgagggtgtacgtgttatgagcacctatctttgtacgtgtttctcaaataaaatgg

SEQ ID NO: 38204 - DNA, 1564 bp, Oryza sativa
gtcgctcgtagactactccatcccgctcgccggcgtgcaccagcgatcggagagcaggtctccggaacctctgcctttgacgtcttgcaccggagaaacgcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacaatctttacttctccatatttgtctgttttctctattccatcacctgactataattgcaatcactgatctttgtaggagaagaaaggttttttgcttgcacaggtgtatttatagacttcaatggatccacatcaagagttgtgacttcagcaagtttggttagaatatctgctgatgaaaacaagattgctgataacctgaaggttggcatcacaaacactccttttgcttgtgcatttgagatactctttaattctcacattgtgtttcttagcagattaaagtgtaccttccaaataaacgaatcgccgtaggcgaattgcagcattgcaatttgagctacaatattgctgtggtcagtgtcaagggtttctgttgtcttcggacagcagaactcgacaaacagatgcaaatcgaacctcatagggaggtagtagctataggacgtatctttgaatcaggcaaattaatggctacaagtgggatattgtctgacgaggaaagcaagcttgactgcagagagcttatgatctccacttgtaaaatcactaaggtacattgggttgatttctttcatggtgtaaacaattaattgtatcagaatatgagtaatttaattcatcgcttcatatgcgtgtcattgaaaatttcatctattcatgtgctttttttttttttgccaggccggtattggaggaccactgattgattttgatgggaatttcgttggcataaacttctatggaacaaaagaaacacattatctaccacgattaatgatacagagactattgaaggattttgacgggtacgtttttcatattttttgtagttttttttggtatatgatcatatcagcaagtgttattcatctggattttattttttttaggtaattgcacttgcttctcaatgacttgtgtgattctttccatcttttctaatatatgtttggtttgaggatgatgtgagatgggttaggtccattcatatatttttaggatgagatggatctgatttttgtttggttggagggatggaacggaccatgtttaattggagagatggattggaccaagccaaccggcaactggatatacgcagaatattccttttagacaacccaacctacggttcaaaccccaaggataatgagatact

SEQ ID NO: 38205 - DNA, 4988 bp, Oryza sativa
tcaactattcttcagttagcctctaccatgtgcgagtagagtttcttctacgctggtttgcatggttacgagttgaaatttattttaaaaatacttttgagaatttgttgtggccatgtaatattattggattaattagctgtagtgtttcttttaggcgtagtagctagccacctcaagtaaattcggataaagcagaccttacttaggtccgtcatagggtagggttcacgtttttttctttttgacgaaaatcgactgaagaaccgtgaaatttcgaggtttcgatgtgggaagaaagtatatcccgagtgaaagtttgaatgggttttgagaattcaaatttcataatccaccaatccctatgcatcatctggcaagtgataggttttgaaatctcctgtgatataccaagcgaacttgcgggtggcgcagctgagtccccgtctcggacgctgcgagttcgcatatttcctttccatatggcgacagtcagtggggcaatgactgtctagttaaaaataaaaaaaaattacaatgagaccgcacaccagcgcagttggcacgacaacggtgaagccagtgacggccccacgatgtcttgcgaatgaccagcggccaccaagaggatggtcgaggatgtacagcaacctctatgatggcgccctcgccgatgcgtgtccccttcttttgccccttgccggtggatgacggtggccgggccgctttggttgttttctgccatggactccccgatttcctccttcgacatggcccctgacgcgtcctatataaaatacgcttccttggtttcctccttcgacatgatcggagcgttccccttttccattccagtcaacacagcacccaccatgttcttgatcactgatggcagcgccgccttcgttttgacgatgactggctcgatcacgaattctctcagcggaggagatgggcatattggggaggagacatgagttccaccgtatttttttatttttaaccggacagtcactgtctcattcatatgtgggttccacggcaattaggggatttcaactaatcctttccggagaattagacggcctacccgaacaagttttttatttggtgggtaacatcaatgaagctagcacgaaagctataaacttagaagaggaaaacaaattgaagaaatgaaattaatctttatgtactgactcctaagcgaattatttgggattgtgaagtgaaagaaatcattttttctactaatagtggccaaattggcgtattaccaaaccacgcccccattaacacagctgtagatatgggtcccttgagaatacgcctcctcaacgatcaatggttaacggcggttctgtggagcggttgtcagctgaaaccaccatcgaaatcgtcttaggacattatttgtattggttttggaagttgagggatacatcatatcagtctggtattgcagttcagggaggaattcagacttagcgacaaattgaaggacctaaagtgaacttattctttcttcatcacccactcagttttgttaggctatgtatggatcttggtgggggctaaaatagcctaattccaattcaggcccagattacagatcacgcagaatggcattccctaaactttcttataaagagttgcgtattattagaatccaggcatgcacttattagaatcctcgagacaaacatagttacatgggagggaaattctcatatctcaagtgtccaaattcatcagcaaaatgtaaacaaaaacaaaaacaaaacgaaatctcatctttttggactgaaaatttcaaacattttgaagccgtacgtcgtcttgctcagagcatgctgtccgcccgcgacggcaggcggcggaagaagttgctgggcaccgccggcaggcggctgcggaaccgcgggtggcggagcaggtagaggccggcgacgagcgccaccaccctgaacggcgtcacgtagagcacgacggcggcgacgaggcagaagacgacgaagaggcacgtcgccctcgggtcccgccaccccagcagcgactgcagcctctccccctgcgtcgccatgtcgccgaccaccgtctgtatcctcccggcgacgctcctcagccggtcgtacctcatgtacaccacgtcctgctgcctcgacgtcgggaacgtgtcgaactcctcgtccagctcgtcggggtgcaccgcctccgcccacgacatcttcgtgtccatgtgcggcgggtggcgcgcccgcccccggtagttccacagcccgatcatgaacatgtagaggaacaccgtggggaggatcagctccgggtaccacacgaggatgaggaggaggacgtgcaccagcgccgtcgtcgcaacgttcttccagtggcacacgtcggcgaaccaccgcgccgccgcggcggcccccgagaagagcgagacggcgcggaagaagttggccttgctccgccgcatgctccacatgtgggactccacgtcgagcatgtactccaccacctcgcgccgcagcggcggctccgcgcgccccagcctcgccgccacgatccccatcgcctggtaccggagcgcgtccagctgcgtcaccgtgaacgggtggaggtagtgcatccgcggcagcagtggctgcgtgtacaggtgcaccatgttcatcagcgacagacaggtgaaccgcacggcgaggcggagctcgcccatcttcttcacccccgacggctgcagcacgatcagcgggtacgcgtgcgtgtacacgcggtcggtctccagcgtcgagaggcggatgcggatcttgccgacgcgggcgtccctcgccggcgggcttcatcctccgccgccgcgggcgttgttgccgttgccgttgccgttgccgaggtggttgttgtcgaagacgccgatggtgatgacggtgcacgggtcgaacacctcccaggtgtactgctcgttccaggtcgggctgaaggtgccgagcatggtgcgcgtgcggacccacttctggccgtacttggcgacgcagtaggcgtcggtggtgccacggccgtcgcgattcttcatcggctggaggccggcggcgccgaggatgccgacctcgagcacgccgacgggcggcttccagagctgcctcgccgtggggcgggtgtcgctaatgtacatggtggactcgtccatgacgtggtaggcgccctccaggcacgccctgacgtgcacgcggctcgcgaaccggagctcccgccgcgtctccccctcgatggcgccgccgatcccgaacttctcgaggtcgaaccaccgcgactggacgaacggccggtggtccagccgcttctcgaacagcgcgagcggcagcgcggcgcggccgaggaggtcgtccttgcgcggcgtcacccggtcctccaccgtcagcaacagctgctcctcgaacggctcggcgacgacgaacaccaggtcctcgttccaccgcgggttcagcgtcggcgccgccaccaccgacgtcttaaggatctggttcccgacctgcgccttgacgaacacctccggcgcgcgcccgcgcgcctgcggatgcacgtcatgcgcctcgatcacgttgacgcggaggtaccacagcttgggcgacacgtacgccttggaccgcacgctcgccacgccctcgcagcgtacggtggcggcgtcgaagtgccacgcctccgggaacgcctcgtcggcctgggtaccaatccacacggcgagcatcagctcccccctcaccttcaacccgccgccgtcgccgccgccgcaacgcgccgctcctcgaggcggtaccactgcggcgcgagggggctgtcggggggcaccctggtgggcacctcggcgaggtcgaacaccacgcggccgacatagtcgtcgcggccgagcatctccttgtccttgaggtacacctcgaggacgttggactgcaccctcgacttggagaaggcgaacacctggtcccactccgggttggctcgccggtcgtagtgcttcgtcgtgcccttgtagttcccgagcttgacctcgacgtacggatccatgggggacccggtgatggggttgggcgggaggtccttcgccttgacgacgcgcacgtacaggaagaacatctgctcgacgaggtcgtaggtgctcgacggcttctccaaccccagccaaccggcgatgccgccgccgacggccggccgcgccggccccgccgcgcccttcggccattgctcccccagcagcgggttcgtgtccttcagctggaagtcctcgtggtgcgcgtcatggtggtgccctccggtcatcgtcatcgtcgccgtcgttgccggccgtcgtcttcaaccttgtacctgcaaccaaaccacaccatcgaattaaaacaccggaaaactccatgaaaattcgcagataactcggcatcaataatctcacctaaatgttccaagatcgagatttcactagacggtaacaatggcgcgagacatttatacctagaactctacaaggagaaagtgatgagcaggcatatgcgtggtcactgcacggccatggaggggcatccgggaggtggcctcgccggcaagcaaagcggcgacgccggtgtcggcgtcgacgtcgcctcgccgcggtgaacccggcgacaaggaaggtatacgtagctaattaagctagggctttttgctgtgcatccatgtacatggaggacggacaatgtcagtgtgtgacagtagtgtagacttggtgggagagcaagcagctatagctaagccaataaacactttctagggttctgaactttaagctgagcaagaagaggcagaagccatgtatggcaaggagaaaattacagagaagggatcgattcaaattcagagaaaaaaagggacagatggtgatcgatcatgtgttgatcaaaggggattaaaagatgtttgtgggtggtaaataaagagagctagctcatcgattgattgattgatca

SEQ ID NO: 38206 - DNA, 2556 bp, Oryza sativa
taaacttttggattaaaatggcatgctttttaaactgctaaatggtacatttcgtacgaaaactttttatatgaaagttgttctaaaatatcagattaatccattttttaagtttgtaataattaaaacttaattaatcacacgttattaccacatcgtttttgcgtgaaacacttaatcttgatcttgatcttcatcttatctttagtcataagaaagtacctccgaatataaatccaaaaatatattttgttatggcagaacctaattaaatattattggattaatcgtttataaaaactcaaaatcaaatagtcgaaatatgtcttatatttttcaatgaaggggggggggggggtataatgttaatctttgttgtaatgttacatttttagaagtaaaagcatgcactaggtcatcctgtaagagttagaaattcagaatccatttccactagctagcagcaacagaacgatacacagattgcacatagatgttcttagccgccaattcacgagatagtggctgaaaaattctggaagctagagagaaccagaatgccaatacagtagacatgagacacatgacatgcgttgcagaataagcttaagaaagaagcagacggaagttgcctttattccgagcagaggaggcatgcatgcatccactggctaagctgcaaatgtgtcaaaaaggcagcagcgaatatattctctcgcctcaccaccaccggcaatatcagtgtgtatcttgcatcgttctcaggctcagcatgaaactaatatgtttacgtgtttctagtctacagattgatagccactggtttctgtgttttatgatgaggaagtcttcttaggtccagttttttggctgtgtacattctatacagagaccgggggtgaactcagttagaatgtatcattttggtgtatgtaactgagtcttaataaagcttctattatctaaaatgaaactaatatggattccgaggtctaatcaagcccatcggtcatagctaatcggtgtatgcagatgatttcatggttgcatcattgttctgtagtcttaagcatacagtaagtagcttggtttggtcagaggcaagatcctctacatcaggaacacactgcatctagccgttctggattctttttcttcttaatttctttcttgagagcatgtggcctggaagaaagttggtatagctttcagcccaaattaattaacatctgcaactccagcccattgaaattataatttacaggccaagcccaggatgctgttaatttgggcttttactcgaggcggcatcagtggcctaaagctaatgatacttgcaatttcctcgatacatttgcaaaccatctccttttagattaagaaaggggcttgttccactgaggttaatttttgccgtactaaatttttgacaacttcaataatgccacatggatgtttggtggattttctatgaatcttttacccatacgtacaaattctacgctaccaaatttggtaaggtcaagagttgctagtgtaaagattagttccaatccaaataagtcctaagatcaatgatgtttgtaactttttaaacctttttaaacattagtaaaaattatttcaagatatgatctttttgaaatttattattttcaagatctatcaccacgatctgacaagtgtgacaatattatttagtcacgccatcctcactagggtggcaagataaaactgtcacgcccactacgagtgacatgtcagtattgttttgtcatgccaagcacattagctcgattaaaaaaagtttagattctggaagtaagttttgaaaaggttcattttaaaattaaacattcaaaaagtaaaaaaaagaatcaagatcaacacgtcgagtctatttttaaaactattttcccgatcgaatacacatacaaccttattttgatcgttaagatggtgcatatgctctctctagctatatatctactcctcgtctccctcttacatgtcgctatatagccttagctactctttgcatgtgtgcgtgtgtggctaataacctaagctaagccgattcaattgatttctagccggcggccgggtgcggccgggtggtggtccagaacaaggcgagcgcgcggaggcggccgaagtagtcgtcgacggcgacgaagcagcgcgccgcctgcctcaccgtcagcatccgccgcagcgcgtgcagcgtccgcatcctctcctcatccgcctacacatacacgcacaacgtcgtcaccgatgcgaaaacttgcaacccaaatcgaggtggatttgaaactctcgaatggatgttatcttattgtttgcatgtcacttaaataactataaaagattttaattttttttaagaagatatgtagtatgctatcactctacgaacatacaacttaaaattgtatgtttgtggagtaatatatcacatattaatttatcttcttaattttcttgtaaacaaattatctttttaatttttttcataactacgtgagaccatgcaaaaaaaacgagaggacatcc

SEQ ID NO: 38207 - DNA, 351 bp, Oryza sativa
atttatgcacgattaatgaatgccacctgggtggaagcgagaagtggaaatggaaggtcttagttcggagtgggatctctacctgatagttgcattggcattcatgatgatcccctggcattcgtccattcagccattcaccattcacccattcaactggaattttggttgaatgccggaattgtgtccacaaattgtggatggataggtggttggctggctggatggctggctggatggctggctggatggatggtgaatggctggcggcggttcggttgctttgaagcatttgttgctatctaaattccatttaaggtcgtaccttatcgcccagcatcatcttattct

SEQ ID NO: 38208 - DNA, 954 bp, Oryza sativa
attgaaaagtacaaggctcggcttgttgctaagggctatactcagaaagaaggcgaagatttctttgacacttactcacctgttgccagattgaccacaattcgtgtgctactttccctagcagcctcacatggtcttctcgttcatcaaatggacgttaagacagcttttcttaatagagagctggatgaggagatctatatggatcaacctgatgggtttgtagttgaaggtcaagaagacaaggtgtgcaaattgttgaagtatttgtatggtctgaaacaagctcctaagcaatggcatgagaaatttgatagaacattgacatctgcaggcttcgcagtcaatgaggcagataaatgtgtgtactatcgccatggtgggggtgagggagttattttgtgcttgtatgttgacgacatactgatatttgggacaaaccttgaggtgataaatgtggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactatggaattgggacttcactatactgggtatcctgcggtactggagggttatagtgattctaactggatctctgatgtggatgagatcaaagccactagtggatatgttttc

SEQ ID NO: 38209 - DNA, 1395 bp, Oryza sativa
  unsure (1)..(1395): unsure at all n locations
cagacaacccaccaccaagggccaaaccccatcccctcaccctctcgagttaggtacaccggatcaaggtgtctcccttatcatccacaagggccaagggaaccaaaccaaatgccatattatccaccacgcccacttctcctccgtcgtgcaatgcaactcgcccatatggacatgtcgccatgccttgccagagcgaaggataaactccgcaccaccacgtttaagatcgcattgtattggatcgagctgtgaatttgcaagaaatgagccaagcagactgaccatgctgctgctgctgcacaccaacgcttggcattactctttgttggactcctagtgtgcctttggaccgaacagaaacagctatgcgatgacaaatttcactaagccatcaaaagcagtaaaaagaccaccgaaagcaggaaaaaaaaggagtgtactttgcacaaaactccttggcaattgtatccttccaaaggcaaaagctggaagaagtttatctcttagaaaaactcagcaaaataaatttgtagaagaaattcgaagccaagaagatattgctgaccttactgcatccggggaccagctccttgagaagctccatcctcgcattgatcttctcgcgtctcgcctgtttatcacccaaaaaaaatgataataataatgtcataaaaaatccaagaggaaacgaataattaagtaattaacgaggaaagcaacccctgaaaaggcactaaaacagcgacgtcgccacgtcctaattacccaatcattgcctaatccacagctcgttaaattaaattaaaccccacaaatctaatcccgcgaggagattggcttaaggtttagcgagtgattaattaagtgggtgattagcggcgagcctgccggcgacggcgaactcacgaactcacccgctcggcgaggctgtggctgtcggtggcttgccctcttctcgccctcacgtgcacgtacgccggcttctcgtcctcgccgccgtcgccaccgtcctcgccgctcgccgccgtcttccccttcttcgcagccgccttcccctgcagcggaatccaaaggagagacgaaatgagaaacgaagccgaggggaaagcagcggagtgcgcgcgcgcgcgcgacgcgacgagacgagataccttggaggcggggtcgggcttgcgcttggaggaggaggaagggggagggggaaaagagcnnnnnnngaggcncnaangggaagcaaacgcngagaacccggcttgcgcgncgacgaggtgcggnntcggcgggaacgccggccgnggccgcngcccngangcngcggcggtggggagaaggagctccatcgcctgggaggtcgggagccccagcagcgcggtgaaggagcccccgctgcct

SEQ ID NO: 38210 - DNA, 3555 bp, Oryza sativa
  unsure (1)..(3555): unsure at all n locations
gcttcgtcttcgtgcatgtcgaagagcatgtcaaggaggtccttctcgtcgtcctcgccgtcggtcgccgcttgccggcgtagcttcctcttggcttccctcgccgtcagtatccgctccatcatggcgtcgaacttgcggtgcaccgcatcgatgcgcttgccgagcccctgcacgtcccagtacttgaagacgccgatgtagtcctgcaggttgaacgtgccggtgagctccgccgtctcggcgaccacgctccgcatctcctccgcgtcgttgtcgtcgccggtccaccgccggcccatcaccatgcgggagacgatgtcgccggtgaggcccatgagcgcggcgtcgacgtcgacgcgctcgccgccgtcggcgctcgcgcggagcgagccgacgaggcgcgccacctcctcgcggcggacgtggcggagccggtcgagcgttcgtccggcgaggagctcgtgcacgcacgcgcgcttcatgaagcgccagtagggcccgtacgccgagaaggagaagtcctggccgccgtaggtgaggcggtggacggcggcgggcttggggcggtcgaggaacgcggcctcgtgggtcttgagcacctcgcgggcggcgtccggcgagcaggcggcgacgcaggggacggagccgaggcggaggaagaggagcgggccgtggcgcgcggcgaggcggtggagcgcctggtgcggcagcggcgcgagcaggtggaggtggcccaggatgggcagcccgaacgggctcggcgggaggcgcaggccgctgctccgcggtggcggcggcggcggcggagcgcgtaaagaacaatcaggcccgcgacgaagaggaggagaggcttgaagagacctcgagctaccagctgatgatccatggcgacgaagagcttggttaatttgactactcactgtgtcactcagcttagctagctatgcctatgctacctctgttggttctcacttggttatatgcttaagcagttaagcttaatgcttgtgggttatgcacatgctgatgttaaatggatgtcatctgtgtagggatgaaaatggagcggatacggacggatattgatcataccatattcgttttcatattttttgccgaatacggaaacgaatatgaatagctcgaacacggactatctcgaatacgaataagaatcgaatatgatcggacacgaatacggaaacaattttttctcggaacacgaaaactaattcaacttctaatagaaacaaatatcaagatatataattagctcattttatataaaatgtagtataatttataaatatttttgaaattttcaataatattaataatatggactagtgttaagagatgaactactattaaaatctaaaaaggtatattgaaggtcatagagttataaagaaatgtggtgtgtcttgtggcttatgcggatatccgaatagcactgttcaccggatatccgaattattatccgtatccgacgaaaaccctgataccatattcgtatctgtatccgagaaaaaatatcagtattcgtatccgaactatctgagaattatccgatccgaaaggtatccgtattcgtttttatccggagcggacggaaactatccgtccgttttcatccctacattggtaagcaatttgtctaaactacttattccttgcttgtttttttttcatttcaataaatagcaaacatttgaggacttaacattgcccactagtatgtacaaaaccatatatatatataagtattttgattttgtcacataaaaatggcagtgatagatccatcgtaacaaaaaaaatccgatattgtagtgactatacaaaatgaaaatgtgttctaaggctgtgttcgcatgtcatggatgggaacttttttcctccgcacggaaaacagagtggtctattagtgcgtgattaattaagtattagctatttttttctaaaaatagattaatttaagttttttaagcaactttcatatataaacacaggggttgggaacaaggggttgcanacacagcctaagaccatatatataaatntggtggtgacctgaaaaattgttttaaactcttgaggaaatatcccctcgtttgtctaaaaacaatccgaatagttatgaaaattctaaaaaaaatttaacgacaatcatgcagcaatatatatacaactatacaaatttttatgtccaaactcaactcacatattgagatattaaaagggacaaattcaacagacgaatagtaatggtattatttatacctaatttttctctctctcaatgtgtaggtcaaatttaaacttgatttttggtggaatattatgtgtatgaacaagagataatttgacaataaaccattacataatcgatatgctgtcttgctaaaaataagattcccttttatatatcaagcgttggatatagaattctagtgaaaatttcacctctttaacgtttcacgccataaacctgatgctaaaactgaacacatgaatattgatcacgagagcgccaaaacaatatttttttcttttgtaatttcatatagccaagggatcaaaatggattgaattttcctgggtttctaaatctcgctggtggttggaattcgtttttgaatttcttgaaaacaattcgaaaacatccctaaaactctaatttcaagctgccctgaaaaaaagatattccctccattttatattataattaagttgtttgactattttcttagtcaaacttctttaaattttaacaagtttgtagaaaattatagtgatattttccatacaaaataaatatattatcaaaatatattcaattttaaatttaatgaaactaatttagtattatagttgttgttttctttataaacttatcaaacctaaagagttttgaaaaaaaaaagatcgaaagaattataatataaaatggagggagtatatcataaagagctctgctataaatacgataaatatcttactattagtgtcggtgcccttctaatctctaatacatgcaacaaatatagggtccacaatgtttccatggccaatcaattatcatgcatgacactagatcgtaccaaaatcgtaacaagtttatcttacgtacatcaatttcctatcataaaaccgaccggcgtcggaaccataaacccttggcctttaacgacaaacgcctccaaacaataaccggtacagtaacttattagtccattcccatgatgttcattttttctttcgttgaatcaatcggcaggagaactaccaggacactttactttttttttattattattgttattatcgggatctgccctgtgatctgcgagaatcaatccagaaatcaagacaaatagacaatggaagctcagtacgatcccctccactgtgtttgatcaggttaatagtatggaccgggcaacattggataatggcgacatcttcttctgttcagagtatctagccatgcccggccggcatggccggcaggtgtgaaatagtcgttgattgagctagctacatatggaa

SEQ ID NO: 38211 - DNA, 5596 bp, Oryza sativa
  unsure (1)..(5596): unsure at all n locations
caaatgtcaatgcaaatgtttcatcatcattactttaattcttcaataatatttaattaaaaattattaaaatactatatgtgaaaggaattttaattacaaatccacatagagagtattatttttttaagtactttctaactatcggttgagtaatttatttttcatattcaaacaaattttacatcatttttaattgcttagaccctgtttgtttctcatactaggagaggataaaattttggattatcgtggcacgcttttcaaactgttaaacgatgcgtttcgtgcaaaaactttctatatgaaagttgttctaaaatatcagattaatccatttttgaagttcgtaataattaaaaatttatttaatcacatattattaccacctcgttttgcgtgaaatacttaatctttatttatctttagaagattcaaacaccacctatctatgcgtagacgccttttacacacatttgggtagaaaatgcggctataggcattagtcttctattggttagactaatattgattacgaaaaagtaataattataggtaaaactttatgcatgtgtagtcttagccgatctaaaagtactctgaataaaaatattaaaactaaatttaaaactaagtatcaaaatttaaattctgactacggtttaagtagaagatgatagcaagtacgaagccaatactatttgaagactgcataccggggtgaggacttgcgtcgcgagtcgagacaagccactcaatcgcacaacagcgagcgtaccaaacaagttgggtcaagaaacatgacgtggagcgagttgagacttcttctccaggactactaatttgcgcatacacactagcagatgaattcacgcacgtgctcccaactacgttataacaagtgtcgggttagggttaggttttcgggactggggtggaggagggtggctatggaaaggggaagtgggggatcaagcttagagggatggcctaggaggcaacaatttgacgatgtgtggcggacaagggcggttggtgaggtggcggtgacgccattagagccgcgaggtcagcagcgggttgtgggctgatgatatcgatgagggcaaagtaaggcgaataggagggaaaggaggccgctctggaacattgacaccttttggcgctggtgaggctggagatgatggtggagatagagctaacttggttgctggaggaagaaagaggaggcttgccaaatagaggctttcgtcgctggaagaaggttgctcaattccgtccctcttctccatcggaggaagcttgctgtaaagagaagggggtttgtcagagggcctccaccatcgctagagggaggcgacagcgtcatcgcttcctcattcgcttgcacacgtgcacgggtgaagacggagagaaagaaatggataagatatatatagagagaggagatacgatggagtggttggtggccatgggccgtgggagcgtgcgtgacatgcgtggccctcttcttctcttccctttactgtgaataaacaggtcaataggttgagaaggggaaaaatggttaattagatccatgccactttaagtatgctgattcagaaaaataccaccattattcgtgatatctgttgcgtgccactggaattttgtaagattgaaacatgccattgccgtcacgttttctttcattgcctcgttagatccgtcaacctacttggcttctccgtctccgacatcgacaccaatcaccaccagtagcagcaacaaccgtctctggcaccgccgccaactaccaccaggagtagcagcaacaacaacaccaacgcgcgcaatccgcctaagtgagaagctgtcggtgacctcccgacggagaggatgagatgttcatgcgttgcagcctgagtgaggaaatagagaggggagatctattttctcaccattgcctcttcctcccccatccaccgaacctcgccgccacgccacccctctatgtcgactgtgcgccgttgctgccttaaccaccccgccgatggctctggtacaccggacagaccaccacaccatgcatgtaggcaacatgttgtctccctcatctgtcagcttccatgtgtgatgccattggtgagctcgcgtgagggctcccgtcctgacgatgcagcttccacaacctctaattccatcgtcgatgaggtcaccgctaccttgccctttagccacttgcattgcgcacccatgggccgcctgccaccgcatcctctatccaccgggggagatgtagagcgagatgttgaaaagagaagaggcgagggtggaggaggaagatggagctaacatgtaagtctcatatgtaggggtattttaatttatattataacagaaaatgtgatggcgatggcatggtcaatggtacgcaatagatatcacaaatagtagttgtatttttctgaatcagcacatttgcagtggcatggatttaatttttaaaaatacgtcctggctgggctgggttgggctggtctggtccccgcggatccggccgcaatccagcctcaacccggcccaaccaaacaagggcctaatcaatttccccggcgcggcaactactactatatagcccaagtctgttggtttcccatccgcgcgaaaattgcaagcgcaccgcctcccccttctcctcttccctagtctactttagggtttcctccctcaccgtcgccggcggcgacggccaccagacgcgcgcatccggcgcggccggcgtcaccgcctcccagccccctcgtgttgctcgcgtctccggcgaccgtcgctttgccttgtactccggcgcctgcgtcggctactaacttgggtgactaggcagcaataaggtgacctataatgcgcgcttctttttccaaattgtgttcttagttgagcaaaaattacaaattgtgttcttgcttgccctgtctgtgatctgtgtaaggcaagctagcagtagcatttgccggtggcgtgtctacgttatgcttactacgttaccgggtcccaaggcccccgagtaaattattcaatactagctaaattataccatgttaacttatactatattagtcaataattagataattagtatgtatcttatctttcataatttttgttctaggctcgtcatgtactagctacttgacctattagtttttgtcattgggcgggaaagatatatagttgaaccccgagcaattggggcttcttctgtgaattgattcatctctcacacatggttctccactattccctgtctattggttcttcatggttatagagctggttggatattactggtgttacttgcttttctttttttaaaaaaattatctactgcaaatttgtaaattaccatgacaagccgacgttatttatcttagataaataattgatttgaactttgctttcatcgttgctcagttaacctttggtagcttcttctattgtgaatcaggtatcatgcagctccagttaaaatggcattatattagtctatagattcatttgcagtaaggatttttttcctcttttgcttgcgaagatcatttatatgacaccttaattatgttcaaagcttactgggtattactagctggtctggccctactcagttttacgtgtacctagctatatacgtaatgtgccagaaaatcagtttgtgatttgactagctagttgcttctgccaaaagaaaaaaaaccaaaaccaaattaaagatcgaactttcatggtaatgtttactcagtatttgggtcttgtcctttctgatccaaggttggaaagatgtctaaacgaaggggcaattgctcgagctcaaatgaagagaagaaaacttgcacaaatagtagaaagaaaggtgagtccgttcttgaatgttgattcacttccgccatttcttacatgtatttacacagctctaaatgtgttgcttttgaagaggaatctggtagcttaattgattatagtgaaggtgcctagagtggactcagtcaagaagtcatttcaaacttatctgaaactgttgtctcagtggcttcattcaatggtgagtgcctatacaaattagttttccatatatgtatctgatcatcagttctaaacattgaagatattatcttgtgcaggagatcagacgcatttttcaggcacaggcatagttgtcagaaccaaagatgaagtaactacaagtattctaacttcagcaaatgtgattagatgttttgatgatgacagcaagatcaatccgtttttggatgttggtacccctaattttctctgcactctgtaacttacctgtttaagatatgataataatctgcaggtgtgcnttgcataatcactgcaagattcgagtttctgcttcanaaatnaacaaacgtgtcatcgggtgnaatggnacactttgactttaacttacaatatgctgtttgtggtgatcaaatatttacttggtntgcgagctgcgtcttttgatcacgaagtgcgatttgggtccaaagtaaggtagtagctgtagggcgttccttcacntcaggcaaattgatggcgttatctgggatagtgactgatgggccaacagattatcctgaacaccttatgatctccacatgtanaatcactaaggtgcactgctgatatctcttctttcttctcggtattgtggaaattaataattgtctcatgatatgagtagcagaatttatcactagttcactacatacactgtactatatcgtttggggccttaaacatttcattctcttcatgtagttttttcattcaatatggttttatttttgtgcttatcttagctcagtgtgacagtatattttcttccaggatatggctggaggaccactcattgatttggatgggaactttgttggcatgaactttttttcggaggagaggactccattcctaccaaggaacaaaatttaccgaagcttggtgcgatcttgcacactttggtatgcctcgtactttcattcagatcctccaaacagtcaaacacttgccaagccagattgagctagaaatagtttagggggttaagtgctcccgcaaaatagtagttcgagggattaaagtggacctttttcatttttatttgacagcctatcacataatagcgatttggttttgcacatagtactatgttattataactctgctagataaagcaatatattactatgttttgcacgccctatagctgatttccataatatgcttcttatggatggaagtgttaatcttgatagtatttttgattagctatatgcaatccattctttttggggatcagcagctctgtgtatttgcactataagagtatactacattctgctgcagggttgaaatcgacgatgaatgcacaagcataattgaaagatgcagatctaagatgatacacaacaattttgttggtgagttcatcagttgaagcacaatcactctttgaaactgctaaattgtttattgtcagaaatctatcttcattaatgtatattattaatccttggttgtagtttcctctcctgtgggtaaagcttaactt

SEQ ID NO: 38212 - DNA, 2883 bp, Oryza sativa
  unsure (1)..(2883): unsure at all n locations
taaatctactcgatgcatcgtatatacactcctatcatgcacatgcgtctgccagcaacgaactcgatcaattggcgtctatgtagctatcatactgtagcacgagcattaattatatactccgttcaatagattgcttattaatattatgcctgccaacccatctcgcacgcggtacataatacattactcccccatcttattctgagcgcagccatgagttttcgtattcaaatttaatcatccgtcttattttgaaagatttgtaaaaaaaatttaaaaaacataagttctgcataaaagtactattcatgttttatcatctaataacaacaaaaatactaataaaaaaattcaaataagacggatgatcaaagttaggcacggaaactcatggttgcgcttaaaatgagacggagtgagtatatatttgtgatcgacgatgatacaaggtacaaataaacagtgcccgtctcattgcatcccggtagtaggttcatctccttttcatttttcgatcttaattatcttgacgtgatgggtgttgtatcaatgcaaactacatatgcttattgtttggccaaatatgcagggggtcattagcctttaaaaggcatctttcttcgttccaaaatatatttcttcctctcctcctagcagatttacgatgatgaggatgcactagagggtttgtggctgcctgatttaggtgcaacgagctcgaggcaaggttgatagtcagcagccaccagcagctctttctgtccacttggaaggcgcagatgcagagggcgcaagctgcatgcatggccatacccacattgtgttttttgaaagagcttaagactctaaaaaggagctaattggtagccaactttcaataatctagaaaagctgggttttcctagtttcttaattatagttaattttctagatgctatagttacatattctcataatctggataaaaatatgcactatttgaggaagttggagattctgggagaagctatacatctgctagaagctcgtcttagcgtcctaggagagctagatcatctccaaggttctgcttgatgcttcaatagttctgcctagtgaagttgttgattgatgcaaatttgtttgtggttgtgtgatccgcttgatgtgcaaatcttttgatacgtgtgtatggagttcaacatgtgtatgatgttgttgaacttgtatatgcaatttgtttgatgttgaagttgtgatctgtttttgttgttgctgatttggatgcaaggcttgtgattcattgttgcattaggaataactatcgtacaggagtataacaattttctttaggggttgaaattaacatcaatgtcggtaaaaaaaaaaaaccgacagtgatggctaaggctattactgttgccttcatactactagctagttcaaaaaccatcagcaatgtcatgtttgaaccgacaataataggatttttttaagttgtgatcaatcattaattaatactagatattaagattgatttgtgaaaataatggcattgatagttttgtgaaaaacacatttatatgttttttaataaatgtttaaatataactagaaaaggaaataaccagatatattcgttggagacctaatgtccaaaacgtaaaaaaaaaaatggcgactactgttaatgagctatggatagcctggagatgatgagataaatcagccagcctttttttctggctagtcatgtatagaggccaacatgtcatgatgatggtccatggaacaacaatgcaaacagtcaatagaatcctttancacattcatcatgtacatactgaatagtgagaatacttccatatactctctccgttataaaatataagacgcaaaaatcggataggatatattctagctaatactacgaatcgatcgaatctaaatagagaattgtccatattttaatattaaaacatgtttcatccgattctaaattcttatattttgagacgaaggtagacgaaagtatagtactactagtagtatatatattatttactgacagttatttttatattgccggtgggtgtatacgtaatatttgtggatgatgaaaatcctatgtctagattgtgtcaggagtgtgtattctatgtttttctttttctactttataaatatgataacataaattaattactggtaaaagtctgtataaatgctactggtgatgtgtctctcaacgtacctctatcatagaaaaaaaaatccaatttctaaggggtgatgtgtctctcaacgtaactctatgatagaaaaaaaatctaatttttaagcacaaatctagacaaatatttatctacattcatccgtaattttttaaaggaagggggtaaatggtcatcgatagggtgcaaaaggaacaaaattattaattactcctgcctcaacatatgcacgtactaggcagtacgctagcgtagtgagaagggtgagcaataacttactccctccgcttaaagaaaaacaatcataacaatatctagaattgtagttagagattgaggtattataggacggaggatgtaaggtcgctagctttatattaatggattactttgaagatagtactagctagggtagctatagcttttgcatatcctctacgatcgctggcacgtcaatgtcgggtccatttgcaaatgatactggagaagagagatctgcatgaaacttaaaatttcctaagctagcaaccagtgtgtaaactaaattatgcacgatagcttaaattagtacatgcatgttttgttagacaaatacttcttttgtctcaaaaaaccaacttctggttataaatctagatatagcatatgtttaaattcaaagcattta

SEQ ID NO: 38213 - DNA, 1472 bp, Oryza sativa
ggcattgccaattttttgttctggttggtttggtcaataaaccaaacatgccatcagaaaatcacaatcaaacatacaattaactgccactggagatagtctacacttacatttgcagaaataaagactggtgatatttacatttctggttcacagtaacagttgcagttttccaattgatggtgttagttgaatttattcttcctccagactcctttctccatataatcaggttgatgctcaagatttaaaatccatcttttttatgaattcaaaatcagctcaggttagagtctgcaagcaaagtatgtgaagttataaatgcatccttatttaggtaagctacttacaacttactaactaatatgggagtcttaaaatagattgaagaaaaaaatattttagtagccaaaggctcaaaggtacagagcatcaactgttaagaatatcatattgtcattccttgcacgaaatctttgatgcttacctctagtgggatgaccgtgattaagaatatcatactttccaaggtcccccttttctacaaaaaagataaaccccctgttcaatggttcattgattatcccatcactcacaatatcatcataacatatcttcaccaataatctccacaggtgcagtttccgtgtgtaagtagatgaaatcgatttttgtccctaagggatatctccctttcataaacttttgaaacaaatttggcaaaattatggcaatcaacacatatgcgaagattcttcataacccggatagtcaatcctggaggagtgttcatcaatccaaaagttattgccagcttctcactgtgaccaagaagcatgcgttctttttgctcatcatcaacatcatgcagcacacaactcaagtctggaacaaagcccgctgctttgatatcgacaaatatctcttttatcttggcatttatgtctttcttactgggatggaaccgctcacttgaatggaaggggtgaataaccctgtcaagaattatccagctctgccctggttccttggtcactgtcttctccaacattagcttcctcactttgaaaacatctttccacatcccagcagcagcataaatgttagaaagtattacataattgccagcattttctggctccatttccagaagcttctgagcaacaagctcaccaacatgaacgttagcatggactctgcaagcaccgagcagtgaaccccaaattgatggagttgactcaaatggcatattttctatcaaatttaaagctttctctagtcgtccagaacgtccaagaagatcaataatgcatccatagtgtccagtgtggagaagtgcactttgctctttgaccacagtatcaaatatatcaaggccctcatcaaccagcccaccatggctacaaccagataaaacagccaacaaagtcacactgtcaggcttcacctctttatgcaaatctttgaagaga

SEQ ID NO: 38214 - DNA, 8772 bp, Oryza sativa
  unsure (1)..(8772): unsure at all n locations
caaggcttcctcatcaagacccttttgagcatagcaagatataattgcagtacacgaaacgacgtccctttttttaagcgtgtcaaatactcttcgagcttcttggatgttttctgacttggcatacatgtcaagcagggaactcccaacaaacatgtgtgactcaaaatttgtcttgactaagagagaatggacttgcttgccctggtatatactttgaggaccagaacaggatgtaagaacagttgctaaagtgtattcattagggatgcatcctgccagatagaagtaaaatgtattacacatttgacagaaattaatacagcatatgttgatataatctgatccttgaagacaatggcatgcattcccaaatggttaagaatatttataacagtaattgcaaaacaaacctccaaactggagagattgaatatcaacttgagaggacattaagacggtcagggagatatgaaaagtaattgttgtggcaatattctaaatatggccatgacataactccatccatattctttacagtaccaaaaattttataaactttactttataataatcatgccccgcatgaaaggtaaaccccgcattatggatgccaaataatgtatctaacaaaggtagattatagagtaccagacaacatgctatgaaaactctgtttttgtttttctgtcaatctaaatcattcagccaaaatgcattgcagaaaataaattgccatctctaatctgatgctactttctgatctgtgtgatctccttatgtcaaatgactcacgagaaacgatccaaacaatttaccagctctaagcatcttgatgaacagatccaaggcctcgacatgtcgttctgtttgagaatagcctgaaatcatcgtcgtccacgagaccacactccgctccggcattctatcgagcacgttgcgcgcgtcgtccagcgcgccgcaccgcacgtacatggtaaccagccgggtccccaggaacaccgcaggccggtacctcgccgtgatcatgcgcgcgtgcacctgccgccccctcccagagcgccctcctctcgatgcacgccgtgatggcggcttcgtactcgtggaacctcgcgctggcccccggaagcgccatccccgatgcggcgcggagcggcgcgacgaagcagcgctggagcgcgaggccgcgcgccgccgcctccggtctcaggagcccgcgcgcggcaagcatgagaggcgttgggctcacgcgagcatttctccgaacacctcgcgcgcgccgccgtcaagacgccgagcgctcgacgaggtggtggtgcgcgtgttggttgctcttctcctacgctaacgggcaatcctggccgtccgatcgacgaatctagcggcctagatgacgcttcgatccaaagactgtctcgtaagaaatcccaaaactaaggggcgtattagaagatatcaaaatattcactcaagggcccgggaactagctgggccaaattcaattaagggctgaatttacaaacggtacaaatgtagccccaatttgttcgtgggctcaatttgtagacgagaattaagtaggccaaattaaattatgggctgaattcctcggcaggaaatggatgggccagatttagaattgtaccgaatttgttggtctcaaattaaattatgggctgaattcctcgacaggaaatggatgggccagatttaaaattgtaccaaattcgttggtctcaaattaaattaggaataagttcactttaggtccctctatttgttggtccctgaaccgcaaaaccgggtatgacccgtcccccaacttacgaaaaccggacaaacgaggtcccttagcggttttgagggtggttttggctgacgtggcgcctacgtggccattttgactcgatattcatctgatgtggcactgacgtggcgcttacgtggcaatccgatccagaaaaataataaaacccgtggcccccacatgtcagtcacacagaaaataataataataaggtgggacccacgtgggccccatatgtcagtccaactcatccctctcttcttcctgctccctccccatctccactctcttcatctctctctctctccaggcaacgacggccgctcctctccctcccacctgcgggtcgccgcacgccgctccctcccactggtccccgtgcgccgccgctcctctcccgccctcccaccggctgccaacgctcgcgcaccactgctcctctccctccctcccgtcagccggcgtgcgctgcctcatctcccgccggccgccccgacgagctcgcctcctccctcgcgacgacggacagcgcatggccggcggcgggcgatggtgggcgacggcgcgtgaggcgcctggggtggcggcggccatatctctcttgcgcacgctcgccgagccgtccgtcgcccttctcctcgatggccaccagtgggagaagagggatcgaagccgtgcgcctctccccgtccctcggtcgccgcagccctcctcccgtcgtcctccccctccgccgcgccctctcgctcccgctcccccgcgccgccgcctctacttcctcgccgccgcggccgggacagccgcgccgacaccctcccctcatcggagctccgcaagcgccatggcggctccgctgcttctggtggtggtggtggtggtgaggacgagaagctccacttgctccaccgcctcctcgcgcggcccgacgtcgccatcgaccccacgtgcctcgcgcgccgccgcgcgtgccgtcgcccgccgccggccatgcactgtccgtcgctgctccgcccaccccgtggcctgccgccaccgccgctccgtcgcaaggacgagggagagccaagaggaagaagaggaagagccaagagtggagaaggagaggggaggggagccggcgagctcagcttgggggcggcgggagcggcgtcgtcagcgtcgctccgcccaccgcccgccgccgctccatttcgccccactaccgctccgcttcctctcgtcgcccaccgcccgccgtcgctccgttcaccactagccgccgcgccgcccatcgtcgctccgcttcctcccaccgaccgccgcgccgcttcgctccgtcgccactttgctcagtcgccgctccgcccgtcgccccctcggcgccgccgctcgcccttctctcctagcagtgtaggagggagagagaggaggatagagagaaggaggctgacatgtgggaccacatggccccacctctttttaattattttttgtgtagctgatatatgggtcccactatttttattagtttttcgagataaaattaccacgtaatcgccacgtcaatgccacgtgggacgaagacctagtcaaaggagccacgtaggcgccacatagacgccacgtcggacaaaaccgtcctccatactgtggagggactttgtttgcccggtttcgtaagttgggggacgggtcgtacccggttttgtggtcaagggacaaaaatcagactgaccgacaaatagagggacctaaagtgaacttatcccgttaaattatgggctgaattcctcgacaggaaatggatgggccagatttagaattgtaccgaattcgttgttctcaaacaagaaggcctaattcgtgggtgaaacaaattacatgacgtgaatctagcggactaaatttgctagtgggctgaatatgtgaacgagaactgagtaggccaaattctgtggtcggcctaattcattcaaggaagtgagtgggccacaatttaattatgggtcgttttgttgcaaggaagtaaatgggccaaattcaaacgtggcccgaactcgtaatttgttatgtgggccaaattcgttggatagtgttaactgggccaaattcatcgcaggctgacttgacgggacatagatgggctgaattcatttaggccttggtgggctgaatttgttgataaaaaaactggtaggcctaattcgttgacaggaactaggtgggctgaattcgttcacgggttgaatttgttcaattaagggctgaattcacaaacagttcaaatgtggaccaaatttattcgtgggctgaatttgttgacgagaattaagtaggccaaattacataatgggctgaattccttgacaggaaatgggtgggccagatttagatttggaccgaactcaatggttacaaacaagaaggcctaattcgtgtctgaaacaaattacacgatgtgactctagcgtgctaaatttcctagtgggctgaatttgtgaacgaaaaatagtgggccaaattctgtggtcggcctaattcattcaaggctgtgagtgggccacaatttgattatgggtcgtttttgttgcaaggaagtaagtgggccaaattcagacgtgggccgaactcgcaagttgttgtgtgggccaaattcatcacaggctgaactcgttgacgggaatagggccgaattcatttatggccttggtgggctgaatttgttgataagaaattggtaggcctaattcattgacgggaactaagtgggctgaattcgtttacgggttgaatttgttcatgagaattaagtggttgaccgaattttctctaggtggggcaaatttgcttgcggacttaatttatactgggctaaactcagtgggacaattagtactgggccaaattcgtggatggatctaaagtgggcaatattgttttttgggccaaattcgttagtgggatttttataggccaaattcgttgattgttattaagtgggccaactttttacatgaatcaatccaggccgaatctgctcgttgccttgggtgggccgaattcgctaactgggtataggtgggccaagtttactcttgggcctaaaactacttggcccgaatgtaggtgggcctaattatttttgggaacttagtgggcctaattcacttgtggaccaaattcgcggacataaattaagcaggccgaattcgtttgttgatgtcgatgggccgaattcgttcatttatattctctaaaaataaaaaaataacaggggggctcgatgcaaaatcccctcaccggctgaaaaatttgagattgtttcgcgagggaaacatacgaaaagctttctcccccatttcaagcggcgcgacggcgcnnngcggccggcgagannggncnacgctagggtttttnctctctctccgccgccgaaatcgaatccccgaggtgagctccatctcatacccaccgagtctcaccgtcccganccatctccttcacccgccgccgccgcttgcgctgccccgccgatcaccgtgagctgctgcagcttccgcctccggtgagcacccgttgccgacggacatcgtcttccttcctcatccatctcgttctacccgctccattcctcgaattcgcattagccttcatcttctcttctggatctggaagcttttctgttcgtcttaaccctagtactaattacagttttttttacccaaaattttttttggtgccctggctgtagagatgaatgcgaatgtgttgggcggcgatgtggtggcggacgatttcaactacttctccggtgtgagcaccatctttgtggccaacatccaggaggtgaaggaccgggtttcccagatcgagctcctcttctgcagccagctcttccctcatgtccaggccatgtggaaggcggccaaggatgcgtggatggagagggaggccgccctattgagccaattggaggagctgagcagcgggaagcggcacgcggaggagaaggcgctgcagctggggtgctcccttgatgagatgaaggggaagcttgcggatgccgagcgatcggtcgcggggcatgaggttgagaagaagcggcttctggggagattggaggaggaaattgggaacaaagatgaggttattcgccggctagagagggagattgcggagaaggctgctgatttttccagggagagagatgcccatcagaggcttttgcagctggttgagttgaaggacaagaatttgcttctcgagcagaataaacggagggatgcggaggagatggcactgcagctggggaactctcttgaggatatgaaggggaactttgagcgattgatcgcgaggcatgaggttgagaaggagcgaattccggggaggttggaggaggaaatggggaaaaaggatgaggttattgggcggctagagagcgagattgcggagaaggctgctgatgtctctagggaaagagatgcccatcagaggatgctgcagcaggttgagttgaaggataaggatctgcttctcgagcagaataagcggaaggacctgatcgaggattacactaagctgaagacactctacaaggatttgaagtctcagtacaactttcttgttggaaagattggccagaatgaaggctccaagtctcctgtagtcaatgtggtggatcggaaaacctccggaagccctccaagcaagagaaagctcaaaggtactcctgccctttgatttcctttcattcagtagagctatttaaaccttgttaatcaatcaccatttttattctctaattactgttacctggaagtttcatttgaagaataccaagttttaattgcaattgtgtactataatccatggtgctctgatcaatgccgcggttgaaagtattattaagcacctttgtaatctgcaagtaatgtcctgccaatgctatcatattagcactaagatctatgcctcctaaatcgatactgattgatgtctgccttagcattttcttttacttgcttgattttcagatctggtggacactaaaaaggagaacaatcaggcagtatctaagactgtagatgagaaaaatggtcctgcttcaagtgcaaaggcacaaggtacccaccatgctagctcagtcaggagtccattcagtaactcgcgcctttgtctaccgtctcgtacaaccaatcctccaccaaagaatgctactagcaattcaaaaacagaggcagcatctagtttcaccgcccaagtctacactggagggagactcgcgcgcgtaaagaaccaggcgttgtagatccacatgatgatttccttgacacacctctggaggctgtcaaaaatatgatcaggaatcctaaaacgccagaagaagcacaagcccttgctgcctctcctcctaaagatatggacttcaataactctgatgatgagactcaagatgtcaatattgccacccagggccagaaaaacatgccagttcccaagcagcaaagtacaatttcaatccaaccaccaaataaaggtttcaaatacacagaacctgtaagaaaaaaagctgaccgggagaatctgaaaggcgttgagtgcaagcagtgcaagaaattctatgatgctgttcttccagatggccgcacaaatggtgacggtgtggactctacaagcatgaggtgtgagcatcatgatggcgtatccagacatcgctacaggtacgcgcgcgccgctgacacctgaagggttttggaacattgggtttgaatcagaaatgtagcacatgaagtatgatgcgctcttcattgattagtgcagtgtcgtgccctaacataggttctcagtcaccccccagatactgttaataatgtcagtagtaaatctcatgctggggaaatgatcatttctttttttaagattatatgtttggatagaatgccaatttgttgaagatagaatgtacttactgtcacatcgattctatgtaaatgacatctgacattgaaaagcagtcgaataatcttgaataacaagcgttataacgttacttgacatttttcttcgatatttactaattacaatcacatccatgatctcttctttttgctgttaccactttacttcagcatatgcaattgttggcagcagactggtgaggtctgtcgaatggtgagccatctcttcttcccatgaaaagcctttctcctttccattgtccatttgatcacgagattcaggtcaagatcgatcaggacgatttcacgtcagatctgctaagaaacaggatgcataacaacaaagcaggtaattcttttagaggaaacaaaataataatatatgccccaagaaagagtcccaactcccaaggaagagtcattcaacttagggtgcaggtggggtgggtcgacctatatagggccaaaatcacattggcccggcccacaaattgtgtagtccaacatgtgccggcgttgccgtgggcctgtggccctacacttcctagcaccgtcacccacagtcgtcaccgcagccgcagtagcgtcgccgccggcgtgcgtgtctccccaaccggagacagcgtggtgcggcctcagtctccctacagtcccctgctacattctgccggatcgacgtaaaaactcacagtttaccacctaggcctcgttcgatttagagaggattgatccaatccctccctcgtagagattaaccgaacaaggccttaggctgtgttaattcttttggaggggttgggatttgggaacccctcacctccgcacttaaaacagagctatagattaacacgtgattaattaagtattatagctatcaaaattttaaaaatggattaatatgatctttaaatcaacttttctatataaactctttacacagcgtacaccgtttagtagcttgaaaaccatgcacgtgaaaaacgagggaggtggatgaggaacccatgagaaataacacaaccttat

SEQ ID NO: 38215 - DNA, 4683 bp, Oryza sativa
cgaatcctatgttttattagctacaacctccgtcctataatataagagatcttaggtggatgtgacacattctagtagtctatctccagattcgtagtactatgatatatcacattcacctaaaatcccttatattataagacagggggagtatcacatcactatttatatgggcttgattcgttacaatgtaagtcatatactactataactataaaacttcgtaggatgatatgttacttaatctttcatgtttattctggagagttatttattccatgtttagattatgtttagattaaattgtctcaaatatagctacttctaaagtaccaatggacatttctagccatgaaatctccaaaatactactcatcttcgcaaccccatcttccaacaaccatgaattcatgacaataaaactaagggtaatatagtccatttttacctctccccatctaagtgaaaactttaaaagtaattattttgagccggagggactagtagtgtattagtgtaaacatttttccatcctaaaaaaatctctgaatgtttaaggatctgatttaaaaatttttggagagttgtatcttgatgcgttcaaatttcatcatatcatggttcacgaaatacgagtagcacgttacgttaacgttgctctaatgatcttgcacagagtcctgtgtgcagaataacacgttggcaaacgataagttccagaactatcttccgttatggcaactgtacatttgctcagttgcacgtgctaattgtcttcctagtcctgtcccttcgcacccatgtgctcatgtcagtctttccacctcagcgatacaaattactctccagttttctgttaaaaataaagtgcatactaaggcaagtataaaggtagagaccggtctctacgttaattacgttaattagatgctatcatgttacaatagttaagacaatatggtctctaattattaatgtaccaaaatactttcttactagtcatctttcatttattagactcactgcaacgaaaaatttccttaataaatgctaagagtcgactctatacggttgtcatgcgtagcaaccatatttctctttcattctttctctctcttccatgtcatcaaatatgcttgcatgacaaaaagcttgcataataatgagagaccgcttaataaagaccattgtacatgtcctaagggtctgttcactttgataaaaaaaaacttaccaaattttggtatagttgtcaaaatttgaataggatttcttatatagttaccaaaatttggtagcaaactaaatgtagccacttttggataactttatcaaaatttgataaggttgaaaatggtatcaaagtgaacatgccctaagttcgacatccttaagaaagttttatcttaggtttgttatttctttcattcttccaaaattttgtaaaccaaacatattcttaccattggtgccctatttggtaattccgaaagtttccactcttataaactctaccaaatgtttaataaggctttagaattaaagccatgcaatactaccaaaatatgccaaaacttagtactacaaaatttttgtaggattggaattgccaaaaacaacccattactgccctaaagttttttttttcacattagaccaccatttcttcacttccatttaactttggaccccttaaacttcgtttaacttgttcaccaaataaatgctgctcatataaccttgacattaaaccatcgtagtcaggcatacaccaagaatacatcagcaagaaaagaatccacagtatctctcgctcatctctacaaaaaaagatagcagcagtaaaacctccatatccatcacctccagctccaagagtctccaacaacagcaacaacagtatctctctatatcttgcattccatatgtacatcgtctcagaatccggcctccaaaatcaatgaaagtcccatgcaccgcactgctgcactgcacaagacgttgccaaccatccacagcagcagcagcagcagcagcagccgtcagtccacagctcacgcctagctagctagctagctctcctgacatccagccgccattgtccacagctcacgtatgtttgtttggcttgctctgctgacctgcttgctatcactaccaccaccggtggtcacaggctcacagctccgtctttagcttgttgcctgtctgggccggcgctcctgcacaaagacatggggaaaaaaaaagtagaagaggtcaaagttagtggtagggttcctggggtacaatgatttcaagaggggaggacaatagtagctaggacagcatcaagtgaccagctggtaacaggtaaaaagggggttcagttcagatcagtcaaattccaagaatttgccaaaaccagtcttgcataagttaattgagtactcctatagtcctattcagtagtttcttgaaattatatacgaaagccaaaaaagaaaggtccaaaaatgcatgcataggataacattgtcagtagcaaggggaattcagcaagaccgtctattttcgaggaatgcaaagcgaatgagctgaaccacagagattagaacggcaccaagttgggtccatttcaatgtgaagccatgaggttgagatctgccctgctaagacagagctgcaaggggatgggccgcgtgataaagatgatggctgggaaggactggacaaagcttgctgtataccactcagctttgagcgcagacaccggtacacgaagaagctgcaataatttctggcaaaaacagattctgccagccgtaatgcagtacagatatcatgtagtcagggcctcaggggagggccctaaaggtttaatgatccttgaacgctttgcatgattgggtctgtacctccaatagcatttgtccctccaagagctctgcttggatccagagctgcagatcagttaaccagatccaaacggcagatcacctgtactacacaccttttcttccatcttactcattagcaaatgcaagagtataacttcatgatagtgctaaaacatgatttttagacaatggagctggctcatttggctctcacaatatctgtactagttatccaatccactctcttagccaagctatataatcgacctcttaaactgaaccatgtgctacggtgtattccttgataaatatataggatccactacaaacttcagtacccagctacccagtgataaaactacatctctagttacaaggacagtcaaatggcacgcaaaatgtatgtcatgcaatgcaaacgtaaatctagcccacatgaattgccataatcgaatgaaattatcgtcgttagatatgtcaaattaagatccaaacccttagattcgcttatgtatttgctattcaactagttgaatagaaaacaatactacagtacagcgtacaaatagtagcactgagattaaagttgttttagctggctccctccattgcaagaaaggggatccctagacaggcactggacaacttacagaaaaagtggacccttcacagttgtacaagtgatcagaagggccaaagggaccagatctgcatctacaggccttatgcagccaagcccaaacggaaagccgggagcgatatggtttctagacatgcatttattgattcgggcccagccacaccaaccagttgggtccgctggtgccagagagaacagatccaccagacgaacacatctatggccccttaccatccaaaatggtggcgatgatggcaataatgattgagtgaacaaacaaagggaagaagaacaaacaaagcattctctaatctttctagaaagttacaagttcctgcttccttaaaccccctagttgctaataaacattcactatcaaatagaagcgggcccaattaggatagtcatctccatcacatccaaatcagaaggtaaatattatttatttatgtagaatttataacaagtacttttattagcatgtgcatgagataaggtatgataatctttcctaaagatgtagtagtagttttccctggaagaaactggtttttcacatattttaccacaatttcccatttacctatgtacttctaaacactctggaacaacgaaagagacaaaagttgtggtccaatcaaggctgaaaaattttaaaagtaaatgacaaacaactaaattcaatgagatataggtttggttgcaagttttaccagagcttgctagatcatagccgaagagggaggaacttgaattgctaaagacagggggattggtatccgtccgcttttcccactgtgaaggcggctggagcgggtgtgctaaatcaccatgccagaactgctgttgtagttgcatgagattccttgctccatggacgcccatgtctggccaggtgacctgctccaaatccattccattcttgtagttcaagcctgttatccttccacactataaataccatagtaagcagagtatatgcccaatagcataatcaatgaacctaaaatgtgaatcatgatcaactttaattgaatttgttatttctgagagatttacagaattacacgacatgcataatagaaaatttacatggaatttcacaaatgcaaaattctgcagaaaacatgtgatccagctacaatggtctaatcatgcatatat

SEQ ID NO: 38216 - DNA, 1394 bp, Oryza sativa
tagactgttggctgtcaaggcaaagtcaaaagcacgaacaataagtttcacagaaatgcacactctccttactagtacaaaatagtgcaaataaatgatgggaagagataaatttcagttttcagcagaggccaaactactcagttacaaaataatttaaaggagagttctgggccaaagaaatcagctatggtctatgaatcactgatacttccctaaactgccatctcagtatccaataggcaactgatacggatatatgcgtattggcgaatatcaaagcattttccagtattaaaaaaaaaggtcgatatgtgggcaagaagggagcaatacatatacacaggaaattgttgttgtaaatccacgcaagctaaacttgcagaaatcttcaagaaacagtatttgtcataatggtacctccgtagtcaagaagttgtctagcccaccaaagtcgaccctcggatttacagctgcgagcctcattgacaagtactgaaacaatcaaaattaccaaacaacaatgacatgagtgaacatcttaaggtaaatgggttatttgggacttaaggtatcataagcaaaaaaaaaaaaaaagaacagttacctcaacttgcctttgaagagattggacatgattgatgatctcatccagtaccagtgctgttcctgatacctgctacaaaaaacagatcaaacaactgttgtcgataaagtaattacttttcctgagttactacaataaaacaatgaatctcatgatggaaaaaaaaaacaattcaaaactatgacaaaaccacataaagtttaacctcagttttggatataaagaatggagctaccactataaaacaagaacatgaaacaaaatagcagcagcagtttggttgcagaatccaagtgcagaagttggtgcatagtactactcttcatttttttcaaagtttgaaatgtgatcttaaaataggcctgtttacgactgttaagttaattagttagagaagctctaagcatatacaacaaaaccaccagcttatattggcagtaatgtactggtttgtttaagacaatggccctcataaatcccacagcggattgaccaatacaatcattcacagtgatggacacctccagcccaaaggctgctgtcctttcagtaaaaataatagtcaaactaccgcaccatacaacaggctaatcacttccacatgaattcatagttaatgaagaccaaccaatactccccaatggtaaactaccctcacagccttacttccacaatccaacacccagagatgccaacccataagcacacattattgcgtgtgcaatagggatagcaacattccaaagtgagagagagagagatggagatatggagatggactcattgc

SEQ ID NO: 38217 - DNA, 4848 bp, Oryza sativa
acaattttcataaactatatacccaagataatcggaaactcttttagtccctcaaaattttataataaatttcacagaaccataaatatttcgagcaactatcacaatctacaaatttaaagtgtcagatcacaaaactacagatttagcatgaaatttctcacaaaactaaatatttaagatagtgtcaaataaaattaagatggagtgtaaaaaataaagattaggtagcaaatttatcacacagctataggtttagcaccaatctaatcacaaaactacaccatttatatagctccaacataaagatagtgttagggatttgaactctagaatctctaattatatgatacttggcttttcatatgtagttttatgacaagttttttttttgttaaatatgtagttttgtgatagaacaccttaaatctgtagttttgtgtgatagtttgatcaaaatatatgttgtttgtaaaatttactcaaatttttataaatagtatagaaaatcaaatgtaaactcagtttaacatatcaagagatattttaaaaaacaaattcaatgtataaacatatcggtactattcaatctaaatttatgctctatattgtgaaattttctccaccatttacgttaaatttgacaggaaaaaaaaagaagcatatgaggggaagaaattagaatcctcatcgcctcatgaacacagagtacagtatatatgcatgcatggcagcacgttcagtaccaatttggctaattggctacttgatgctcaccacacattgaagtcaacggctgcttaattaagctttgcctgcactgccattccataattcagtgaaggctatattttactctagtactacctactactatggagtattttactccagtagtaagaaaacgtgtcaacgaaaattgatctatctaatctatatactccatgcatcccaaaatattattacctccgtcctaaaatacctaaaatacttgtcgatttaagtttttatttgtaaagtttgatcattcgtctttttaaaaaaattatggaattattatttattttatttgtgacttgttttattatcaaaagcatcttaagtatgatttttttaatttgtacgaatgtttcaaataaaacgaataatcaaacattaaaaaaaatcaaaacgaccattaattttgatatggaggtagtacaacataaaaccggagtagacatatcataatactacgaatctgaaaaaccaatcctaatatcacgaatcaagatagagatctatctggattcctcggactatatatctcgtttggttagattgcaatattttggaacggaaatattatatattagttggactttaaaagaatctcacattaataaaaagaacagtgaataaatttagctattcatctaagtgcactgggactaaattattgttgtttacttgagtttacattagttagatcttcccaaatattgatgtctaattgtaaattaaatcaatatgatgctaacctgaaagtccaaaatatttaaaatttcatgtctattcattacgattttcaaattattaggtaaaacaactgagatgacaggccaagtacaactgtatttatgaactttggatttcggaattaatatatcaagaaggaatttaagttgtaactatatatatttgttatttatgggtccatgtcaattatgacttgagaattattaattgaattttataagaactaataaattaaaatagtaataaatcaaaacaccaagatggctacaactccatgcttatttttacgtttgagttttagaattattaaattatgaaaaactgtaatttggtacaaactgagtacaattttatttgtattaattttgaatttcataaatcatttcatgtaagaaaagctaaaattacaacagtataacaagtacaactttatatttattaattacgtgtacattccgtgcacatcaactaacaaatatcataaaaaaatccaaaaacaatcaatcaatagtattacacttacttataacatcttaacctgaaattcattacattttagtcgtaaaaaaacaaaaattctgacagatttaagactacaagtctattgaaattttgtctttttattttttttaacgacttgcacaagacgatacgaagttctatcgatagagaaaaaaaaactacaagattacaaccctgaagggtcataaccaggaaaaaggaaaaaatatgccaccaccccacacaccgataacgccaacacacaagtctaggagaaggctagcacaggaccggccaccgttaagcgtgaccgaccgccactagaccaacaaaggaacacagacgagatcgtcccttagggtatgccaaaatgacgttttcaagaagagaagcgacggaaaaaccgccgccgccgtccgtcggggctcaaatgagccaagactaggctttcacccggcaaccacccttgaggtgtgagacagcacgacaacaccctcaggagggtgaatgaatcatcgttgtcggtccggccaaggccggactgggttttcacccgccgctcaccacctgcgaatctacgctgacgcaccgatgctccaccaccactcaagctctgccgacatctgggacccctgcaccggcgccccccgccggccagccttcatgcgccaaagaccacgccacacccaccggcagctcctcctcgcaccgaggtcgcctcctccaccgccggccacatctctcgcgccaagccggcctcctccaccggacgcgtctcttgcaccaatccagcctccctccattggccgcgcctctcgcgccaagccgaccttcatctccaccgctcgcgcctctcgcgccaagccggcctccgctgccatcggctacgcctttttgcgccaagccggtctccaacccctcctccaaacgatgccgcgccggccagatgcagccgtctgccaagccctcggctagccgtccgaggccgtcatacctccagtgatcgcagtcacggtcaccaccaccgcaaccgctgctgctgaacgcccagccacctcgtcgtcgccatcctcacctcgccgccgtcacccaccacggccagtcctcctcccgtccacggtcgctgtccggcccatcgcccgtgcatgccgaagctgtggacgccgcctccagctgctgccggcgccgaccgcgcaagccacttggaacaattttttctagattttttatgatatttatagttggtgtacatggtgtattcatgatggtttacgtgcataggatatgttctcatataaccaaagagagatttttgtacgtaccaaaatttatatactagctaggatgtattccggtgacttctcaggagggtaagatcattcgtatataaattgtgcaaacatacaacttggtcgacggagaggaccagcaaacaagcacaaccatcgctttgatagttgacttaacgaatccggccgtacgtacgagtagggtcgcctaaacagacaatacgatatattttaagctttgattaattatgacggtacgcatctttttctctctgccttttaaaacaagatatttaaatgcatcgtccatccgtcatgcatttgtgtaactagcaaaccattttccatgattatacacgagctagattttatattcaaaagtggaattgaatagataaatatatttgtttccatttcgatataaatatattttatatacgaccatatcgatcaatatatatgagcctttatggctttatcatcgcctttatggctttatcatcttaacccgccacgatcgagtgatgaaattttttttatttcttttattaatgtgatatttttttaatctctaaagtgaacatagtggaaataaatggaccaagcatctagatggtcatattctagttttacgtagatttaaggtagagtttgaaacagattattcacatgtcacatattatctattcgattataggaatatattaaatatcttatgaaataaaccttacgataagtggtccaagcaatgcagcaaaatatttttttttgagaattcatatttagaaccattgagggcccctttgatttggaggaaaaacataggaattttgtaggattttaatcctataagaaaatttcctataaagccctttgaaacaaaggattaaatcctatccaatcctttgaaattcctatggaatggacaatcctatagagattttggaggaaatttagcaagaacttcaacctcttggtaactttcctctgagtctatctctctcatccaatttctacgtttttcctgcggttcaatcaaacgatcattcatgtgtttttcctgcgttttgcaatcctttgttttacactttcattcctattaaaatcctacatttttcctattcctgcattttctcaaccctgtgattcaaaggggccctgagtttgtttcatgacaatatgttgggtatatgtctatcggtgatatgggcctaggggtatcatgtttagagggaggaggccgccccccccccaactcacgtggcgtctcttgagaagggtggcgctcgggtggagtggctgccgccccctcccagcttagggtaccgagtttggaggaaggaggctgcccctagacccacatggcacttccccgaggggatggcgcccggggtggagtggcggttatcccctccgcgcttgggggtcgggcccgtcccgatcaagactagagggaggaggctgccccaagcgccacgtagccctcccccgaggggggatcgggcccgaggtagggcggtggcagccccctcctgtgact

SEQ ID NO: 38218 - DNA, 4141 bp, Oryza sativa
ccatcacatcataatgagaggctttttagcctctcatcatagcaggagtcggtttatccactctggtcaaacaggagcctagaagtcttcatcccttaaatggcgactcacaggggcaccccccgtgtcaggcggcaagatttgacgggccccatcatcaagacaacgtgcaatagacaagacatgcatttaatgcaaagattgtaatacttctccactaagttaggttgttgggcccatgtggtaaccccttatggtataaaaggaggtccaggcctacttagggagggggtgttttttggacggatagagggaggatgagccattttagactctagagcagtctcttgcccctgatgatcaacaccaccttctactccaacaagaagatcttgtaacccccaactcaatgaacatagcacatgagtagggtgttacgcttcatagcggcccgaatctgtataaaccccttttgtccaatcgtctttgaggggcctacctaaccccctcaagatcacatgtaacgctccgcttttcgtgagtcgttaaaaactaactcggcaaaatcctaattgcgaaaattttcgttctttgtgtgagagtctaagttgtgccaaggatcccaatttaatcccgttgttccctctcatcgaaatcaaaatcctccccctcatccaaattcctcttccgattcaagtctctgaaatcaaaattctgaaattcaaatccttcctttgaatcctcgccaaatacttctacgaatccagaattattcaaatcccgcctcgaatcctttccttgactccaccctatgttcccgagaacaaatacccaagtattccttttgaaacttttccatgactcctccttgagtttcccttgatacatccctaaaccctcgagttcgaatatcaaattgaattcgaatccaaaccctaaatctctccaattctatccaaatcagttttctctgtaaaagtctactttacctccctgtatttttggatggaccgattttcctcccccggcccatctcccctccccagcccatctctctcctttgccatctccctcacgtgcgctgcacgagccgtcgccgagagaaggatctctctctctctctctctcgttttctcgctccctctctgtttctctctcgcgccgacaccgcttcccgccgtcgccgcccaaaacctccaccgccttcgcccattcccgcgcgcgcctcgcgaggtggccgaccggccggtcgccgccgacgccatgcgctgccggcttgcccccgctccatgccaaaccgaccgccgccgtcatcgtcgacgtcatccatgcccccccccccccccccggcacttcacgccggacccgttcaagagtgggagaagcaagtggccttcctcttctcctcctcctcactctccctctcctcattatggcaagggaccaagcccctttttccccttctttttcccttttccgaccactaccggtgtcactgcctctgcgccgcttgaccgaccacgccaactcgctctccttgaccgcgccagcccgcgctcccgtggttcgatttccgccgctcgatccaccgccttcgccgcccaacgcatccacgccgtcgccgctttcgcactgcccacgaaaccgccgctgccgcccgtgaacaccagccgagctcccttgaccgccaatgtcggtttccctcctccaaaccgacctctcctcctcgcctataaagcccgcgccctcctctctcgtttcatctccgcctcgctcgaaacacccgcgcctttgttgccggccgccagctgctcgcccccgccccgccgtcgcgaccacctcgccacgactccctctgcgtcgccaacgttgctcctctctcgccggtgagctcctcgcccaaattcttgccattgcatcatcttggataagccccgagccgttcggttgctcgctcgtccccctaaacgtgccgccccgccgttgctctgcttcgccgccgccgtgcccgactgtgcgccgccatgggccccctcgccaatccctcgcgccaccaccgtccttgagctccctaggacctccccaaaccattccctagcgccgtcgccgcccggcacggcctcgccgccattgccgcccgctcccgaagaccgcctctcgtcgccagccaatctcggtgccgctccatccaatccgacgccggaaacggattccttgaaccccggagatgctcccacccctttgaatcgaaccctcgtcgtctcgtcgtgttttccccttttgctctccggtgattgccgccgccgtaatccaccgtcgtcggctcctctcgcgtcgattcctctcgccgccgcgcgtgcgtcgccggtgaccatcgggtcccgcgtccccgcgtgcgcatcgcggtcgcgtaccgtttcggctaggcccgagtccgcgcccccttgtcccttccctcacaagaccacatccccgatccgacgagcttggtcgccgccgccagccaccgtcgtacctcccctctcaaatccgtgccgttaaacggattctccctgacctcctctagctgccggcggtagccgctcgctccggttcaccgctgctcgccggaacgcctcgcgcgtcgtcggccgtccgatcccgggcgcctcctcctcctcctcctcccctttcgcccctgcccgcgtggccgaccacgtggcagccacctcagccccgggcccgcttgactgggtcaagtcgcgcccagtcagcctcctccctccgtcttccctcccgtgcgcgcggtccacggcaagccgtgcggctgcacgtgggcccgccgccatccgtccacccggcgcgccgcgcccgaaccgcgcgcacccgaaaccctagcgcccgcccccgcgtgcgccctccccaccgtgaacccaaccaccgccatgtgggtcccgcgcggtggaccgcgcccaccccgtcgggcctccctctctccccgcgcgccctaatgggccgtctccccatggccgcgctcggcccaatggccggccaagccttgtgaatctctcgagccgcgcctaagtcgcccgaggaagtctaaatccgatccctccttccttttcttttccaagggaattaataattccttttccttgtccagaaaatccatttagacctccaaaattcatatccctcgatccgtagctccgatcgcctccgttccacttccagtaattccgtaaaattgagacctatttaatggcactactaataggtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttatttgcaacttgcattattagaatcacacttaacttgcttggcctcggtttgcgtgccaaaccgacggacctacccagtagtcgcactaatttccgtaggtcgtactaccctgtttccttgtcgctccacccttgtggtacctcggtattcgtgctctctgagcgcgtataccaaatatcccacatacatcgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgagacaccctggctaagtagctagtcggttcagggaaacctcgcatgccaatagttgggaacgccggggcggggtcggttggagccaaaccgggttcctggtaatgcaagaacgagaagcttgctgaattaccgatcgaggtggttggagtttgattggtgaacgcctaaaatggcctatgtttatgtgaggatttgatccttctatgtggcatgaggtatccctaggtcggcttgggaaaggctttgtcgcgaacctctgacaccggccagtgtctggagtaagttcgggtctgtgggtaaag

SEQ ID NO: 38219 - DNA, 8675 bp, Oryza sativa
tttgtaaaatttaaatatttataaacacaaactcatatatatatatactatctctccgttataaattgtcactacctaatgaatctgtctagattggtagtcctaagaagtatcccatcctatacaggaataatggaacttttatgaattcatgcatgtgcctgtgcttgtgcatgtgttgccggtcaaatgtcaaaactattgtgtcttactgatgccggtcaaaaagtcaatagtcaagaccactagtatatataccgtgtttagttttcattgtttctactcgtactccattaagcaccatggacgacgcagacaaagctagatgtatgtacctttcagtacctcgtctccatattttggaaacgaaactacgaaaggaaaatatttgtcttcccaatggatgacgaaacaggagctttccgtgcaatttcattgatcgagaagaaaatgtcgtgtatattacggtgatatcatttatgcactcctagcaaaaaaaatagatcaattatgcgctagatgacatgcgtccacaaacacaattaatatagttgcttttatgcaatattctaatgacagttaaggatgcatgtatctgaacaaattatacgtcatctcaatactgtgtattttatgccagtactatcttaattatttcaggcacacaaagttgaattttacttgttattaataaacctccaactctgatcctttctacggtcagataccgtaggtgatacgtgagatcgagctacttaataattatgtagtatgataattaacataccgtatactgaacgggtacgatattttttgaataaacactacttgatcgatcgagacacaataatacgagatatatatagaagtgtgtcaaagttgtcctatgaacttcaaaaactgtagaaaattaaaactcgcagaacggaatatatattcagatatgtttgtatgcatgtgctaccaaagttttaatttttaattttctcctgtatcgggcagttataatatcccctgtgttctacgcaagggggcttactaaaatgcgcatttttttgaggtaaccagtttaattttgagagcggacacgaaatcaattgtttcgggagtctatcattaggaatgaatatgaaaatcaactacttgaccatgcatgcaaacttgatgattataagacgttttggagcaagttgaaagtgaattaattaattactgaggcttgttgaatttggccattgttgcattataatcgacaccagctttgctccaattcgtggagactgagagctagcttgtcatcattatcttgctctcgcagcggagatggaccagtttatctagctagttacttgggcggtttggagaaggtcacgtgacacattcacgtaatcacgttgtgctagcttggctaaaggagcattatctgaagctgtacgaggctagtagaaaaggcaacatgaaattacattcctatttacgcactccgtctaaaaatataacagtatttaaaatgtcatgttaaccaatattacagatcatccctatttaatttctcatcttgccttaatccctagtatatataaaagaaatctaaaagtagctactatatccgcctctaagatatactctcttcatttcaaaccatttcaggttataaaatgttttggttttgataaagtcaaactactttaaatttgactaagtttattgacaaatgtagtaatatttacattaccaaactagttttatgttaataattaaatatatttttagaataaatttatcttgggtcgaaaatattactattttttttgtcaaacttaaagaaatttgactttgaccaaagtcaaaacatcttataacctgaaagggggagtatccttttaagttatgagtctgttaatagatatctatccgagataccgcatccgttccatcataattgtatttttaggattcaaatttgtcccaaaataattatcataatagagtagtaactatttcattaatcacttttgatttgaatttctctgtaacgctccgtttttcgtgagacgttaaaaactaattcggcaaaatcctaattgcgaaaatttcgttctttgagtgttgagtctaagttgtgccaaagatctcaatttaaatccctcccttgtctcgataccctgttatcaaagatcgtctcctcaaaatttccatcccaatatagtcccgaagctcgattccttctattcggaatcccctcctggaaccccatccgtgaactttgtcgaatgcccgaaccctaacttcatctaaggattcaccttcgcgtcataagctctctccttggttccttcaaaccgattctcaaattcgaattcaacctctcaggttttgattcatctatctttctccctgtattggttcatcaatctacccttgttctctttctcgaacttctgatccaagtctgaatatgcaaatcgagatcacttccacccttgaactcaaaatcccaagattcaatccctttcgccctgagttctccccaaaatgatttccgttccgaaataatctcgaagtccgaacccttctattcagacttctctccaaaatccttacccacatatctcgttgagtagtcaaactcaaactcccaagttacactctctttctctaaattatccatccccttttgactcgtctccgaatattgttcccttccttgactccttcctattctcccgagaccgagtatcaacctcgaaattcgaatccagactccaaccctaaaacctcccaattaaatctctctgtgaaagtctatttaacctccctcataggttggattccttcatcctttttccggtccacctcttccttctcttccatcccatctctctctgagtctcgatctatctatctatcgatcgatccatctatctatctactatacctatctatctgtttatctatccatctgtcaatccatctgtctatccgtccctctacctatcaacctacctttctgtctatctatctatccatggcattctaccgctatctcccttgttccatttttgaataatgatcttccctttttgaaatcctctgaaataatccttcgtgccgccaaatataaatccatcccaaaaataccaaaattcccgcttttgaagcccttccttgacccctcccttggatccaccttgaaccctcgtgtacaaatatacaaattgaattcaaattcaatctccacatcaaacttctctccaaatcaaaccttctggtaaaagtctattttacctccctcgtgatgatttgggccgaaacatgccgctggcccatctcttctcaactccctccatctccacgtgcgccgcacgtgaccaccgagagagagagagcgctgtctctctctcccttccctctctcggacattctctcgctctctcgtcctcttcctctctctcgctgtctctctctctcgttcgatctctctctcccgcgccagcgctgccgccatcgccgatttcccgctgccgccattcgattttcggctgtgccgctcgttcccgcgcgcgcgcgcacgctcgtgaccgacctcccggtcgccgcctccgtcagcgcctgcgctacgctgccgctcggccccgctgcctgccgcgagctctgcagcgcgtgcccgagccgctccacgtgtgtcctgccaaaaccgtgaggctgagctcccgctcctatccctctccctccccaactcggcaaagagaagagctcacttttttcccctccttttctacttttgcccgacaccgccggcgtcatcacctgtcgccgccttggctgcacgcgtcgatgaccgccagctcgctctccttgaccgccaatgtcggttcttcctccctaaaccgacattgccatctattaaaccgagccgccccatctccctctcgttcattccctcgccaccaccgtgcccttgccgccttgctaccgccgtcctcgcttccctcctccatcgcgcgtgctggtgaagccggcgtgcgcgcgaggagctgacgcgggactccaggcgccgtctccttccccttccccggcccgaggccggagagctcgctcccgcgtcgtcggccgctcgtcacagcgtccgtctcgactctgtagtgcatctcccgttctccctccttgctccctctcctctccttagctctgggcagtagtgcgagtagccttccagtagcaagctggcgccgccccgaccgccgccgctgctcgccgtaggctcgccgccgtcgctgcccaaactcggtagtagccgctcgtcgccggccttcctcggtgtagctccacccaatccgactctagaaatgaactcaggaggtcgcgtagatgctcaagtccctaggaatcgagctctcatcgcgtcgtcgtcgtttccctcttttgccgccgccggcaagcgccgccgcgattcgtcgtcgccggcctccctccggcgaatccgatccggtggctcactccctctcgtccgtcccatcgttcaggtgtactccctctctctcgaatcgtcgcgacgagctccggtgaactcggctgccgtctgccgtccatctcggccgccccttctttctcctcccgccggcccgcgtggctgccacgtaggcgccatctcggcgccacctcggccttgaccgggccaagccagtcagccgccccctccctccgtcttccctcccgtgcgcgcggtccacggcaagccgtgcggctgcacgtgggcccgccgccatccgtccacccggcgcgccgcgcccgaaccgcgcgcacccgaaaccttagcgcccgcccccgtgtgcgccctccccaccgtgaacccaaccaccgccatgtgggtcccgcgcggtggaccgcgtccacccgcgtcggcctctctctccccgcgcccctaatgggctgaccacccgcgcccgcgctggcccaatggcctgaccgcgctgcgcatgaccccttgggccgagcctaagccgcctgagtaagtctaaatgacatccctccttccttttcttttccaagggatttgataaatccttttcctttagatagaaaatccaaataatcttaggaaatccatatctccccaaccgctcgtccgattgactccgttccacttgcaataattccgtaaattgagatctatttaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattctttgtcgctccacccttgtggtacctcggtattcgtgctctctgagcacgtataccaaatatcccacatacatcgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtaggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagttgatttgtgaatgcctaaaatggcctatacttacgtgaggatttgatccttctatgtggcatgaggtaaccctgggtcggcttgggaaaggctttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgtgggcatcatagactaggcttcctgagtggaagcggattgctttgctgctgggcagctggactctgggagtccgagaaaatgaaaaaggctctgggagccgattaatcaagtggaatggctctgggagccgagaagtaatgatctgacccgggaggtcggtacattactaaatgagctgttgaaaaacatctcttaaagtcgaattgagacgcaagtctcttttcggcccaaacttagaaagaaataaatcacttagtgatttcaaaatgtcttcaaataaaagatttgcaaaacaaccttgcctctcttccaaacttgcattaaacacctaagttcccgtgacttgctgagtacgaaagtactcacccttgctctatataaatatatatatatatagttcctccgccctgaagagaagataaagtgaagtgaagattagagtttcgtcctggttcccagccgtcgcctgtggtgttgggtgttagaccgttggttctgctgctgctgttgttgttggtgttcgcctcatccgtgtcgtcggttgtattctcgggctgtctgagctgcaacctaagttaaggtaaataagtactctatttattttaaggattgctatgattcatatttgtcaccgtgggtaccaacactatgtcctgggactggtaccgagatcgcggtttcgtaggaagcggttcgcgccgttttccctacgacacgctcctgtcaggtgccgttgtacggcggtatcagattggggtgtgacattatccctattctatcctcaggcatcatcctactcttactagctatgcaccatttaatgaagggtatcttagtttttcttctcaaatcttaatatatgataagtaatctagaattgtaattattttaggatcagtttgggactgaggtagtagtatatagattttggtatggggtaattacaaggggaaacctttggtgccggcgattgagctaaatttggggcctgctaaatggatgcgccgttggtattgaaatgtctcaattttccttttgcgggaaaaaagtctcaaattaaaccaacagggctgtaaaatgtagagaaaatagaaaaaccgatgaactataaggactgtgaatgcttgcatgcacactttcttttcagatatacaagagtacaaagtagctagagtacaattcaaacctcctaattgtgggtaaacaccaaaacagttttctttacctgattaaaagaaaagccaaactatccatcataagcatggacaaccaaccataacaggacaagaaactcatatttaccacttgttttgcatgcatcaaagaacaagtccagagtctttttttccctttcaggaacaagtacatatatagagccaaatgatgtttatatgtgtgtagctcatataagggtgataaatatatatcattttatttttgtcaaaaataacatcatcgagatcaccacaaaggctatgtcgcctaaaacttctatttaaatcctaaacatgtttctaaagtgaaaaatattttggatatatttaaatcctaaatattccttaaggaggcgtgcatatttttccatggccatagcattcgacagtccgcaaaatattcagagcttatcaatggataaacgaattattgtagtactttaagaacataataaaaggtttggctgtacatgtacacacccacttttgggtgtagaggccaggtttaaatccattttctaaaaaaaaaaagatgacatttaataaaagccgtaatgtcacgccccgaactagccccgaccggaactagcccgtgacgctccaaattaacctgttaatcgataccggccccaggaaatagtgttggtatcacaggaagacagattatcacagcaacagaggtctctttattacagagtaggagtacagtcatgttgggctacggacagatcccgagctcacaaatgcattaaaaagggaaagcggaagccaagacttggaccatttatcacaggcgcgacttggaaactaggccgaaaccttaaaactcatcgtagccgacttgctcctggaagaactcctcgtcagcgggatccactgtcacgtcccaaaatgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaaaaaagttaaaatgattttataaaaagaaaatctctaaaaagtcccctttccctccctctccctcttgggccggctcggcccatctccctc

SEQ ID NO: 38220 - DNA, 2907 bp, Oryza sativa
tctatttaaaccctccccgcacctcctccgtccgtttccgcctctagccgcccttcctcctcgccggaatcgagctcgcgccgtcgctctctctccgccgtcgccgtcgagctccggtccgccgccgtcgtcgccccggaccacctcccacctcggcgccgcctccttcggcttcgccgcatcctcgccgacctcgtccacccctccgtttcgctcgccgaccgccggaacgccgtcgaccccgtcgacccgagccgcgccgccgccttcctccgctccggctgcctttttcgtcgtcgctgtcgacctagggtgagccgtggaccgccgcttctttttccccttcccttcccctctctcggccgccgctccgccgtgcctatggccgccgccggcgaccataggggcgcgggcgccgcctcccgccggctacgccggcttggccgccctcgggcgcgccgagtggctgccgcgtggggcccggccgtcagccgcccgcgccctcgggtgcggctgacgcgtgggacccatggcgccggtcggtgtgagcccaggtgcacccggtccaccgtggaccgtgaggctgccgcgtgggccccactcccgtggacccggtccgcgcgccccctcccctcggctgacgcaataagcccttttaaaattaaaatttaaatgaagaaattcgcaaatattcatttaaagagcatataaacttcaaatgaccataacttggccatttgaactcggaattggaccgttcaagtctctaatttttccttaagaagtcaagaacctatttttgtgctttgttccagcttgttatatggagtttattagagtaaaagccttttcttttccgttggtcgtgtagacgccgtagcttcggaagatccgctcttcgtggaagttgaagctgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcccctagaataaacaaaaccccaactagtggacactctactcatggtaccactagtatgattttaggtaaatgcttcgctggttcattaggcaacattaggtggttttacaactctagactttaggaatattctcatcacctggacacttttgaatggatggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaagtgtagcgcccgttccgtcgtggcgcctagcgggaaaattatctccgaaaaaccctaattgcaaaatttgtttctttgattgttgtctagtgtccgtgccatctcaagatctcaatccccgatctatcgtcgagttcaattccgaaaagtctagtttgcctcccccgggttcgatgggccgaattccgctcggcccatctcttccccggccccctctctcccgggcgctccctctctctctctctctctctctctctctcgctttccccggcgcgttttccccccccgctcgctgctcgcgcgtgcgagagccgcgccgagcgccccctcctctcgcgcgagctccccgctcgcaaagccggccccgcgcaccgtcgctcgcgcgcgcgcccgcgtggtttcccgcccgagccgcgtcgtctgcgccgtccgcgtcgcccggtcccgctgcccagccgcgccgcccgttgtttcccgcgcgcgcgtgccgagtggccaaccgcccggtcgccgccgccgtcaccctttgccgcgccagcccgcgcctgtcgcccgtgtcgtcgcgccgctccaaaccgccccgtcgtcatcgccgttgtcatcggccggcccccgccactccgggcgctagccttcaaagggcggaggcagagagcccctttccctctgccgagtcgccccgctccctcctccttttcccgaatcggcaaaggggcgagccccctttctgtccctccttttcctctttttctcccctttttcccctctcgccggcgtcacctcctgtcgccgctttggacgctagccggagcgccagctcgccggcttgaccgcccatgtcggttcccctctctcaaaccgacattgccgcccttttaaacccgtcttccccctcccttcctttcctctcccattcgcctcctcaccgttgtcgccgctcccgtgctctgcctcgcctccgccgtccatcgccaagcgccgggagagccggtgcgttcgtggacgcggaaggggactccgggcgcgccctcttcttcctcttcctcggcccgaggccggagagatcactcccgcgccgtcggcctctcgtcactgcgccccgtcccgcacggtagtgtctctctccgttcttcctcctcgctccatctcctccccctagctttcggtagtagcttgagtagactccccgtagttagccggcgccgccccgaccgttgccgtcgctcgccgtgtgctcgccgccgtcgccgcccgagctccgtagcacccactcgtcgccggcctcgctcggcgtagttccgcccaatccgacgctagcgtcgagttcccgaagccgcgtagatgctctcactgccgggaatcgacctctcgtgacctcgtcgccgttccctcttccctccccgccggttgtcgccgccgcgattcgccgccgtcaagctttcttcggcaaatccgagccgatggctcgt

SEQ ID NO: 38221 - DNA, 17893 bp, Oryza sativa
ccgtttgttgagttgttccatttcgcgtatagtttcagagcccgaagacccgcagtgcgaggatttcgaggatcaagctccagatctcgagcaaggcaagccacctttgaacatcttgagcctatatttgaaatttaattatgttgcttgcaaaatattatgcattgataggatcgcacttaatctgtttgtcccgtctacaaggcagattggcggacctacctaatttgtcgcatttgatccttcctttgttaattgctataccatgtccccttgtaaccacccagttgcgcctcgatactcgtgcactctgtgcaagtatcgacggtcgccttcaaccttaaaatctgagtaacaacttgggtaaaactggagttttacaaaagacttggaaaacccgacacctgggtcggtgcctccgaaccaaatgaatttccaaaaccgcggaccggggatcctaccgggtgtacggtttcccgctcttgcacttaaggaccgtttccttggaatttcatccgaacataagacaagtacgaccacatgggtggaatgggacgcccctggctgagtaaattgctaatcgggggagctttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccacggacatgggcggatctgaggtgattcctagcgtagttttgtttgtctactgcttgtgaaattgctgttgtgaaaaggggttcgatgtttgaaaaatctgcagctgatgggatcagctaggcccgagtggccgtttgaaaagttgttggcccgggtggccgtttgaaaagttgttggcccgggtggccgtttaaaaagctgttggccgggtgccaactttgttgcaatcctaaagattgacacattgcacatactccgaccggacgagacgcactgtctcatccgtgtcgtttgagaagcactcacttagttgttttcagaaaagagttcaaataaaatcaattgcaaaaacaacagccttcccttgaagcctgcattaaacacttatttcccctggcttgctgagtacccccgtactcactcttgctctatataaatatccccccccagttgctgaagaagatgaagcggatcctgctgatgaggagttcttccaggagcaagccggctacgatgagttttagggtttcggcctagttcccaagtcgcgcctgtgatgtttggtccaagtcctggcttccgtttcccttttgtaatgcagttgtgagctcgggatctgtccgcagcccaacatgactgtacttctactctataataaagagacctctgttgctgtgatattctgtctccctgtgataccagcactgtttcctgggactggtatcgattaacaggctaaattggagcgtcacgggctagttccggtcgggactagttcggggcgtgacagtaaggcttagtttgtggctcagtctggttataaacaaaagtacacggatggagatggacgaagttgggggtcgatggacatctctaggacaaatgaaggctacacgagctgcggcccggtagtcgagatgtcatggcacagggccggtgtcctgctgctaggggctcagtcctgcctacctgtcccaggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctccgttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctggaatcgtgtttacaaaatagctttgagcaactaagtgtcttttaatgctgtttactgcaaaccctaaccctttatattataaccccctttactcccttgcatttatcctgcacttgtgggtgtgtcttgttgagtacgttggttgtactcagtcttgctcaatttttttcccaaacccagaagaggagcccctggaagatgaaggctttggtgtctagctcgtgcctgccgtcaagcgcctgtggtcgtcgccctagtcttccgctgtttcccgtttgtctttgtgtgtgctgggccttcgccgcccatgtaataaattaactatttacgcttccgcttgataaactctgaaatatatcaactttcggtgtaccttgcctcctgggacaaggaataatacacgcacgtaaggaacgcccgttgggttaattccggtcgtgacatccacttcatcttcttcagcaactggggggagattatttatatagagcaagggtgagtacaagagtactcagcaagtcatgggaattaagtgtttaaatgcatgcttcaaaggaagggctattgtttttgcgattgattttaattaaactcatttttgaaataactagatgagtgcttctcaaacgacacggatgagacagtgcgtctcgtccggtcggagtatgtgcaatgtgtcagggttatggataccacatacctaatagtagttgactaaatctcggcaggatccactacataccatgtcttatacagaaactgacctcgagggagttccggataaggaaagacaaccagagttctacatggaaacgacaaggactactaggattgtatccatattggtttccctagttctacttggacaaggggacacctatgggtataaatacagggccccctaggaggagaggggggacaagacaatcaacacccaacgggatcaacacccgataggatcaacacccaacacaatcaacatagaagcctacatacgccaagacacgccgccggatatcgacttcagggataagtacggctaataccctacggtgtcttcggatactgtcaggagaaacgaaagcgctatctctgatctcgccgggcacggattcgaggaggaaggctaccctgttgtcaactacgagtcagatcgtcagaccgccatgtcgacaacagttagattagctaccccaaatattgtactggtgtgattatggtgaataagagcaataccggctttggccaacaggatgtagggttattaccccacaactcgggggcccgaacctgtataaaaatccctgtctccatctcttttacctcagtctcgcgtataccctagcaccgacgatccccataccatgcaaataccagaattgcgacatcaaacgtcgacagtggcgcgccaggtagggggattttggtgcttcaggatttcgacgagatgggttcaaaagatggattctccgacaatgagctactcgacgacttcagctgagggggagatccaacctaaccagatcggaaccatcatcgtcattgacaacttggtctatttagatcatccaagcctcaagctttgcggcgtaccaaaagatgtcagatcgcatgatatcgaacgagtacgcaacaaggtaattggtagattggttttttaaatcaatctactaatttcgtaaatacatctggcatgtatctacaaaggtacgcaatattttatctgcaatttatcgtacctattcagatcatacagtattgtcagatctataatttattatgtttacctagagcatgttctttatacaataatatctgttgcgcgggtgtccccgatgttaaatcgactacgatctaacgctgggggctcgctgtcttcttctgtataaatcatgcttatttacggttcacataatgccctgacatttacatctactcgttatgtcataataatactagaagatccatgcagttttttgagtacatactcgatattatctgctatatgtcttgtcttctagaaaatatttttcaggaacaattgagcactcgagtaggttgtggtcgagtacactctattatcgagaacattctcgacaaatgcggagttatcgcaaccgacctaccaacgaagaccgacgacctatctcatagcaccggccatggctggactactcgagaaaaggttgttaacggataattcctcacgaacgccgtcggcttgatcacccgacatgattgcgaatggacatccggatatgctacaagttgggtgtgtgagtcatgctagccacatgagacgcacatgtaataaaccaactctagcacctccattggtgttcgagaaataattctacacgctcgctggtcctcgaaccagtacgtagcaatctctcgcactgcagcttccgttggtgttcgagagataattctactcgttcgctggtcctcgaaccagtacgtagcaatctctcgtaccgcaacctcagatggtcgaggtacgactacagtaataacgcagcggtcctcgcaccacgacttcaaatgatcaagagacacctactcactggttctcaaccagtcaatcgtagcgatctctcgtacaattacttctagtggtcgagtttagactacaccaggttcttgaccagcggtgtaacaattttcctactatttccacttcaagtggtcgagttacgactactgcctggtcctcgaccagcgatgtagcgtttctcccactacttccactttaagtggtcgagttacgactactgcctggtcctcgaccagcgatgtagtgattctcccattacccctgcttcaacaaagttgatatcaggtgcacaagatcgctaagtgttttacccagagatcccttacccagatgacacctagcgttgaaacctatcctactgtccctttactccgtcttgacaaggcctccgaggaacctgagggaacttcggctggggatgcccagagctgataaggccttgtcggatccttcagagacgaaagaccatgtaagatctggtcgtgtaagagttctcgccgtgcgtattaaccaagccgtgtaatcggaaattgaattttccaacttcatgactgggggctaggatcagtgcttgttcaaccgaggcaggtcaaaggtccaagagccttgtcatccgagaacaattctccgacgacaaggctgggggctagggagagtgtatgactctacaaactgactgatcggagtcggtaagaaagaagacgctcatatacaaagcactggtctgtacattcaattcactagtctgtcatattataacatgtcaccctttgagcattcgctcgggggctatttctatctaatattcttttctgagtattgatttcaggaaaattctattcgacattatcgaagactccatgtctctatggttctacaccaagatcgactaaggcgagtacgacaaatgtcgacaaggttccgtcgcagactctacgccttctcgatcactcgagaacggttgctggatctcgacaaggaatacggaatgaagagatggtgtaccgccgagataaaatttcttaacttcaatccaaattctcgattacagcaagacgggagacttagtcgtacgctctgtactttctcggtcgacatcggagattgatttagacaaaccctttcggtgcccgcacgaggctgataaaggaagtctaacgttatctctaaactcaccgagaacggtcatgtgagctcgataacagttcctccaaagtctgcggttgagaatatgaactcgttcatttgcatcgaagtcgggggctactgttagtgttatggatacgacatacctaatagtagttgactaaatctcggcaggatccactacataccatgtcttatacggaaactgacctcgagggagttccggataaggaaagacaaccagagttctacatggaaacgacaaggactactcggattgtatccatattggtttccctagttctacttggacaaggggacacctatgggtataaatacaggcccccctaggaggagagcggggaaaagacaatcaacacccaacgggatcaacacccgacaggatcaacacccaacacaatcaacatagaagcctacatacgccaagacacgccgccggatatcgacttcagggataagcacggctaataccctacggtgtctccggatagtgtcaggagaaacgaaagcgctatctctgatctcgccgggcacggattcgaggaggaaggctaccctgttgtcgactacgagtcagatcgtcagaccgccatgtcgacaacagttagattggctaccccaaatattgtactgatgtgattatggtgaataagagcaataccggcttcggccaacaggatgtagggtgattacctgacaactcaggggccgaacctgtataaaaatccctgtctccatctcttttaccttagtctcacgtataccttagcaccgacgatccccataccatgcaaataccagaattgcgacatcaaacgtcgacacaatgtatcagtctttgattagatcaaggttggctcccggccaacagcttttcaaacggccacccgggcctggctgatcccatccaccgcagatttttccaaacatcgaacccattccacaacagcaatttcacaagcagtagtcaaacaaaactacgctaggaatcacctcacatccgcccatgaccgtgggcacagttgttcgaacagtttaataacctctgcagagggggtacactttacctactcaacattactaacccggatcacccagcccgtgcagaatggccacgtctggtgtagcgcccgttccgtcgtggcgcctagcgggaaaattatctcttaaaaaccctaattgcgaaatttgtttctttgcttgttgtctagtgtccgtgccatctcaagatctcaatccgcgatcgatcgtcgagatcaattccgaatccaattccttccaaatcgaatccctccgcaaaagtctagtttgcctcccccgggttcgatgggccgaattccgctcggcccatctcttccccggccccccctctctctcccgggcgccctctctctctctctctctctctctctctctctctctctctctctctctcgctccccccccggcgcgttttccccccccctcgctgctcgcgcgtgcgagagccgcgccgagcgcctctctctccgctcccctccgctccgcccgcgcgccgcgcgcgcgtgcgcgggagtcgcccgcgccgagcgccccctcctctcgcgcgagctccccgctcgcaaagccggccccgcgcgccgttgctcgcgcgcacgccgcgtggtttcccgccctcccgcgccgtcggcctctcgtcacatcgcctcgtcccgcacggtagtgtctccctccgttcttcctcctcgctccatctcctccccttagatttcggtagtagctcgagtagcctccccgtagttagctggcgccgccccgaccgttgccatcgctcgccgtgtgctcgccgccatcgccgcccgagctccgtagcacccgctcgtcgccggcctcgctcggcgtagttccgcccaatccgacgctagcgtcgagttcccgaagccgcgtagatgctctcaccgccgggaatcggcccctcgtggcctcgtcgccgtttccctcttccctcgccgccggttgccgccgccgtaatccgccgccgtcgagcaacctccagcgaatccgagccgttggctcgtctcccctcgtcctgtgcagccacccggtgtgctcgctttcgccggtatcgccgtggctcgctacgccgctcgccgctgtcgcccgccgtccattcgcggccggttcgtcgtctacctcccgccggcccgcgtggctgccacgtaggcgccacgtcggcgccacctcggccgcgaccggataagccgacccggccagccgctccctccgtttctccccgtgcgtgtggtccgcggtgagccgtgaggctgcgcgtgggcccgccgcatccgttcctccgcgaaccgcgcgcgtgcactgcgtcccagccccgcccgcgcgcgtacgccgcatactccctccgcacggtgagccgagccgctgacaagcgggtcccacccgggaccacgcgtggtgagcccggtccaccggctccctctctctcctccctcccgcgcgcgcgcgcgcttgggccgtcttgggccggccggtccgttaagctcggccgagccgccccaaatctcttgggccgcaccctagccacccgagaaaagtctatattccctccctcccttcttttctttttcttttccaaaaaaaggatttaaataaatcctttttcctttagaccaaaaatccaataatcttagaaattcaatatcttcccaaccgtaaattcgattgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccggatctcgagcaaggcaagccacctttgaacatcttgaccctatatttgaaatttaattatattgattgcgaaatattatgcattgataggatcacacttaatctgttgtcccgtctgcaaggcagattggcagacctacctaatttgttacatttgatccttccattgttaattgttataccatgtccccttgtaaccacccagttgcggctcgatattcgtgcactctgtgcgagtatcgacggtcgcctttaaacttaaaatctgagtaacaacttgggtaaaactggagttttacaaaagacttggaaaacccgacacctgggtcggtgcttgcgaactaaatgaatttccaaaaccgcggaccggggaacgtaacgggtgtacggtttcccgctctcgcacttaaggacagatttccttggaatttcatccaaacataagacaagtacgaccacatgggtggaatgggacacccctggctgagtaactagcttatcaggggagctttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaaggggattcgatgtttgaaaaatcagcagctgacgggatcagctaggcccgggtggccgttgaaaagttgttggcccgggtggccgtttgaaaagctgttggccgggtgccaatcttgtttcaattctaaagattgatgcattgcacatactccgaccggacgagacgcactgtctcatccgtgtcgtttgagaagcactcacttagactttttagaaaagagttcaaacaaaatcaattacgaaaacaacagcctttccttgaagcctgcattagacacttatttcccctggcttgctgagtactcccgtactcaccctttctctatataaataatcccccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctatgatactctgtctccctgtgataccagcactgtttcctgggactggtatcgattaacaggttaatttggagcgtcacgggctagttccggtcgggactagttcggggcgtgacatctagagaccttgaggctttcatgacaaggcatttcgaaagctgacacaggttcaccatatgccaacgagaggggtcccagaccaacaccaggttaggtcccagaccatactgtgccaggaaacccgggggttctccccggcaccaccccgttgaatccacgtctcttggcatcatgcccccccccgattagctaattactcagacatgggcgtcccattacacccatgtggtcgcacttgtcatatgttcggatgaaattccaaggaaacggtccttaagtgcaagagcgggaaaccgtactcccggtacgtcttctggtccgcgattttggaaattcattttagttcgcaagcaccgacccaggtgtcgggttttccaagtcttttgtaaaaccccaagttttacccatcgttggatgttttaatttgaggggaggtgttccgatgcccgtgcctgaaggcccgtgcatcgaagcacaacagtcgacaaaggagttttaagtattcaataattcacgcagggtaattgcagcaatttaggattggggccggtaggctatctcgcaagccacggccaaattacgtgtgataaacctattcatgcaatatttgcggaaaagaaatacttagatttaaattataggtgcaagatgatcaaaggtgacttgccttgctcgagatcttgagcttgatcctcgaaatcctcgcaccgcgggtcttcgggcaccgaaactacacgtgaaacgggacaactcaacaaacggcgaaaataaagccctattattgacctctaagcgtgccattagatagatctcgagatttgaggattttttgaatttgaacagagtcaaacggacacacggttgagaagatattgaatttataagattattggatttttgtctaaaggaaaaggatttaattaaacccttttggaaaaagaaatgaaagagggagggggaatagacttccctcgggcggctagggcgcggcccgagagaaggggcgcggcctggccgagctaatgggccggccggcccgagaaggcggcccaaaggcacgcgcggggggaggggggagagggagggggaaccggtgggccgggtccacctcgcgtggtcccgagtgggacctgcttgtcggcggctcggctcaccgcgagcggggagcgggcaacgcggcgctagggttcggagggggggcgcggtgcacgcgcgctgctcgcggaggacgcagatgcggcgggcccacgtgcagcctcacggttcgcgatggaccgcgcgcgcgagcggggcagaggggagcggcggaccggggtcagcttgacccggtcgcggctgaggtggcgccgacgtggcgccctcgtggcagccacgcgggccggcgagaggaagacgacgacgccggccggaacggacggcggcggggcgatctacggcgatgcgggtgaaggcgagcacaccgggaggttgcacgggacgaggggagacgagccaacggctcggattcgccggagggagttcgacggcggcggattttggcggcggcaaccggcggcgagaaaagagggtaacggcgacggcgcgatgggagttcgattccttcggactagagcatctacgcggctaccggagtccgttcgtagcgtcggattagacggagacactacgagagaggccggcgacgtgcgggcgctatcgagcatgggcggcgacgacggcgagcacacagcgagcggtggcagcggtcgggacggcgccagctagctacggggaggctatacaagcttctaccgaaagctaaggaggaggggaggaacgaggagggagaacggggaggatgcactaccgtgcggggtgaaggggcgccgtgacgatggtcgatggcgcggggcgtgatcgctccggcctcgggccggggaagaggagggagacggtgcgcccagagtccacgtcacgcgtcctcgctcgtgccggctcctccgacacgcgcgacgacgagcggcggcggcgagcagggcagggcgacaatggcgcggcggcttggagcgaactcgggcgagcgaaggggaaccgaacgagagggggagggcggattttatgggcgcgggatggagcttcgaggggaaggaacggggcatcacgggcgcggtcaaacggcgcagaggacgggctggcgcggcgcggctgcccctctgccatggcgctagctctgagcggagggagagcagaggccgggccaagagaggaaagcgggaaacggagggtggaaagggagctcgagccatgccaactcggggaggagagggatgggagcgggaggcgctgcctcagggttttggacagacgcgagcggcgcggctcgggcacgtgcgctggctcgcggggccgagcgacagcgcggccacaggcgcggcagggcagcggggctgggcggcgcaggcgcggcacgggcggcgcaggcgtggcatgggcggcgaccgcgcgagcgcgcgcgagcgcggcaacggcgcgcggggttgcgaaaacgcggcgaggagcttgccagggatggagcggggagagagagagggggagctcggctcgtcgtcggctcacgcgcacgcgcaggcgcgtgcggcgcacgggcagagcgaggggagagctgagggagagagagagagagagagagttgggccgagagggaatcggcccaccgcacctgagggaggcaaactagacttttgcggggaggtttggattcggaatttgaattcgacgacatatcggggatttgagatcagagattgacacggagactgacaacaggcaaaaaaaaaacagatttcgcaattagggtttttagaatttaattttcccgctaggcgccacgacggaacgggcgctacacgtaatgttcaatagttaaatttttgttttttcttccgtggaatgtgtacagattgaatgttgtactgtagagtgatatatatatgacattgtgatatatgtagttaatttttaaattttttgtagcatttaaattacatgcaagatattactgtagacccgattttcttagaaatcaaaacataattggacattcttcttccgacatgtagaaatatcgtcaagacactctgggtgtgtttagttctttggtgtaaagtttttgaagtatacggacacacatttgaagtattaaacgtagactaataacaaaacaaattacagattccgcctgtaaactgcgagacgaatttattaagcctaattaatccgttattaacaaatgtttactgtagcatcacattatcaaatcatggcgtaattaggctcgaaagattcgtctcgtaatttacatgcaatctgtataattttttttccatatttaatatgacgtttttggccaaaatttttttgggatctaaacaagacggcctcagggtactttgcgctatctctggaacaaaaatcaatggtcaaaggggcaaaatagcatgcatttccacaaaaattcatcattctcctccacaaaattgaaatgtgagggacacaaaatcaggacttgctttttttctttcacggaatatgcaaaaggaaaatccatgacttgctgtctgtcaaccacatgctcatgactgatctagtccatgttcatgaaacaaaccatactagcatggaaaaggttgttgacagacaacaagtactttaattcttcctatttcttctaacctagcttattatctctctctctctcttgcggacattgcaagttttttgtgacacacatcatacatataaaagatacatataaaagggggcgtatattttcacgtacacctcgagagattaattaatattgcaaccaacatattgttctacagttatgcgcctatataactataattaatttaatattgtactggcggctaaagctacgtacctaaccaaggaaacaacagttgacaggtctgcattaattcgcacatgcacggcatgcacaatcacctatacgtacagatgttcacgtatgtgtccggctaacgcaagccaaggcagcagcaatgggcaacatatgcatgaaggccagaaaacaaattaaaaaaccctgtaggcgccaagtgtagcagctgaccgtgtgcttagttagcttgccggtttgatcgcttccaacttgtgaaaattttcttcgatcacccgttccattcctaggagcagaaatggtggtgcaactgacgcatgcaaacgacaaattttatagtgatcgcttcaactgcaactgtataagctacgtacaaattaaaagccgtgtacgttctttctttaatcctccactataaatacgtggcccgagcgcgtcacaaagctatcaatcagatcgagcaagacgaacagaccagacgagagattgcctttttagcaggaaaaggtgaacgatcgatcgatctctctcgcagtcgtctttgttaatttagcagaggacttggtagcataattagctagctaaccgttgcattatattgcatataattagctagctagagctggaatcaatggcgccaaccacgaaccagagcagcgggtcggcgccactgaccgtgaacccggtggtgcagcgcgccgtcgtcggcgcgcagctgccgacgacgtcgccgtgccgcacgcccaagtcgccgccgccgtcgtacgggagcatcgtcaccgtgctgagcatcgacggcggcggcgtccgcggcatcatcccgggcaccatcctcgccagcctcgaggagaagctgcagaagctagacggcgccgacgcgaggatcgccgactacttcgacgtaatcgccgggacgagcaccggcgggctggtgaccgccatgctcaccgcgcccaacgaccagggccgcccgctcttcgccgccaaggacatcaacgacttctacctcaagcactgccccaagatcttccctcccagaaggtgcagattggattatataaaaaattaatcaattaataccagcttaattaattcgtgcatgcattcctatgatcttaacctgcatagatcaacatcttgctgtggatgcagcattccaattgtgggattgttccagagcatggcggggccaaagtacgacggcaagtacctgcactcggtggtgcagtcgctgctcggcgataagcgagttaatgagacgatcaccaacgtcgtcatccccaccttcgacatcaagctcctccagcccatcaccttctcccgattcgacgtaattaaacgtgtccaataacttaaatattaattagtgatatatcaatgtactgacacatgcgatgcatatatatatatcgcatgcaggcccagatcgatgtgtccaagaacgctctcctgtcggacgtgtgcatcagcacctcggcggcgccgacgtacctccccggccaccgcttccagaccaaggacaaggacggcaagccccgggaattcaacctcgtcgacggcggcgtcgccgcgaacaacccggtaactaattaaggcaccatgcatggctgtgttgtacaactctgacatatgagaaattttacgggttttttgagaaaggcaaaatttctagtgtaaatttggtaccggagatatcgaaaattactaaactttacaatagaaaacatgcccatacctatttagggcgtatttggggagcttttagcagctgcatgcagcttctcctagaatctccagttgccaaaagctcccctaaacaggccagctttttacccagattctgtacttgtataatctggaaaatgaactagaagtcagaagccggatttcctagcttctcagattctcaccagctagtttttcagcagctgcttctcagaatcttaaactccccaaataggtgcttaatggcggtaatatatatatagctgtctacatgtctgacatgtatgaattggcacttgcagacgctgttggcgatgacacacgtaagcaagcagatcctgctgggtaaacaggacgacttcttcccgatcaagccggcggactacggcaagttcatgatcctgtcgctgggcaccggcacggccaagatcgaggagaagtacgacgccgttcagtccggcaagtgggggatgatcaactgggtctaccacgacggctcgtcgccgctgatcgacagcttcagccaggccagcgccgacctcgtcgacatccacgcctccgtgctcttccaggcgctgcactgcgagaagagctacctccgcatccaggacgacgagctcaccggcgacacggcgtccgtcgacgtctccacgccggagaacctgaaccggctcgtcgacgttggcaaggcgctgctcaagaagcgggcgtgcaaggtgaacctcgagaccggcaagaacgagcccgacatgagcaggggcaccaacgaggaggagctggagaatttcgccaagatgctgtcggaggaacgcaaggccaggctccagaagaaggccttccttcagtaaacatggatgcacggacatgcatgcatatatgcatgtatcgaatactatttgtgtagcaaattccctccctgaaccaacagcataatcattagtcgtaacccatgcatgcattcgaacaggctatatttctattacatttgtactttaattttgttggaaaagttatactatgtaaactttgtttgtcgtatatctggaataaagtactacataatttaattttattaacagttatacaaatttgaaatttaacaaatacaaaaatggattatatgtataataaatgctaatacttaccagatcagctttagtttttccatatgattaaataattccaaaacttaatttggagttaatacatagagagaaaagttgtgctctgtttggagtctcactataaacatttttcatgatttaataattatgaaattctcggaactagtaagtactgaattggcaaattgtacccttattatggagtctcaactttattttatatttatttaatatttacaaaactcaaaattaatacttcatccatcctaaaatataattgatttgggtgaatataacacattctaatactacgaatatggataaagagtctatccatattttgggacggagggagtattacctcataccttcgtcccaaaatgttgctgcagatgggatcactggtggagaaagcctttttacttccggttggtaaccccctataatcccggttttccaaccgggagtacgaatccaggactaaagatcgctatctttagtcccggttcaaatacccgggactaaaaatagatcttcaccaatcgggactaaagagggtagcggcagtgcagtgtagatgatcctttttttattgtttcttagagttaatccctatattttctcctgaatctagtgccatgtatatccccaaatctccaattcaaagtaacatcccaaatcttaagttccttatacacacaaatcaaatacatcacctattctaa

SEQ ID NO: 38222 - DNA, 5882 bp, Oryza sativa
ccaaccaggattaaagatcctcgcgcccctgacatcctactgacaggaatgaaccgggactaaaaatgatttttagtcctggttggtgttaccaatcgggattaaaaatcataaaatagctgtgggtttttttagtcccggttctttttggaaccggaactattgtgattttgggtcaatctagcaaagatcgtttctctagtagtggatatcttaagttctacgaatcttgacagaggcctatccagatttttagtactggatagcaacattttggatgaaggtagtagatggaataaatatggaccactgttttaatatgataatatttggtccacctagtttgatggctagataaactctcattactattgatgcgaacattttctcaagttgtagtaattattgtaggatgaacaaacattgcctccaccgtttccaacaccaatgttattaattgggacgatggtgccaatttcattgacgtcatctctaggttgcacagtggtagagggacggcgctgttacgtaggattaagttttttcagtgatctttgtaaaatatgttttcaaaaaggacaaaaatataacaaatcttgattgttgcgaccaactggtccaaaactagttggtagcgggtgggcctttaaaagtagggtggcagcgtttcacaggactttagaaaatcattaaaataaaacctgattgtatggaagccgtggcgggccgaacaagcaagtaaagtggcaaataagtgacggatggtggctggtgtgtctttaaaactataaatttgaaaacccaacgatgatgagatttaattttttaaattctaaaataatgagttgactatttagaaaatattagataattcgatataggtggtaagcgtgcaattccgcgggccaccccactagttgggtttaaatttaggtgaaaatgatgtatgaatttcatgtaatgtgatgtgaaatttattaaaacaaatgagtttatttgagtttttcaaataattctatcccttttttttcttacaaatgaacttttttcaggttaagaattgtgtttttctcagtgagttagcaaataaatataagagtaataatacgttcatgacatatataaattaactaacgaaatgggtataaattaaaaagaacatgaaggaaacactattggagaaccccatatctctctcggttcacaaccctctttagtcccgggttgcaaatcgggagagagaatccgggactaaagatgacgatctttagtcccggttggagtcaccaaccgggagaaaaaaaataaaagcaccatgtggctgaccctttctctttcctttttcttttattgtttttagctacttgcatatttattttgcactaaactcaacaacaaaaatcatacacacagacaaaatcatccacaaattgacatcacagattcatcggcaacttcatagaaacatctaaaaatcatccacaaatttacatcacaaatcatcaacaaattcaaaaagcatctaaaaatcacccgcaaatttacatcacaaaatcatccccaaaatcatcacaaagtcatcacctccgccgtccgttgccgcctccaccactgtgccgtcactgcgcggggccgccgcctccctccaccgccgcgcggggcgccgccgtcggccgctcccgcctccctcccccaccgcgcggggcgccgcccccgcgccacgccagaccacctccgccgcttcgctctgtctctgcaaggaaagaggataaggaaagagtggataagaagaaaataagagaggataagagagagaggagaggaagatgggaagaaagactttaagctagaggatttgaggataaattttagggattatatacgaggggttggtattaccaaccaggactaaagatctaaataatctttactctcggttagaattaccaaccggcactaaagtggtaatctttactcccggttggaatcaccaaccgggactaaagattcttagccacctgacagacctttgacatggacgaaccgggactaaagatcaaaaaaaatttaaccgggactaaaaaataatttttagttccggttcctattagaatcgggactgttgtgaaaatcggtcgacccagcaaagatcatgtcacgccccgaactagtcctgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactggggggggattatttatatagagcaagggtgagtacgggagtactcagcaagccatgggaagtaagtgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccacacgatattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggtgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccgttacgttccccggtccgcgattttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacagaacaacagattaagtgcaatcctatcaatgcataatattttgcaagcaatataattagatttcaaatataggctcaagatgttcaaaggtggcttgccttgcttgagatctggagcttgatcctcgaaatcctcgcactgcgggtcttcgggctccgaaactacacgcaaaacgggacaactcaataaacggcgaaaataaagccctattaatgacctctaagcgtgccattagatagatctcgagatttgagaaattttggaatttgaacggagtcaaacggatttacggctggaaagatattgaatttctaagattattggatttttggtctaaaggaaaaggatttaattaaatcctttttttttggaaaagaaaagaaaagaaaaggggagagggagggaatatagacttccctcgggcggctagggcgcggcccgagagaaagggcggctcggccgagcttaacgggccggccggcccaggaaggtggcccagagcggcccaagacgcgcgcgcgcgggagggaggagagagagagccggtggaccgggctcaccatgcgcggtcccgggtgggacccgcttgtcagcggctcagctcaccatgcggagggagtacgcggctcatgcgcgcgggcggaggagggacgcggtgcacgcgcgcggttcgcggtggacgcggatgcagcgggcccacgcgcagcctcacggctcgcggtggaacgcgcgcacggggagggactgaccggggttggctcgacccggtctaggctgagctggcgccgacgtggcgcctacgtggctgccacgcgggccggcaggaggtagacgacgacccggccgcgaatggacggtgggcggcggcggcgagcggcggaacgaaccacggcgatacgggcaaaagctagcacaccgggcggttgttcgtgatgaggggagacgagccatcggctcggattcgccagagggagttcgacggcggcgaatcgcggcggcgacaaccggtggggagggaagagggaaacgccgacgaggtcacgagggaccgattcccggcggtgagagcatctacgcggtttcgggaactcgatgctagcgtcggattggacggagctacgccgagcgaggctggcgacgtgtgggtgctacggagctcgagcggcgacggcggcgagcacacggtgagcgacggcaacggtcggggcggcgccggctaactacggggagtctactcgagctactaccgaaagctagggggaggagatggagcgaggaggaagaacggagggaggcatcaccgagatgaggaggggcgctgtgacgagaggccgacggcgcgggagtaatctctccggcctcgggccggggaagaggaaggagagggtgcggccgaagtccccttccgcgtccttgctcgtgccgactccttcgacacgcgcaacaacgaacggtgacggcgaacagagcacaggggcggcagctatggcgaggaggcgaaaacgagggagattggaggggaaggagctgaggtttaaagggggcggcaatgtcggtttgggaaccgacttagggcggtcaaggcgcgagctggcgctcggcggtcgcggccaaagcggcgacagggaggatgacgccggcggggaaaaaggggaaaaaggagggggagaaaggggcttgcccttttgccgattcgggaaaaaggaggaggggagcgggggcgacgcggcagagggaggaggggcgctgcctccgtcccttggcggcttgcgcgcggagtggcgggggccgggcggtgacgacggcaatgacggcggggcggtttggagcggcgcgacgacacgagcgacaggcgcggcaggcgctgacgacggcggcgaccaggcggtcggccactcggcacgcgcgcgcggctcgcaacaggagggcgcggctcggcacacgcgctggctgcggggccgagcggctgcaggcgcggcagggcagcggggccgggcagcgaccacgcggtgcgggcgaggaccacgcgggcgcacgcgcgaacaacagcgcgcgggggccggctttgcgaggggaggaggcgcttggcgcggtgactcacgcgcacgcgcgcggacagagcggaggaggaggagcgctcggcgcggctcccgcgcacgcgcgcgcggcgcgcgggcggagcggagcggagctgatggagaggggagagggagcgccgccggaaggggagggggcgagagagagcgagagagagggagagagagcgggagcgcgccgggggagaggggaa

SEQ ID NO: 38223 - DNA, 13914 bp, Oryza sativa
ggaaggatttggattcggatttgaactcgacgatagatcggggattgagatcttgagatggcatggacactagacaacaagcaaagaaacaaatttcgcaattagggtttttaagagataattttcccgctatgcgccacgacggaacgggcgctacagatcacttctccagtagtgaaatatgacaaaactcaagggcgtgatggaaatgataggaaattcaaacgcataaaaatttgagcgaaaactgatgagaactaaaggaattttctcaatgacgaactttgaagatgatgaaggcgctattgccgtcaagattgaaccaaactaatcgtatggtctttttccaacaaaaaaatattatatatcttggtacacgtacgcgggcgcgcagcttcaacaagaatctatcatgaacgggtaaacagctgaaaccatatcatcttcctacattatatatcttcctatatatttatttatttttatccagagaccatacaaccatagtgtacggcacgctactatagtacacgctcctacagctgactggggcaacattgtctcgcctgtccagtggaccaaccgggtcacggtctcacgtgccaaagatgaaagaccagctagctagactgcgtccaagatgtactccgacatactcctatagtagtatgatatgtccaacatcgatcatatctctctttgccggtacgcgatcgatcgaacccgtgcatgcacgggtaacctgtgactgtctcgtgtctgggctggtgcgaccaactggttcaaaactccatcgcaccactgactcgtccaaaatgcaatcacctgcacgaacgaacgcacgcgcgatgcttccgatgatcgaagcagccagcaaaggcgagaccgcgagaccttctcatgttggaaacgatggcgtcctcgcgtataaattcatcgcccgtgcactgcagcgaactcacatcgagatcaacgatagagccaagcacaaacacgagctagacgacgctatcagcgaagcagaaacacacacacacacacacaaaatctcccggtgttttgtttagcacagtctagtgtttcccatggcgcccgtgcagacaccggagcagagcaacgggtcactgacgttgaacccggtggtgcagcgcgtgctgagccgcggcaagtcgctgctgtcgccgtccacgccgcggtcgccgccgccgtcgtacgggagcatcgtcaccgtgctgagcatcgacggcggcggcgtgcgcggcatcatcccgggcaccatcctcgcgttcctggaggagaaactgcaggagctggacggccccgaggctcggctcgccaactacttcgacgtgatcgccgggacgagcaccggcgggctggtgaccgccatgctcaccgcgcctaacgacaacggcgacccgctgttcgccgccagggacatcaacgacttctacctcgagcactgccccaggatcttccctcccgtcagcaaggggcctctcggtctgttcaagagcatgacggggcccaagtacgacggccggcacctccactccgtcgtgcagcagctgctcggcgacaagcgcgtcgacagcaccatcaccaacatcgtcgtcccgaccttcgacatcaagctcctccagccaacaatcttctcgacctacaacgtatgtcacgaagatctctatgtatataactctgacaaacttgttgcaattgtacatgtcctaaaattgtttcgtgtctttgcacgcatgtgcaggctcgcaaggacgtgtccaagaacgcgcttctgtcggacgtgtgcatcagcacgtcggcggcgccgacgtacctccccggccaccgcttcgagacgacggacaaggacggcaagccccgggaatttaacctcgtcgacggcggcttcgccgcgaacaatccggtgagtagccgtgcttgtggaatacacaatccagtcgtccagacttggtggactactactgaatttaattaatacagtacctatcaaattaagaaaacagaaatcgtcataccaagttagctttgtgaaacttgtcaacctaaacttccttaaatatggcacagaaatgacttgtgttgctctcatgtacactttgcgacgtttgacactggaccaacacgtgcagacgctgctggcgatgacacatcgacacacgtttaaattcaaatataaaatatatcactccacaaacatgtaattttaaattcaacttttataagttgtaacaaaaataacaaatatagttacgaatgtccgataactattttcagtttaatttgttatttttgttgcaacttgtagaaattaaatttggtcttgcatgtttgtggagtgatatatttcatattaatctatgttgacaaatttttttttatttttttataactatttagataacattcaaataacgagagaatgtccctcgagggatgaaaatccacatccctactgaatttaattacttgtcaaattaagaaaaacagaaatcgtcgggtctattcactttgatgccattttcaaccataccattttttgagtaaagttgacaaaaaaatattcacgtttagtttgttgtcaaatttggtaaatacataagaaatcctgccaaaattttggcaatattgtcattttgccaaaattttagcataccaaaatttgctaaggtttattttagctacaatctgaacagccccgtcatatcaaattagcttgtgaaacttgtcgacctaaacttccttaaatatggcacggaaatgacttgtgttgctctcatgtacactgtgcgatgtttgacacctgaccaacaacacatgcagacgctgctggcgatgacacacgtaaccaagcagatcctgctgggctgccaggacttcttcccgatcaagccggcggactacggcaagttcatgatcctgtcgctgggcaccggctcggccaagatcgagaagaagttcgacgccgtcgagagcggccggtggggcgtcctcggctggctgttcaacaagggcgcgacgccgctgatcgacagcttcagccaggccagcgccgacctcgtcgacatccacgcatccgtgctcttccaggcgctgcactgcgagaagcgctacctccgcatccaggacgacgagctcaccggcgacgcggcgtccgtcgacgtctccacgccggagaacctccagaggctcgtcggcgtcggcaaggcgctgctcaagaagcaggcgtgcaaggtcgacctcgagaccggcaagaacgagccggacatgaaccggaaaagtaacgaggaggagctggtgcttttcgccgagatgctgtcgcgagaacggaaggccaggcttcagaaaaagcaggggagcatgaagatctagtacatattggcaaattgtagcagatcttcggatcaatactacaggtctacaactactattggtgtcaagtgattggatgtaaaatttatccgttcatattggatgtttgttgtatcttcgtaaattcatgtacatctatgtaaggaaatgattctaaactctcgagaagatatctatgtgagtagtaatgaaaaaaagctttttactatcaaagtcaagtgaaggaaagagaataccatgttcagatgccccaaacggcatattttggaccatattttgcaattttcatacagtttgaccacatgacgatagaagagaaatagcaattgaaaaccgtacagacacattgttgtagtggatttatgaattatgaccctttcggcccatatgcaggtatctctactaaggaataagttcatttgaggtcccttaacttgacagcgagttcgattttcgtccctaaaccgcaataccagatacaacaggtccctcaactatcaaaaccagttcagacgagatccctcggtggtttagatgatggttttggctgacatgacgcctctgtggatccttttgactaggtctttgtcccacgtggctcttacgtggcaatgctatccggaaatataataaaacctgtggggcccacatgtcagtcacacacaaaataacatgtcatccctcttctctctatcctctctctctcacctaggcggcacagggcggccggagtagatgacggccgaggcggggcgtgtagccgtggtccctgcagccgctgggaagggatccgccggtgagcgcggcgctgcctggcacggttacgtccacagccttgatgcggctaaggtcatcgtcactgatggcgtcgacttgccggcatcatacgactaaatggactacgcaccgacattgtggttttgcctgctgacggccgcgactttgcacgccgccactgctatctcgtcatcgctgctaagaaaccgccgctttcttccatcccaagccactgtcgtcatgtcctcattggcaacttccaccgcaaccgccactcgccgctacggaccgccgcggccccctcctcgccggccatcccactggaacgcgacggtgcctgccgtcttctcggttccccaacggctgccgccgcgaggtcattgaggtaggaggctaaagaggatggcgccgctcttggccctactgaccgccacaacatcgccgtccctggccccgtcgcgcgcgagaagcgaaggggcgagcgccgccctggccggagaagcggagggccgagcgccgccctagccccgccgtccgccgctgacatgagggagagaggaggcgctgactcgccgtggagatagagaagagtcccactgttttttccgactggtatgtggtcccacattcttttaaaatcttttaaattttaaaattttgctttcagtgccacgtcactgccatgtaggaaagcgccacgtcagccaaaaccgacatctaaactaccgagggatctcatctgaacggttttgatagttgagggacctgtagtatttggtattgcggttcaagaacgaaaatcaaactcgctgtcaagttaagggaccttaaattaacttattccctctactaatagcaagcccaccgttctctcttatagggctctgaattgtgttttgattctatacagatggatagactgttgcacaacgattgatcggtactgcagtctgaaagcatgcaagcaggaagccgcagagacgaccgcaggcgacggcagtcacggcatagaaccgattgatatcaggtgcagtcatccctagacctgcactaatctcatctccgtccatttctttacgaagagttcagatttacagctacttaactcctacatagtaaaactaaatatttttctctagataacagtgtttagatgatcctatctcttaaagtcagatcaaatagcgacagtatgacagcttaagttacagtcacaccaccaaccgcaacggaaccggatccgcataaaaccagccatatcaaggaagcaaaccatgactgatcgtcagattgttaactaattaaagacgctgttaaatatgtgatctgaattttgggcccacaatatattcggattagttatctaataggactctactttataggattagtatcctattagaactcctagatttctcatatatatcccttataagccgcacggagagggcgcgacagcccaagtatcccctgcgtttgtatccaattcctctatagtaatcattgccggtcagcgctcatggttttttcccgcaagagtttttcacataaaaatttgtgtctccattgtgcatctatttttataacaagtggtaccagagcattggagatcgatctactaacatctcggctgccgacgagttcgtctgcttggagatcccatctgcaagttttagccgccggtacgctgccggtacgctcgtcgcaagatttgatcggcagtagcaggcgtgtgtcgtcgcgttgttctatctatcactgctgtcagattgatttgtttgccgagataagattaaccggtacgaagcggagtcagccgttgactccgatcaggatttggtgccgccgtgcagcgtgttggagaaaaagcagcaatccatctactccagcacgttgatcaaggaaagaaaaatcagcagatgcactcagccttgttattgttcatgtgaattgaatttcacgttggttttgtgctacgtgcacatgccccttcgtaccagggattcaattcaattgcggtgcttcggttctgtttgggtgaatcagattcaggttcaattttgtgctatattcacaagccagtctaccaggaggttctgcacggagatcaacttcgttttatgcacctagagtgtttcgcgtttctgttagggtttgacaaattataccagcagattcaggattttattcccaaggcgagttagaagtttgatctaccgctcctggattgagatgcaatctcgttatggcaagtgaagatgcaagttggcgcatgtttcaaggaggataagtcgtgcacctgagattaaaaaaaagtacattcaagtcgtcaagagggagcctcgctcctgtctagattacaaggtgatcaaattgtccggcgaattttgctaccattatacccaacataccaggaggttatcaggggatctaagtacttcattttgtgcacaagaaattttcgcgtttctgtttgaattctagaaattaatgccagcagatttaggattttattcccatggcgagattgaagtttgtgcatcagttttgcgtatctgctgggttccacaatgttataccagcagattcaggaattgttcccaatggcgagtttgaagtatggtctacctcttctggattaagggtgttatggattatagtccaagtgattatttggcgcacattgattttatcatcatgaggttgttcagaggttgaagatttttatgctacaagggaaattcgtctcaaggtggagattgttaaatatgtgatccgaattttgggcccacaatatattcggattagttatctaataggactctactttataggattagtttcctattaggactcctagatttctcctatatatatcccttgtaagccgcacggggagggtgcgacagcccaatgtatcccctgctatccaattcctctatagtgattattgccggtcggcgctcgtggtttttttccgcaagggttttccacgtaaaaattcgtgtctccgttgtgcatctattttcataacagacgcatcagtagatatgtcctgttagaaaaagttcagttagcgaattatctgatgttaactccgatctgatcaatcggactatcattgtgctggcccatgtggcatggtgacctggctgcaaggaccatatatgtggatggatcaatggaacagcccccactatgcacctaattaaggtgaaatgatttatctcctggaacctaatctgggccagatgaactgtatcgaacatattgccggattctcctttgatgttgatatcgtgcatcttgtggtctctcggtggccatcaagtacctagttatgcatgctgtgctagccattaaatggatattaacagtctctaatacaagtgtatatattatcatattgtcctttctaatcatacgtttgtaataagcactaaaaatataactaaaagaatgtttatttacaagtatgctaataccatttttatatatcatctttaaacaattatatattggtgatcttatatttcgaggttaatttgactaaatgcatgcttccaaaaaggatgtctatttctaaaaaaaaaatatatgtctctgtttgtgaacggtggcaataatcgaagtattcaagtatatacttaataacaattggtctcttgtgaattactgatttttattttttctctaagattagcgttccagagagcctcctctctctctctctctctctctccggcttaattaggaggtccatagaattgtggataaggtctcatgtcatagggtaggatggctggatggggtttggctatggaaggaggttattctctcagcaacagattgaaatatgtatactcagtcataaagcgtattatttagacacctcttcgtaacttatgtatgctagaaaatggacaggagcgagctaattttcagtctggcgatattgttatttgctagcattttgggacataatatataatgttgtaggattttaaagaattagtttaatcatatagtatgttgaaaccaagtgagtatcaggcatggccaaaaacttctaatgtcattgatgtaaaaaatctaagtcctgaattgactagacgcatagcaatattttacaactatttatttatttggtggagactcattcatagcggtgaaaatacaaattaaattgtaggagccgctcaacttatttcttctattttagggtggtatgagagtttcgaatttcaagaagcctcatgccttttatttcttttaccgatatgaaggtgattttttttcatgtggtttatctttcttgtctctgaatcttttcttgtactagatatttcggatatactatcatataagcatattcacttggatgaggattttcatccctatagtggatatcccctcgttgtttgtatgtcatctaaatagttatcaaaaaatttaaaaacaattaacaacatagattaatacaaaaatatatcactccacaaacatgcaagaccaaattcaacttctacaagttttagcaaaaataacaaattaaactgaaaatagttatcgcacattcacaactatatttattatttttgtaacaacttgtagaagttgaatttaaacttgcatgtttgtagagtgatatatttcatattaatctatgttgccaaattttttttatattttttataactttttaggtattatacacgaaacgaggggatgaattcgggcatgtttggataggtgccgcagtttaccgcgcctcaagttcggcgtgccacaggtagttagcatatgtttgtttgcttaccacatattagcctgccacaagaaattaggtgctcatgaactactttgccacaagtttcttagcctaagttgtggctctcaaattgttcgccaaacttgtggcacgagctagcttgtggcttggcaagttggagtagtcttcaaaacaagcccgaaatcactttccccactttacaccgaggatgctatatatccggctggtcagccagcacacatgaacgggcagctgacgagctagctagccagcgacgtgcagtacttacgtccaacccatgagcgcagtaggtgccgatttaaacactgtagttagtcactatcgccttttcctataaccacttttctctaccgatttagcagaacatatatattgtggcagagccagaacgccatgggagccgtattatttaggcagcgagaccatctaccagcaccctgctatttgcctacatgtcagacttcccaaccagcactcagatgcgacactgaggaggattgaggagaaatatacagtttttttttaaaaaaaaaacagctacatcaattcgagccaatcttcaaataaaccaccaaaagaaaataaaaaatataacaaatagaagacaaattcacagatagctaaacaaatattcatcgacaagttcacaccatagaatcaaacattcattaaaagttcacatcacagaatttcaaaactagataaaaaaaatacaccaattaattatagtggagaacttcccccgctgctgttgctcactgggaaagtgtcgtcgcttgccgccatcgagcaagccacctctgagccaggagggacgaggttgccgcaagctgccacacgtcgccggaaaaggagggggaagaacaaggcttcaaatgggaaagatctctccacacatgggaaaaggagaggctgctactgccaccgcacaaggagaagggaaggccgtggggaggcgtcgccgaggagaggcaaggtggatgccgcctcctcccgctcgccctgtcacttaggggaggcactgttgaaaggaggtgccgccgaggggagatgaggtgtatgccgccttctcccgtttgctccgctaccaccaaatgtggggatgtggggagagattgagcaggacagagaggacgagccagtgaggaagattgtgtgagagaaaggagcccaggaggataagataaaggagtggtcaagggagagccggactttggcttggaacgataatgtgccgatatggttttcttatttgtgccggtctttctatataataaaccggcatgtaatagtactagtactggttttttaataattggcatactagtactgggtttttaataaaagggtccggtatttattaggtgttatatgtgttggtttttaattttgaaccatctaaaggtttagaaggatgagaaaaacctttgtaccagatttagatgaactaataggtattctctattagaagttttatagtagcagagtcttgtactatgtttatttattttagaacagatagtgagtatatatatggtttggacggattcggtcgtctaggtgcagtagctagtgtgactgcaagttaggcagccacacaagcaccactggattcaaaatggaagatctagatgcatcagaatattgtagcaaagtactatagcgatttactgaaaaataatatattttcgaattcactgtagcaagcgatttggatcattgaatctagaaatagagggctcaaattgtgttgagttgctattgtgcagttgcaatagtaactgtactggatctcaatccagtttggacatgccgtccttgagctggtcctccaattaggttagctaaacatcaacaaagacgtgtgctcagtacgtgctcatcattggcatagcgatttgacggatgcatgggccaggcaacaagaagttggtgcacatttttttttgagacagagggcggagaccctcccatttcattaacgaaatgataagattcttacaaaaggttcagagcaagtaaaaagactaaacatcacacaagcccatggggcctgacccaaaacatgacagccatgttaactacggcagctcaaagatgaaaaaaaaccgaagacattcagcaacacagccagcattcaacaccccaaacgcctgacttatggattccatccatgacttgcattgtagagatcaccggctaccctccttagcagagctgcccccatttgcagatttcctcgcacgtcctccgatatctgcagaatagaccaagattcgatccaagaacacatagaatgtatcagttccacaggatcatacagtttttttaaaaaaacatgcagcatttctagccttccaaagagcccaaatgagagctgccacccccaccacgatcaaacccttatctcctttattgaagccccaaagccatccaccaaaaagatgatggatattatttgctattttcaggttaaaaacactaccaaccactctccaaagaaatctagcaacaggaaaattgagaaacaagtgttctattgtctcctgcccagagcaaaattgacaatttgaatccttccctttccaacctcttttaagcaaattgtctttggtcaaaatactgttcttcagaaccagccaaagaaaaacttttactcttggagggattttaaatttccaaatctttttaaaggggaagccactaccttgaatcattaaagccttatagaaagacttcacagaaaaaactcttgacttattcagtttccaagataaggtatctttaacatttgacaacttaacatttttgcacaaaaaattcaagctaatccactcctccaatttcttatcagtcaaggttcttctaaacctcaagttgtccaaaccttcactcaaaaccttagcaaccaggaccatcttattcagactgatgttatataacaatgggaattgatctgctaaaggacgccctccaatccaactatcttccaaaaaaagagtatttttcccatcccccacttttttctcacaaaactgataaaaagcgtctttgacccccataacccctttccaaaactgagaatctccaggtttgctcttcctttgcactaatgttttttgtgacagatactttgcccttaacacatcttgccaaatcccctgctcagtttctaatctccacagccatttccccaacaaagccatattcattttccttagatccaaaacccccagaccaccctgatctttaggcaaacaaacagtaggccaattgaccaaatgatatttttttacaccttgatcatcctgccagagaaacctggctctgaaaaaatctagtcttttttgtactccttttggtaactcataaaaggataacatataaagaggcacactactcagactagcattgatcaaggtgagtctacctccaatagccaactacttaccctaccaacagcttaacttcccctctaatttgttttccactggtttccaatctatattatgaatcctttttttatcaataggaactcctaaatatctcatgggcaaatctcccattttacaagtcaaaatttgactataaatttctttcttctctgcagcctccccaagacggtaaacttcactcttatgaaagttcaccttaagcccagacatttgttcaaaaagacacaaaatatatttcagatttttagcatattccacattgtcttttaataagaaaatagtgtcatcagcatattgtaaaatagcaaccccctcctctagaaactcctgacccaaacacctcaccagcccctgatctactgctctatgcatcaacaaaggcaatgcatctgcagcaatatcaaacagtaagggagataacggatccccttgtctcagtcctttgtaagtctgaaaaaaaccccctatttcatcattaaccttaacagccactttaccaccaattacacatctcatcacccaatcacaccaagattcaggaaaacctttcgctctcatcatctggtacacaaagggccatttaactttatcgtaagctttttcgaaatcaactttaaagagcaacccagcatgtttcttttgatgcattgtattaagaatttcatgcataaccactacccctccatgatataccttcctttgataaaaccagtttgtgatttctcaatcaaaagtcctattactttagacaatctcttcatcaaaactctggttattatcttaaagcttacattcaataacaaatcggtctaaatttctctatctgcaaagcatctttacattttggtataagagtaataaccccataattcaacctcctcacttccaaaagccctctatgaaaatcatatagaagatccttcaagtccatcttaataatttcccaaaaagccttataaaagtccacagaaaagccatctggcccaggagctttattgttttccatttcaaaaacaacttctttcagttcttccatagaaaaaggtctcatcaaatcgtccttttgttgttcactcaattgactcatctccaagttatgtaatctaacttctgtttcttcaggtggcccaaacaagtttttataaaaatttgctatgaatttaaccaactcttgttgccctgcaatcacttccccatctttgtttaaagagtaaattctctcttttctctttctcccattagcttttgcatgatagtactttttattattatcccattctaaaatgtctttctcttaactcctttgaaaccattttaacttttcttctctcattgtaaatttcagttgttcttccaaacaccttttctcttcccttaagacatcatccataccatttgtttcactcagaatgtctatctcattcaatctctgtacaatcttccatttctccctcttataagtcccctcccaattcatat

SEQ ID NO: 38224 - DNA, 38045 bp, Oryza sativa
  unsure (1)..(38045): unsure at all n locations
aacccacacagtatgcagcttacccacagcctcagcttcatgggaccatctctttacactaatctgaacacctgtgcctttcagtccaaacgaaacaaaattcgacagctcctccaatttctcttcatttgggaatctcatctaaaaagcaccattagacaaaggttttgctctccattcccaaacccacttaaactgttgtgcaaaacctttcttccaactgctttccagccaactttccttcatccaaaactgttatgattgctttgggattcacatgttcttttcccatagtacttttagcattctgtttgaggacacatcccaacccaccagctgcatatcccaccatctttgccactggctttggttgttgtgccacaaagcattcatcagtattatgagaaaccttagagcaaatcacacagtattttctcactacacaatctttagctatatgacccatagatctacatttcccacaccatttcctgatttgggcacccttatcaaccccatctttcaccacaccttttgtatccccttctgtctttgactcctcacttttcttttccttgtttaacatagcctccacattagagctctccctcttctgctgcacaattaacccagcttcacctttaacctcaacctgctctatcttagaccctaaattcttctctttctcctctactacagacacaacttcacctatcttctgttgattcaacttatcctgagtaggtgggtttgtagatgtaggagattgagatgaattatgttccagaccttgccatacctgattttccctaagagctccacccaaaggccttgattgttgaggacgaaaacccctatgctnnnnnnnnnnnnnnnnnnnnnnnnnnncttgaggcctcggttggaactatggccttgcttggaatccctgcgacctcgcttggaatccttgtggccttggctaaaacccctgaggacgatacagccatggttgtggatctctccgtctccaagcatcccccttatccgccattgttgatgattcagcactcaccacctgtgcaaaactcctcgaatctccgtgaatcgtcttcccccactctcgatttcggcccccgattccttcacgcggccattgaactctctccccttccacttcctttacctctctccaccctcctccaaaccctaactttatccccttctcctcacacctcaaatgcgataccaaagttggtgcacataacctcaagccagcttccagtcggatctttggacccatgctgacgccgacccagatcgatgctctactatcattatgtatgcaccatgttgtacttgaacgtaattcaggatacggattttcatccctgcttatatatcatttaaatagttattaaaaaaataaaaattgataacatatctctctatctccactattataaaaattgaagatgtttttctggtactttggtatgtcatccgtgtatgtgtcggtttttaagttcgtttgcttttgcaaatacaaaaggaatcgtataagaaatctttttaaaaaactcgtatactaacttgagacgatcagactcctaattacaactcatgattttctaacaaaatatatatgcaagcgaatttaacacagtgaattaaatagttttaataagattaaaactattttaatcttattattgttagtttgttatttcatcttaactaaaccatataacaaactaacaataataagattaaaatagttttcacccgttgcaacgcacgggcattttttctagttaatataaaatatatcactctataaacatgcaagacaaaatttaacttctacaagttataaaaaataaattaaattaaaaatagttatcatgcatttataattatttttgttacaacttgtaaaagttgaattttaacttacatattatggggttatatataaaataaattaacctatcttgtcaaaaaattatattttttatgattatttatatggcatgaatgaaatgagaggatatcccatcaagggatgaaaacactattaccgtaattcatactggtatgtataaactaaactaaccatgcagtgagattctacttgttattggtaatgcatccagaaaaaatagcaggggtctaaacgaattagataaagttagagcccctcctgccatctacatatggtaaaaatatttagttggggtcgtgggaggtttccatgattgtcatgtcaatagtgaaggtttgagccaccatcatccccatggtaaatccacccgtgcttgctatatatgtttgcttatcatgcgtactgctggggagatacatcttacttatccatgtgcaacgtttaaactatatatatcttcatatctaacatgatgatataagtatataatttgtgatcaagttgatgaggaacaaagtactgcggaactacgacctttgtgtcaacatctgcccccacatgcttgtcgatcatagacctaaagataaaattattatggtacgtacgtgtcccatcacgatattatggcatgcattgtactgtaaaaacaactgccgtaccaactatttgcatgtattttcaaaaaaaaaaagatatgtgtcatctaagtgtaaaaacaatctctagagtgatactctctccgtcctaaaatataagtatttttaacatagtgaaaagtcaaacatttgtaactttaactattaataaaaaaataaaaaagatcaatcatgtaaaattgatgttattagatttatcattaaacaaactatcataatatataactctttttatttaaaacatcttatttttataaatattattagttaaaatagtatcccggaggccatgtccgagtctcaaaatgtttatattttaggatggaggaagggagtacaagatgcatgtagcgaatgatcattgcaatgaggggcgaggtgattaattgggacgattgtctgatcatcacaattacacaagcatactattaatatatagctcgatcatataatgtgtgtacttgtgtgtgtatatatatagttgtattcacaagagaacagtataaatactatgtaaaatactcgtttcctcgctcacttcttcctcactaggaaaatgctcagctccggggcgcactcgcggtcgcggccggcggcgccgccgttgtcgctgccgtcgtcggggttgatcatgtagaacgcctcggagtccttggacccgacgacgcgctcgacgcgggcgcgcatgtaggtgagctcgccgtcggggcccgcgccccccctgcggtcggcgggcggcggcgggagcaccccggcgcccatggacacgccgcgcagcaggcgcaggacgtggcggtcgtcgtccgacgcgtccttccgccggatggcgtacccggccttgcggccgttgcagaacacggcccagacgtactcctccagcagccgccgccgcgcgctgcgggtgtcgctctccagcgccagcttcacggtgcccgtggccatctccctgtgcatcgcgctcgccagcatgggcagctcgatgaggaacgccggcggcgcgcgcgtgtcctcgtggatggctaggctcagccgcccgcgccggtgcccgaacagcgtcaccgtcggcgcgtggtcggcgaggaggggcgccgccctgccgccgctgtgccgccccagcagcgcggccatcttgcatcccgtggtgagcatcggcagcagcttgaacatcttgaagatgccgcccacgccgccggcgccgccgccgcccccaccgccggacagcttcgtcgtccggcggccatcggaggacggccggaggagtgaccgcagtgaggccgcgccatcgatgagcgatggcattggcgacaccgatcgatggtgaggtggagtttggtgtgccgtctgaattgacgcgcggctagcagctggctggctgcagagctttgctccgatggagccccatggggaagaaagctgaggagatcacgtcgctatttaaggaggatgcgtggaagaagatgttgggaggtcatatgcatttgctaataatgttgtctatgttggattaaaccatcaaatgctttattaggcgtcagttgcacgattatcttttttaagatgtacacacacaatcattagaagatcgatatcgctatatgagctaaaaattggcaaaagaaaactggattaaggtgagctaaaataacaggttaaaactaagggcctattgggcaaatcatatccagatttttcatcatgtgaagctggagccgaataaaacgctactagatatatatctctttttttttagggcggagcaagtgaatctgcttcaaagaaatgcatagaaatagtgatgctgtctttttcctagctcacaagtccctagctcttgattagctctcactgcactgttggtaagactttatgtgtctggcataatgtttagaacttcagctgtgcagttcagaaatgtcactgcagagggcaacagtgacctgaattaggggcattcccctgccgttcgatgataatcaatgtcttagatcatacgacacagtaactaactactacattgatcaacagtattttgggagtacaatgatcagcagtatttttaggagtactcctacagtggatctatactgttcctggcatttttcactgttctcctcgcatgagcagtaactgtcgtctacattactgcagacaatcaggatccagacaagctcaggcccagccattgagtttagaaatgcatgatcaatgcttactagtcatattatattatcatatatcaatccatgcaggcttctttgattgattaaactttatgaacgcactagataagtcaggtcaggactcaggacgtgcagaaacttaatttgtggcttttgcctttttgcagagattaattgatcgatatggatctgcgagtttttgcacaaagagtcatgggaggccttaactcggcgacatgtacacacaccacggaagtaattgttggggagcagctgactcacttgccatccgtgctgcattgcacacagcacatgcggtgtttggtcgcgcgcgcatgcaaggaagccactgcatggcaactgtcctctgattgtgttgctttgctataaactattttgaaaatgtttataatacttcaaaatctgtaaaagatttaggtgaacttcgacatgggatttttttttggtacttttgaaaatgaaagcatggatatatgtgcgaaaatcctaactcataggcacgctatgaatgcatcgtgataagctatgggttaggtctacggtcaaggtttagggttgggttacagagaaggctgctctggaaagagataagcaaggattcttgtgcttagagggatggtggggaggcggcagataagcgcaggagccacggggtcggcaccagatggtgggttagtgttagtggtgggagcaaagtgaaccgaacagttaggaggcaggggtgtctctagtggcggagagccatcaaagatgagaaagatagcaggacgggggcacataatgctgcggcggcttagggagatggattgatggtggaggtgtggtcgggtgagaaggctaggagttggtgctagcttggatttggaattcgtcagagagagagagagcgcgtgagggagttcgctagagaaaggtggagggagagcttgctagtgggagaccacttgcctacactcgacctacccgatgagaaagaggaaccgtctatgcacttgattgttctggtcgacaagggaagataagaggaggaaagggaagaagagaaagtgggctaggctagcaacgatgcatgtaggtttgtcatcttgcagaattttttagttttaattttttttattaagcgaaaggggttgtagcctagtagtaaagtactcaagtagtacttgtatgtcctaggttcgacttcctaagaaaacgaatttaagatttgaatatttcaaatagagcaagctccattcgtcctaagagggaaataaagggacgagcctaccatttttcgagtggtgctctaggtggaacgatttaaatacagatagccccattcgtcctgagagggagacagagggacgagcctaccttttttgagtggcgctctaggtggagcaaaaatcgttctataggagaatagtaagggtggcgcttgcaaaagtgacaggcctaaacggatggtcgttaacgtgagctatcaacaatctatcacgtcacactatgaacaatctgccacgtcacacaaaacaccctctgggaggacggggcgtgaggggttatgagtatatttgtatttttttttccaaaccgaaatttttttaaaaaaaattataatattttttatgggaaaacattttaggctctgtttgttccccatggttcccaactccccaccttgtttcccacgcgcacgcttttcaaactactaaacgatatgtttttgcaaaaagtttctatacgaaagttgcttaaaaatcatattaatctatttttttaaaaaatagctaatatttaattaatcacgcgttaatgcgaacatcgttttacgtgccggggaggagggatcccaacccctcccgaacagagccttaatattcatcttgtattcgctggttgatgggccgaacaaacttgtgcgtaacctgaccgtatccaattttggccggcccatcgtgtccgctatcttctaacaggccggcctctccccgccgcctccgccgcctccgctcctccttggcatgcccacgtgcctgcctcctccgccgcgcgccgccatcgccgccgtcctcacctcgctactaccaccgccaccgggcgcctccgcgtccctcgctcccgccggccccgccgccgccgtcgcccggcagatccgccggaacgacgggcaccacccgggggcagcggtagggatgtcgtccgcgtccgtggcggagagggagagggagagcgaggctggggagttcaccgaggtcgtggtggtgcggcacggggagaccgcctggaacgcctcgcgcatcatccaggttccgtgctctgttcctcccgccccgagccccatctatttctctgaagctttggtcttcaactttggggaaaagctttggttgggaaaattgggaagaataaatgatagtttggtggtacacttgtttctagttctttgatcattcagtgctcagactttacaatgctccggtgtaccttagacaatgctccggagtaatacagactagttggctttactatctaatctaagccaaaatagtttgacaaagaacgtgtcttgataaggacgatatatcgtatacaagggctcacaagtcggacaaaatggatgttttctcaagtgatgccatgcagaatttgatgaaagtatgttggtatttagaaagttcttttaatttgctgaacggattttgattgattgattgcacccgttacataagaggtcttgtttttcttttgttttcagcatgaaacccttaatgtggtactcccctaattaaattgttccagtgactgtttattcactcccctaatcttaatggattgatatgattttctcgtataataaagtttataaagttgaagtgaaaaatgttaaatgttaaagtaatgcaattcccttattccttttatagaaatttacagtttgcaatatgtgcttcatcacatggtctgaactcgtagttgtttactaaagtactaggaaaattccctcgtacatctgctgttgtaaggaacagtttctataacagaagttatgcaatgcaaaaacttaagagatgataggcagtaaggttttatggctgtcgataaacttatgctatgactcgccatagtggattgtcagatagctatggttacacattacctgactatatctgatgtgtaatatggaaacaaagtatggtaaaggcatttcatgatatgattaccaacattaccttgtctttgcgcattaactaaccatgtcttattcataagtttattttatcacacttatagtttcttactgcctttcaactgatatagaaccaaaatcctgtattaggggcacctggatgtagaactgaatgagattggaagacaacaagctgttgcggtatggtatgacatatttcagattgccgtaagacatttggagtggtgtgtcttatgtggaacttgttgactttaatgcaaggttgcacggcgtctttctaatgaagccaagccagctgcgatatattcatctgatctgaagcgagcggcagagactgcagaaataatagcaaaagcttgcagtttgccaaatgtttgtccattcaactcatgcacttttctattttttaaatatctcaggctgactatctacgctgcttcagttacgcataatgtattgtttgtagaagactagaagatcaattggtcattgattactaatgtagaaactgtctgcatcataggttgtgtttgatccagcactgagagagagacacatcggagatctgcagggcttaaagtatgaagatgctggcaaagaaaagccagaggcttacagagcatttttgtcgcacaagaggaaccgacaaattcctgtaagcactccattgtcttactttttataacacatcagtattgattcagcaaacagattatgcttctgataccatacatagggtttagggttcaccggggaaggagcagtgggggatctatgggggctagacgactggagggaaactagggttgggtagctaatgggaggggatcgtggatgaagggcgacagtggcgatggcgggggttgctggtggtgagggtgggtgtcggggcttagtgagctagccatccacaactgaacatccctagcttggtggaacatatcggaaagaccatgacgaccatgtatgggaagaccatacataggtggtatgtttgtcaattgctggatgtttgcaagcagattctcaatgataccacgcccatttgatgccattgagtcaaccgttgcataggttttgaaaaaaggtcatacaaccctgaacccttgcgcaagtcgaaatatcaaccttgaaccacaaagctggacacattacaacctaaaaactcttgaaacattcccctagacctaaactactattgttttgcttacctgtcatctacatgttgctagctttgccacctcatttgacgtgccatcaactgtatcacattagctagttaagactatgctaactgggttgcgatgccaaaatgaaaacttgtgatgttactgctaatgtggaggaaaccaccagtaaatcaggctaagggtttaatgaaaatggttttatgagtttcaggatttaaatgttcggttttatagtttagggctgcagttttgcaagagatcaagtttaggcgtgtcaaacatggatgatcttcaactacaaatatgtgcttaagtttaatttttcaccttattgaaatgacaaaagctctctatcaaatcaaatctcctgtagtacacttacctgtaacatttggcatagaggcttctcaagttagctttataactgccatatttannnnnnnnnnnnnnnnnnnncacttcttttgctgctaccatatgccttcttgcagtagcttctcttacaagaattttgggcttgtttttcagggtggtggagaaagtcttgatcaactatcagagcgatgtgtctcttgcttgtacaacatagtcgagaaacatcaaggtaaactgtgagcttcatccttggagttttatcttataattggattgtctgagagtttttacattacgctatgatgaaatgaaatgctttaatcagtctatcaaaaggaataccacttaagtagttggcttattggcatccttaattgactcgtgctgtttcgtgcttcgtgttgatattaggtggagatactacatcagtgtttacacaacataattaatttccataacataactctgtaattgcaactgcattttattgaaacctgcatgtgagcttctgatcatttctgagcttgtgtaactctatcaacaggggagcgaataatcttggtctcgcacggtggaaccatcagagaactctacaggcatgccagtccaatgaagcctcttcacggtaagatacacaacacatccgtaagcgtaatccttgtgtctggtgccactgggcgttgcattgtcaaggcgtgcggggacatcagccaccttaaggaaaccggtgttctggaaaacgcctttggtggcgataagaactctgcataaacccagcttcagtagcgtcgtacatgtaacactattcacatgtccaaagagtaccactctattgtcggcatctctttgctgtgatgaaacagctctattagcaataaccagatctctctgaattttgacatcatacgacccttttgaattttgatggcctcgattacagaggccagtgtatcttccttgcaacttgcaacttagcagagtagtgttttcgcattggaatggaatgagatgcacttgatagtgcagtggtaaggggtgcgtggttttaaccctgagatctcatgttcaatcactaacatgctcacaattttttcttcaacaatgtttgaagggacgtctctctccaattctcgttttctttttcattggaatagaaactgagtagacgtccacatttgctgggacaccgtcacaccgaaatcatttcaatcagatgaaacagccggtggatcggcctatctcttctcacatgaaaggccacttgatcccctccctgtactggctaaccacttgacacaactgcggccccgggctgtctgggccagtgccatttgccatgctttcccacaaaagagcgtctcgaattctcgattgctatgcgctacctaattaattctcaaggggccatcccatcactgttcatgcaatcaagtgcaggtaaccatgcataaaacgagacacactatacatttatagaaaaccgtacagaaaaccacataaaacgagacataatactactatacatttatagaaaaccgtacagaaaaatcacatgaatttttgcaggtcgccgtcgtcggcaacttccccgtgcaccggctgctggatgctgccgatggacggcggacggatgatgcatcaaccacacactaaaaattaggcgcgcgaagcgccaagcggcgcgcgcacgcagcgcgaaaaaaagaagacatgcgacgcggaacggggacacgatgcccggtccgcagccgcgcacacgcacaccacaccacacgatgacacgatcaatgaattttctttttttcttctttccttccttggcaacagtagagattccgccgccggagctacagtgcatgcctctccacctccccgatcggccggccgactacatgagcgacggcgaccggatgtccatctcctgcgtccacgcgctcctgtcctgcgcgtggacgtgccagtagctctgcgccaccgcgtccgggtccgcccccgccgacgacgccgtctcgccgccgcacctccccctccctgacctgcgtgcaacaaaaacacacacgaaaacatcacgtacgcttccatcatcactcgatcgcgccccgcgattaacccacccacactgtaaaaaaaagctagccgcgatggtcgtggtctcggtgcgcgctcgccgagcgccggagcgcgagcgcgaaaaagcgtatcgcacgcggcgtgcgcgcgatcgagcgagcgattcgctcgccgatgcgtgcggtgtcggcagccggcgccgcggcaggtcacaaggacggcatgagagctttttttttccgggcgaaaacgttggaccgcgcgtaacgtgtcgagccgaggggagaagcagcataaggtggcagttggtggttgggccaggtgcccaactatccaacccgatttatgatccaaaagtagtaatttaaaaagtttccgagatcgaacaggtcggatcggactatgactctagaaagagaatatattttgttgcttttttttttttttggagatgccatgaatggaagggaggcgttggatcggacagtagacaagagcatttacaactcagcatagcgatgggtttgaaatggtgtcgccgtgtcctgctctcgtagggcatggaaatcttttgtgcagtgaagcgagatcatggtacggaataaacacgagaactgaaaaagaaatgttgtctgatgcatgcatgttgctgcaaagaaaagaaaaagcctgaaaaagaatcataaagaatagcttatcactaaattatggaagtgctagctcagtctctcggacatatatacttctagagtgtttatagcgatgagtttacacgtatatatgttggtgcttgtgtttgtactatttttcttggaaaaataattgttgtagctcgctgtggacaaagggagagggaggttgttttcatggcgttgatccataataccaatgtttttagctgctatttttgtgacgatactggatctagatcagtttcaccatacttcgctatggcttctccagatgaagttgaggcttgggttcatggagagaaggggatcctgtccgttacaaaatagagcggagtacacagttgcaactacagatgggaaagagagagggaagaggcattgggtagttgacaaatcccaaattaaggtttcaatatagagaggtaggaggctggtcgatccctcattaaggtggctttctgctaggctcgtgttgttagtgctggcatcgagaaagatgtatattgttgtgtcggtatggaatggaggaagatcaaagaaattggtggggggagagagatgggagtgtgggaagctgaaatgatggacgagtggctgacaggtagggtaggagcatatttataaactgttttatgttgatagtgtttgtatgggatagttcactttagaaagtaaatataaaagattataggctgtagtgaaaaggaacaaggcataaaagtgcaaaattacggttacatccatttaagttccaatgcattgtccaagtatagtatcactaatacttgcttaagctgctgcacctcccaagagcataccatgagaccacttcctattgtaaatgtctttgagcatgaataaaagttgttattcttgtaagtgatagagttttcgaaaagaacaaaggcaatatactaaaggtctaaagttcatctggaatgtggggaaacttttaagttcttattgaatttttccccctgaaattctacacgggctagttttaaaagcgaaccaagctgtaccattataatctaatctcattatggtctaatatgcaaatatttttatatttagaccctccatgatcaattgatgcaaatctttttctttttttttcaattaatgtggaaaaatctagacaaccaaacgtgaagagagaatatgttgacttttttttatgcctctgaaaagtagatagatagatataactatttaagaaaaaaatccaacacaatacaatgcaacaaatcatatatatgatatgttgtacaagtggtctcgttggttgatcaggaggatatatagctatcatataccatcgctttgcatattcccgatgagggcatatatatcggtacgcatacttacggttttaacaaaatatcggtatgcttacgtacttgttcaagtcaattttctaaaatatatattaacaaattatttcgatactatctattataaaatatacgcattgaccgaacgactgaactatcttctttctagggttcaaggaatgatgccgaaagaagcagctcgcacatgtttttcagtggccggtattacggaagtcgtatatatccgtgccatcattgcggaatgtattcctgcatatttatgagagggacgcaaaattttattttttttctcctctgttcccctttcctgaaaatgccctatgagctgatctgatctacacgttcgcgacgacgccacaggaccaccgaccttcgcgaggtagcgaacgataggattgagagatctcccgaaactttggtatatcttcttcttgtcatagctcactagggacaatattccactcgcacttgcccaaactaattacccgcaatttgactacccgtaatgaatcaaagctataataagcttatgcatttatgctttataattatattagtatctagcaagcaaagacgtccgtaatcttgatttcttgaagtattggttagtgaaattgagatcatgagttggtttggttcactgacctgggttcgccgatgacgccgtcgatgatcatgtgagcaatgtggacgccggccggctggaactccttggccagcgactgggacagccctctcagcgcgaacttgccgcagcctgcatgcattttactcgcgcgcaaacatgactcggatccaggaatttaatccggttgcttaattacgtgtgatcgatcgagccagtgaatggatcagcttacttagatcggagtagccggcgtagccggtgaccgacgccgacgagccggtgaagatgacggtgcccctgccccgctcgaccatccccggtataacctgtttgatcgatcagtggccggcatggccatgggtgattactgattaatcgaagatatgatcgagaggagagatgtggattgatggattgtacttggtgggcgcagtagaaggcgccggcggcggagacggcgagggcgcggtggaaggcgtcgggggagatggcgaggaagggagtcgggcgcggggaggcgtcgccgtcgccgtcggcgggtggctcgcaggcgttgtagacgagcacctcgacggggccgagcgagagcaccccttcgaaggcctcgcgcacggaccgcgcgtcggcgcagtccacccgcagcgcgaacacctgcgccttcgcctcctgcgcgatctcctccgccagctgcgacagcttctctgcaccaacgtacacaaccacatccaccatcaccggccatcatgcaagaacggaggaggaagaagaagaagagggagatcgagcttgccgaggtcgcgggagaggatggcgacggtgtagccctcggaggcgaacttgcgagccacggcggagccgagcctggggccgacgccgaccacggcggcgatgcccctcgacgagttggacccggacactgacctcagcatatggggaagacagagagtgaccgatcgatcgatcgatcgagcaaagcaacgcaacgcaaacgcaaagcaagctcgaagagacagcagcgagcgagcactctgtccggtcgtctggcggcggcgcgccgttggttttaatacgaaaaaccggggaaacgcgagcaggatatggcgcgccgcgcgcgacgtctccgatccagacgaatggtggtgttgggacagaatctggccatatgccctgcctcttgtgtcttccacgtacagcgacacttggacagtgtgcggagtattacagctcaagatgacagcaggacgggctggagtgatggtcctgcctgccggatcgatcgatcatctcatctctctgtacaacatttacaactagagttctataaattatatattgatttttaggaacagattaattgggtgggtgaacgtagaatttttttttctttttagacttttttattttttaattttatcaatagacctttccgaaaagtatttctaaagcagaacccaaataactatgtcgtgccacgcgcagctaggactgaaaacggggcgggtatttcccgaccgcccgcccggccacattatttcgggtcaaattcgggtcgggaattcgggtacccggacccttacacggatacagggttcaaatacgggtaattttttgcggatatgagatcgggttcgggagagcggtatccgacggatacggattatccgggaaattatgcgggtattacccgataatctatccgtatattacccggatagatggacagcagcccaacaggcaagcacccaacaggccaacacaacaggcaacagccagcccacatccaaaaggcccaccaaacaaagtgccaagcacaaaccctagccttcacttcacagttcagatcagggcagaacgcaggcaggcaaacagccaggcagcaccgcgccgcacgccgcatgcgtgcatccaggctccagcaccgccgtcgtgccttcgcagttcgccgaccaccaagtggctacgcggccatgcccaccgaccaccggccgctgtcgcacgtcgccgcgtgggtgtgcgacaagccgacgaccgtcagactgccgccgcgccgaccaccaccgcaaggccccgcctggccccttgcctcttttggctcctcaacgccgagagccgaaggacgtcgcgccacctcgtcatcttcttgggtagtcaagtcaacactcagcgactcatccagccatccaggttagccaaagtttcagtttttcattgccctttctcaacatcacgttagaacttggaaggatttttttttcttattttacttttgctgtttggctgtaggattaggatagaatggctagtggtgatgcaaacactagtatgtgtgcaagcacaggtgcatctccggctggtaccgtagctgttggtactggtcactcggcattggcaccaaatgcattggtactaaatgatgcaaccacagccactggaggtggaggtggaagttcagaacctgttgttattcccgatgaagaagatggagaattcacaggagaagttgaaccggtagcaaagaggcagaagaagtgtacctcgaaggtttgggactatttcattaagtacactgacaaggccaagaacaaagttactggtgtggaagagcaacaacgtaaagcaaaatgcaaaaaatgtggtagagtgtttggagcagagacagtaaatggcacaaaacacttatgaaatcatttgaatcgtattcactcattgaaacaaggccagcaagaacttcaggtgaagggtgaagttcagactttcaggtatgatcctgaagtaagcttggaaaagtggtatatagctgttattatgcatgaatatccattttctatggttgatcatgtgtatttcaatgagttcatccactctcttcggcctagttttgaattcaagtgtcgcattaccactagtaaagctatattagagatatttgaagttagaaagagaattttgtatgatgagctgaaatctgtttctagtcgaatttctacaaccatggatatgtggacatcaaatcagaacaaagcttatatgtgcatcactgctcattggattgatgaaaattggctgatgcaaaagagaattcttaagttcattcatatagatgggaaacatacaggaacaaggctagcaaatgcatttgtcaagggagtaatgtctatgaatattgagaaaaaattatttgctctcacactagacaatgcttcatcaaatgataaatgtgctagagaagttgtgatagagcttaacaagctgtttaacatcagtaaggtccctccattgatgtgtgatggtgctttctttcatgtgagatgtttatgtcacatattaaatcttgtggctcaagatggattgaaaatcattgcacatacaattcagaatattaggactactattggtattgtgaagaattctacgttgcaatgggaggaatttcaaaagtgtgctgtagaatgtgactgaacaacaattctgggctaccccttgatgtgcctacaaggtggaactctacatatgacatgttgaaacaagctatttactacaggggtgcttttgaaaggcttttattcttagatgaggatagatatcaaaggtgtgcaccaagtgctgaagaatggggtatggcagaatcactatgcaattgtttggagaaattcaatgatgccacattgttattttccggttgtctatatccaactgcaaacttgttttggtggaagttttgtgagattaagttagcacttcgagaatggtgtgcaagtgttgatgtctccattgcttctatggctgtggccatgcaactcaaatatgacaaatattgggacaagtccaacctagctcttgctgtggcttgctttcttgatcctagatacaagcaaaagctagtgattttttttacagaagatttaccctgacaagtatgaagaggaatttaagcgtgtcttggctgctatcgataaatttttccgggcttacaagagttgtgttgcaaggtcttcgaaacctaccgctgcaggatcaagtgaaaattctcagccacatggtaatacttctttgggtcacaatgaaatcgagaaattcttgtatgatgatgcagctgcaaataaagaagacgatataaatgaattggatgtctacatgaaagagaagccaattcgttgggttgatccaacaggtgaaggtgtagaatttgacatactggcatggtggaagagcaaccaaatgacctttcctatcctctcaacactcgcgcgtgatgtaatggctgttcaaatatctaccgttgcttcagagtcagcgtttagtgctggtggtcttgttgttggtccttttcgcagttctagtttgtaccaaggattggataagagcatctagaaaaggtaactgcttgtttatcttcatttcgctatttatataatctgccatttctagactgtgtttatattttgtcaattttatttacaggaccatttaaggacaagatagcaataattcttgatgagctggatgtacagatagaggataaagatggtgctaaaactgacaatgatgaggaggttaattacatatttatgtgttgcatttaaaaatatattttggacctgcaatctttaaatgaacaatctgttggttccactttggattttgagagagttaaggagcaccacattgtattaactgaatgttatgttctttttagggtcaggcaacgaatagtgtttgaagctgagcatgttgctgattggagagctggagtttttggtgattgaatctgaacatgctggcctttgggatgactgtattggtaatatgtgatcagtagtcatataagtgtatcttttggcttgattgtataccttatgtgaactattttggtactacttagtagttagtactattacttatggagttatggtgatgctcttagtatttactagtatggtactacttattatggtgaactatagtgtacagcattgagtctgaagctatcaagctatgaatgtctacttttgctactactttggtacagttttgctgataggcattacgatgccataagcccctaatatattcataatagacatataggaaatggctgaatggctattgtctatgtggtatatttggttgttgctttgacttgatatctgaataaatattcgtaaccgatagagttcgtatccgtcttggtacgtattcgttccgtatttatgcccgatattatccgtgcttctattcgtatccgataatatccgtgcccgacccgattccgattataaaatgtgggttaggatatgggaaggatgagatccgaccgaacccgacccgatttcacccctacgcgcagctggcatggcagtgttgttctgcaacgccaacgtgtctggcgtggcaaaacaacgttgctcagttttcagaaatattttttggaaaagtctattaataaaattaaaaataaaaagttaaaaaataaaaatatttcgtgaacgtaccaccactacaacagaaatgctaatcctgcaggtttcagaaccggcaaaccgcattagatagtgatggggccataactaacaatttccaacatggctgcgatatttgttagcttaaccggtatggatccgaatttaccatgccaaaaaaacacacaatccagatcagcctagcatgtgtaaggacggtccggattgtacgaacaataaataaaataactacacagacggtccggatgtgcggaacggatgatccggtcatctatcaaaccagacagtctgtacaaccttggacaatcttcatgtggcaaaggacgaatggtcctgccggactaaaggatggtctggactttgcaacaaaaacggacggtccatccacaatccgttgtcacgaaaacggattgtaccggcagcacacgaggacggtctgtgcatgagggaacgaacgactggtccggatcattgatgcgatgatggactggtcgaatgggaggttcaagttggactgtcctatctggctcttataaagaaacccacaatgcaagattattaagcaatttttgattaaaaaaattcatacaaaattagcgtcactaacatttgaagcaccgaacgaaaagggaaatatcgataaattatactctctctccgttcctaaatatttgacgctgttgatttttttatacatgtttgacctttcgtattattcaaaaaatttaagtaattattaattatttttctatcatttgattcattattaaatatacttttatacatatatatagttttatatattttacaaaagtttttaatatgacgaacggccaaacatgtttaaaaagtcaacgacgttaaatatttagggacggagggagtaggtctaaagtctgaagtctgaagagacaaacatccccttgccttcagcttgacaatgagcaccatgctcgggttgggggtggatccgtggatgtacctccgtatataaattgtatgaaaatcggtgcaggtttagcaaagggccatcgagaatgtcaattatgtagaccgtctgataacttaaaagatggtttggatagttaatatatttgtcagcctgtggtgagaaacaacaatgaaaaaacttccacagctggttcttggttgctcgggcgagaagattccctccaacgccatgaaccggtagtcatatgcggatctagatggtggacccggaaccaaaaaaaaaaaatcctagcccaatgcaaccatatattgcccaatgattattcagacgattaaacaaaatgcggatggttaaatgctaaaataaagttttgacgtttatcttgccccatatcgcgttcatccatatcgcgttcattttcctactttttatgtttgtatggccgactaatatacactaaacggatatagataagtttggcaataaacgacttgttttgaaacagattattgaacaaatttactatgcattatctatttaattatatagataaattaaatattttgataaataaacttaactagctgggtagcccgcccaattgagcggctagtatccaaacaaaatcatatatttttttaagtatggttttacttaaaatttattgtcttaagactttgaaagaccaaatattttcatccctgtgtttctaattgtatagtttttaaaagtcacaccggttgctaccccttacttctgtcatttcctttttttatttgcttgctcgatctatcactatttctattcatttttcttggaacctttaaaaaaaatggatcttgtaatttttagagtttattttcttgtcgggtttcgtttttataatctctggaagacctgtcaaatgctgctgttatactcctatacggtccgtccactgcctcttctctttattgtcgttggaattttaaaaatcgaacataattattgtttgggttcattttttactttcaagaagtcccaccaaaccgtcaacggctttgtcattgtactcctctacgactcgcttggtgcctcccttctttattatcattcagattttaaaatcgaatatgattatcactgttttttttttactttttagaagttccgaacctttaaaaattggagcttgtattttttatagtttattgtcttgttgggttttattttttataatttttagaaggcccatcaaacgatgccactatgctcttttacggcccatctgcagcctactctttattgtcattgggattctaaaaatcgaacataactatgttggaattcattttttattttctagaagtcccgccaatcatcggcggctctgcaactttactcctatccaccccgcccggtgcttcttctttttattgtcaatgagattttaaaaatcgaatatgattatcaatgggatttattcttttactttctagaagtttcggcaactgtcttgcccgtttgcttcacggcctgcctgtcgtccctccttctaatcgttattaggattataattggtgttttattaacagttttaatatgtcgtatgaaccgccaccactctactcctttataggcatgttacttaattttatctcatcacgagttttagatggtcttttctttcaatatcccttatttttaatttcgaatttcaattatttttaaattgtattcctacttggactctccttttcttttctaatttcggattttattttatttttattccgaattttgatttttaattaatatcgtattgtgttcttttaatatttttattttttattttcaattctagttgcttcaaaattgtattcctatttgaactctcttttaattttcaatattgcttatttttaattctgaatttcagttaattttaaattgtattccgacttgaactgttctcttcttttcatttttgctaattttggattttaattttatttttatttcggatattaattaatctggtattgatttcttatatgaactcttctttcaatattccttatttttaatttcgaatttcagttatttttaaattgtattcctacttggactctcattttcttttctaatttcggattttattttgtttttattccgaattttgattaatctcgtattgagttcttatatggactcttcattcaatattgcttatttttaattctgaatttctgctctttttaaattgtatttcgacttgaactttttttttctccgattaatgtgggaatttctagcctccacagcgaacgtagtgcctcctttcaaagctgttttaataatataatagatagatggtaacttaaaaacaagtgatgtaagcaatatggtaaaagaaagtttttttttcaatatatgtatatatttttaaaattcattttgagaaaacgtgaaggaaataatcaactgagccgaacttgacaccccaggtaaggtagtgctttggagtaggacgggcttccatgctgacagggatgatgtggaacccccaagctgaagtggtgcaattaatcgtcggcaacgagagcagaaggtccacacgcacataatgcaggagtggtctcgcaatacatctacggtaaattctccaactcagccgttgcttgatctccagtgttaaaagttaatactactagcatccagaatttactcaaaaagaagattgtggacaatgccctatgcgcactctgtcagacactcagacagatactgaaacggcgagccatctctgttttgcttgccccttcgcaaagagtttttggcgggctatcggctttcaaccaaatattgaagaagatgaattttacacttcttaagaaagtaatttgaggtacctaaattttaaactaaattttttaatacctagagatacttaagtatataaagataccaaattttacattagaaaatatagtatctctatgtgctttcataaggatagtaaaattacacattgaagaaacgaatttcctttatctacaccaatcgtctggaagaatacccaacaagatgttccacctacttccgcagattgtttccggatactttggctgcatcgccataatgtggtcttcgctaggatcggccctgacaaaatacttacggagatactaacttctgggttgaaagactaaatagcaaagatagggatataatcccggtttggaaacagttgttttcttcctccctgagaactctaaatttgatgtaacctttgtgtctcaaaactattctctttgaatgaaattcaggaggggaatctctcctctccggtgacttggtcttaaaaaaaaaactactagtacctagaggacctggcatggccactccttgttgtcttattccatggatcggtacaatcacaacggcaaccctgcacgatagcagcgcacgtccgttttatgctataagactttctagtattatccatatttctatatatgttaatatatgtctggattcattaacatatgtataaatattaacaatgctaaaaagtcttataatatgaaacagagggagtagtttttatacttgtcatattatatagaagttatgtatagaaattatatactcaacgaatgatttcttcaaaataaattctcagccaatcaaccatcttttttcattcacttaagaaatagtttttttcattttcccccttttccccctttttcttattatcaactcttttactatttcagttttttcttacgcgtcaaatatatttaacactacgaaactaacttaggtgaatgttgggactgtcttaatcctggctaaagtccacaagcatacaaacgtaggagctttagtcagacgcatgactgtcacgtattggcacacgtagcaccaccgataccaactgcagttgtctacttgcccacctggcgttgccaagctggtgggagccatctccattgctgccattccaattctggctgtcctggctggactgatgcgccatgtcaacattcaaattcaagtgcttgtccatttacataaccttttcttttctgtctagggggactttagtacgtgtgacagttaataggggagcatatctgtatgtatcagatacatgcatgctccagaatttctcttcagagtagaagaaagaaaaggaaaagaacaaaatgatagagcatggcacaaaagataccctttttaaaaataggagtatccttttgactaaaagttcttctagaaaaattcggaattagtgagtgatcagtgtcagtgttaagattcagtaaggcccattaacaggacggccactagtgtttagtgggccagtgaggtgccgctgtgcaggcccactagacagaaccaattcccaattttgggttgtaatagtagccgaaatctagaagataccgaatctggtatggctgtaagctaataatggtcagtaaggaccagaagagggatatgtacaatgtataaaacaaaactcattttttctgtcgctgttcgattagtttgctagcaatgcagttgcttgctagctggtggatggtagagttcaaaactgccaaacatgaaatagccgcagaatttaagtttggagtttggactaaatatactccaataataatagctagtacatgtagtgtgcttttaagataggaggtttctaaggatccctgcatatgatagcaatgaggtaccaggtctaataatttttttttgaaagaaatcaatacgatattgtgctatttcattgaatgtaaagataaaaaatacaacctctaggtgtaaggaaaaatactgtacatggctacacaacgcctatggttgatttgagagaaattctccaagccacttgctcctgccatagcctaagtttgcctcctttatttttgccataaggctttttttttaatggaatcagcacgagattgtgctatttcattaaatatagcgggagaaaagtacaacccctaagagaagaaagaaaaaaagctatacataactatacgtgtggagggataaactcgctaagttttttaagctccggcaagaacccaagttcgtgtttcttcctttattttggccaacaatttttgccataaggcaaggagccacagcctccttttgctcgaaaaccgttgatttttttctttccggatttcccagaatgtctaatacttatatgtatcaggtctcgtatatgaatgttagacctaataccacagaagtacaaggcctgatacgtatggataccaacctgatacacattaatccacaagaaaaatggaggagcctcaatgaagcctaaacatccccaaacaaattacaactacgacaccatggatagaaaaatattgtggcggatttctgttgattgagctcagtgagagagaagctgttgttcaactgatcatctaaaagggggaagatgcctcgagcatatccaccagcaggcagcgatgggattctaactgatgaaatttcaagtgttagtttcaaatgtcacctttttaaataaatcaaaatagcaacaatacttctctgtcaagttttagtttgtcggctctgacggtcactgtaggtaggaggaacacggaacaccaattcttcagtggaaagcaacatgatatatatcactctcaactcttcatgtgtatttccctttacaaatgcaaaaaaaaaaaattccagcaattagctgcaaacttgtgctacacaaaaaaacaagccattctgcccttctacagtgtccaatccatacaccgtggcaggtctacgtggccagaagatacctgaacctgaactcgtacggcacaacctggataggcggcggcgacgggctccggcggctggcctcgacggcctcgacggcgtgccgccgccgctcgccgggcagctgcaggcacacccagtccatgagggagctcacgtccttggtgaagtcaagaaggtaccagtgcaggagcttggggatcgagatgctggtcgccgtcgagacgccgacggcggcctgcaggtagtccctcttggctgcctccagctcttcctcgacgtggcaagccgtgtacaccctcacctgcgtagagagaaaaatactcctatgtcatcagcatttccaataccaaatgaaatgtagcctagtggtggccgtgtaaaaaataccattctctaataaaatcaatactggaatacgcttctcttaataaaatcaacatttccagtgcagtgaggagttcagtatcatattcagtctcacaatttcagtactaacattttgaaatttccgaaaacaaaacaagttttactgaattttgcaaaaaaagaaaaaaggaaatcaatttaacaaaatctgtttaaatttccgaaaccacctaaatgtttatgcagtctgaaatagtaaaccctgctcacattgtagtggtctgcatttttactgcctaatagtgatagctttatattatgctgaattctcacacattagtagtattcagtactcttccctagactgcaagtctgcaaccaacttgattacaccaaacgacttatatttgtgccctaacaaatattcctactgtacttttcagtacaattagtaaagtgcagcttgttcaacttttgcctttgcagcttgttataatcgcaggctgctagagtgctagctggctagctgccacacagagcttcccggcaaattcatgatgtagcagttgaaaagatacacaccatagtaccatacacgttaacttttgttccttttttcaatctgaagttagctagcacatgcagaatgcacaccgagagcagagagaaaattcaccggcacgccggagaaacttaccgccggcgaagaccagcttccgcaggacagcgcgaatgtcaccgacggctcaggccagtccagtccaaaaacccctctcgccgccgccgccgcgccattgccggatttcacccccttcgggttcacctgtccacaaaggcataaacatcatcttatatcctcctcatctcttcgcttatcaagattcctgttatcccgtcatattatacggaaattgtggggacgctttgactcccgtgtcgctctctgaggcgacccgggaggagaacaggactcccagcgcttttcccctcgtcgcccacctcgccggcgccggcgccggtgccgcagccgccggcggcgcccccacccacctcctcccttttcacctccccctttcacctttttccctttcccatttctcccttttccaccttttctgctcagcgctcggcggctgctggctagttgcccggtcctgtaaatcctcaccgccgtcgtcgcttttcaacttgccaccgttcgagcaggtcaccggagagtgcaggtccgctgggttggcggcaaggcttcctcctcagtccccttcctagagagagggcggcacggtgggtctcgcctggctccggcgagcgacgcagtggaggtgatgtcgacggcgggagcggccacgcccagtggcagtcggcaaggcaggcgcctatggcgccggttggccgggggtggtggcagtggtggaggttgccggttagtggggcgctccggtgatgggcatggttgctgtatggcggcaagttctccatcaccggtggtctcaatgggcggtggtgacaggggctagcccaccgttccttcctttgtcaccgacggcgtcgcggacttggtgagtagctgttctggatggagatggagctagtcctctatcccctccttcgtcagcggcagacttggtcggcgacagcggcgcaaaggtggcagcgggctgggagtccgagaacggagtaggagtctgaagtcaatggcggccctatgggcggcggaggcttaagaatccgacgaagcaaatacagttgctttcaactagtgtctggtcggctagttctgaccggaggacgatggatgagggtgggcttcccggctgccgtggcatgaaaatgacatctatggagattcgcagcgacaacgcactaggggcggtggcgacgtttcagttgaggatgtcaggatgcagggatttaccgaggttgtaggttttcttgctttttggttttgtgttctcctcttcgttgaggtgtgagtctagtactcttgtatccttttggctgtgtatatcccttgtggatatagaggccggattaatgaaaatccattatctaaaaaaaatctcttcgcttatgtttacgcttatcagctaaaatttaaattttcaaccttaaatttagagttgattttgaggtttttttcatcgaagtttatttttcagcttttaattttaaatcgctaagaacatgtatatgattttttttattcacaaattatttttcttttgcaaatacgcccgaacgacggggcgtcaatcttttgtaccatgaaatcgatcagataagttttcaggcacacggcaatgatgctagcatcttactcttacatgctttgcattgtagggcagccttaggatgaagtgctcgatcgtcatggcgctcagcacgcgcccacccacgttgattgtcgcctgcggcagcaaagaaaaacagccaactcactcttgtcagagattttctccatatcacccttttatcttttgctctcgagttgcagatgcatatgctgcacgtaatgaatctagagaaagaagtaaatgtggatggatggatggatggaaccttgggcatcattgccaccagcgtttgtggggtggtaggtgctccatgctcaagaaatgcctggagttgcagaataaacaagcctgcattagtgttagatcaggagacatgtcactttgatcagattaatgaattctgtcaggctttgctagcgaagacgagctgtgggtcaaaggataatggagccaaggtcgtcagttgtttatggctctgcagatgatcaaggaagcaggaagcattttgatactgaggtttaaacgtttaataacatgacaacatgcagtccacagacatgccgtgtatgcgcacaaaattacacatggccagaactatctaggtgtatttaagcaaacctaaacaagcttacaaccgttggagatttcacatcagtgtaaaagggagctaatcaaagttgtcaatcaatcatgctgaggggaaaagcaaaggaggcctcaattatgagggacagcttacattcatcatgcaggaattgtaggtgttgatccagaatgctaacttctgctgatgggaaaggcccactaggtcaactgaagagagcttctggagcaaggccctgatttttgccaggtagacactagacaagatcattccatgaacatgataggtcaaacagaaaccaactcatcacacagcagaatctagtttgtaatgacagattagtacagtagtagtagtagttaccccagatcagtggaaactcacttcaatctcctgtcaagaagggagttgctgttgtcaaaaacattctgatcgaatgaagtggcatcaactgctctgaattgcttgtatggaccaatgtccctgctacccaattccaggacgccgtaggggtcgccggcgcaggcggcgccgtcggagctctcgcaggagcctgaaaccgacggagacgatgatcggtcctcatcttggtcactggaggacctcatctgtgagaagatattcagtaggcacgtcaatagctcctcagacactttgtttgcttctgtcgagatgttttctgaatcaatgacagtggtgtcctcagtacctttctgatctttcactgcactaactgtctgaaacgaaacaacattagcgagcaaaataaatttaagcacacaaaaacaaaacattgggctaagtcttgtacctgaaaatcggcacatttctcctcttctggattactgcattttggcacggttttcagagggaaccggctgtgatctctgaaagagttggtggtacacgattggttctccttcccaggacgatcacctccatggttcatggaaggaatagtccttcttggcgtctgcttgacattggtgactcgcttcagagacgaccagctagcactagcagcttggtcgggaacttggccatggcgcgccggcgtgcaccggtcggtgtcggagaagtacgcgctcttcgccatggagatggtgacagcctcctcgtagagcccttgccggaagctgacgacctgctcctcgagccggacgacctcctcctccaagaccgcgacctcggcgaggagctccagcgtcttgatttgcacaattcggcaaaaaaacaaaatgatcagggagatgaaatccgatccgtctcacaagctggagctaagctgcagccatggcgatggcggcggcggcggccggagctggatgttacctgagaaggcaggtaaggtggaaggcgagggagagcgccgagtggcctcgtgaaggcgcgctccagagctcggtggacgttctcctcgtgccgcagcttcttcctcagcttgtccacctgcaacccaacaagaaggcaaagcgttcgaacatgctactaactgattgtgttttagctgatcaattcgatcaaaaactgaatttctaggcaaggagaaaagataatgtacgtcttgctgcagtgcaatcttcctgtctctcctggattggctcctgttcatgatcatctggggcgccgcagcattggaggacgacgccttcatcgccggaatcttcgagttgggcctctccatcaccttgatcagggcggagaagaaaacaaaatggactcgtttagatgcaacaagcgacagtgaattaaatacaacgcggggctgcaggagcggggagcaatcaagataccgaatttgaactgctctcgactggaatggatcccccggagcccatttcaaaaactcagagcgaaaaccatccgaattggcacgcgaaagcaacaggagtgaggtgtacaaaacttgttgaacacagaaagctctgctgagctttgaagccgtagcaatcaaccgctccctccaagaacacaaaaaaagaaaaaaaggagcgcagaactcgtctcccgaagacacccccaaaaggcctcgaaacgcaaagaattcatgcgcccatctcccatgggacgcgaaaggcggcagctttgttgcgatccgaggagcacgcaagagtcaaggacggcaatagacacacacaaaaagaaaaaaagaaaacgtattggaaacaacacaaaaaaacgcgaggaatatcatcattagcgcaaactttccggcggccggagcccaagaaagggagtggagtggggggaaggaatgcaaggggagagccacgtaccttgtcgctcctcggaggagccctcacgccgccgtgccgcaccgccgccggtgacgtcctcctccccacgctgccacttatcgcctccccggcgccgtgtacatcccctatcaccaccagggtaaggttgggtggccactggcacgaacgtccgatcggcgacgtaggatcggaggagccaaccgacgccgccgccgccgcgagacgaggaggagcccagaatgcgaggcagaacccggcggtgaagtggtgatcgcgggttcgattcgtctcgtactctcgcgtgatgtttcttctcctcctccgcgtgggtggtggtggtgttcgcttcactacggcttcctccgttttattcgcggcttgatatcgatcggtcacgccaggtgaggtctcctttattttcatttttctttgtttctcgccgtgctgccgacttgcgacgcgacgaggtggtgggcggtgggatggccgaggcgatcgagcgatccaccgggtcggtttgatggtttctgccgggctcggctaaggaatattgtgatgggaagagcgggctgggtcggtcaggtcagcggtggccgggacgggacggggggccacgcggtcaatcatgagctcgtggtggcctcgctttccacctttccaatatcgcacatattttccccttcgcatgggaaatagtagtataacttgggaatatatctggatgtgtttagttcggattccttcctcctaatgcgcaaaacgaaattacggattagcacataattaattaaaaattgattagaaaaattaaaatagattgtaatacgattttctataatggctcttctatattttttaaaaaaaacattttttacaagtttacgcgtcaaaaatgagggatagaagttaggatagtggtcaaaagaactcaaccttaaatggaaacttaggaagtatttaattaaaacgttaaaaaaatctttgaaaaaacaaatatgtattctttgtcccaaaataccgaatcttagagatgaatatggatatataatatatgttcaaatttatttctacaattggattattttgggatagagtgagtaggtaataacaacctataaagttgcatgagcaaactcaatttcgttgctgaggtatgaaattaacaaactatagaggaaaacactcctgttttttttctttttcagtgtttctaatttttatatctcacaaatgaaattgagtttatccatgtaactttgcataattgtataatactatcttagctatttgtaaggctttttaatatataaagacttttatatcattgtttgagatataattttgggaaacatgagagaaaaagaaaaaataataaaaggaatagcgttcttcctttatgatttgttaatttatatctcattaacgaagttgagttttttcatggtgtgatattttttagatttacttgagaactcctgtaaaaaagtttttaagttttcgtctagaatgtggatttcactttccaccatatactttccccacttggcactccctggaagtagtagtccagtatttttgttccttccccttcttttcttcacttgccgttagctgtagctgtctgatctgactctgatcactgctctgtttggaaaaagcttagctgcatatgcttacgaagcaatgcagctactactacaaaacttttccaagttgacacggtgtaaaataattagtggatgcgaggcttacacaaaaaacgcagcactcattttgctcccctgcaaatttggtcgctgcagctgttaacaagttaacactagatcagagcaaaagccgaggagtctcaggctcgtcaggtatataaaaaagctctgatcttttaaaaaggatcagcttggtttataagtttacgagtgtaatgctatccaaatggtcggtttagacgagtgtgctgctgcttccatgatgcatcgcatacgcaaaggccggctctgccatgtgaggagttcatcttttgcagtgctatcctgttcattcaacgcacagcacatcgtcagagactttgcgaaaaagacagggtcgtgacgaagtgttgtgtgtgtgtgtgtgtatgcagagaagctgggcatcacgtcgccctgcaaaattacaagcgagcaggaacacggaggtaggtgaaaagcgtgtggggggtttttaattttttgctgcaaaatgatccgtatttatcggtcgtttcctacgcagaaatggcagtatagtactgtactagctgtagttcttgtcgaccttacaaaaagcttctgcatttgtggactgtcactaagctaatcaccccgttgttttggaaaacaatgttaactagttaataacaaaaatagtttcagaacgcccggtcgttctgccccgggggcgacgcgggtggcgatccccaccaaacccccccccaccccgcctcgccgctgcccgagccaccgccggcaaagccaagcggctgcaaggacggaggtggtggagctctctctccctcgctcacggttaaggcggtcggggcgccggcaagatggagctcagggcaaggcgccgaagccgaggaagagccgatggcagcatccagatttggcaccgggatgcacggatctggtccccccatggccagatctgttgctccaggcggcggagagccaggtcagcgagttggcggcgtcggtggcgtggagttggcggcattggcagatagagttggcggcctcggcggtgtggaggtggcggcgggggcggcggcaagcacgatagcgtcggaggcatgggtggccgcggcaggcatggaggcgcgactgttgtggccgccggcgggctgtggcaggccggcggctcgaggcgggtcgccggtgcgagcgggccagcgagtggacgtcggtggcaggcgtcggaggctgcggatccgaaggaagctgcaaaggtggaggatggcgcgctcgcagcggccttcttcacgatggcggggtggcgatggtggcggggttggtggtggagcgacagcggcggtggtggaggccagggggcggagaactagggctgtggcggctgtggctgtggttgttgtggcgaccgtggccgtgcctacggcgagaggaggcacgacggtctcggacagctagccaggggcgtggtagacggctacatctgaccagcgcaacagcaattggaggaggggtcggaggtcggctcggcgcaaccgatggcagcggaggtcggcatgacgcaaggaggcgcggccggcagcggtggaggccggcttggcgcggccggtggcgggaggccggattggctcgatgaggcacgtccggtggtgaagaaggccgacgtggcgtgatgaggcgtggccggtggtggaggaggcgaccacggtgcgaggaggagctgctggtgggtgtggcgcggtctacgacgcacgacggctagccggcggggggcgccggtgcaggggtcccacatgtcggcggaggttgggcagtggtggagcatcggtgcgttagccgtggactcgcaagtggtgagcggcaggtgaaaacccaacccggccttggccggaccgacaacgatagagctcgagtgtcattccccctcctaagggcgttgtcgtgccgtctcacccctcaagggtggttgccgggcgaaagcctagtcttctctcttttgaaaccttggtggacggtggcggtggttttcgtcacttctctccttggagttgtcatttaggcatccccttgctgaaaccactcgagcaattggtgcaagcacactctagatttttcatcctcttgtggtggcgtcctagtttctacaagttgactacgtcggagggcctagggggagaggtgctccatcttctctctcaccctctctccctaaatcctgaagacgtggatagagttgggctttgtggtggttgtaagagcgttttttgggcgatctcgtttgtgttccgtttttagcctagcggcggtcggtcacgcttagcggcgatcggtccggtgctagccttctcccggacctgtgtgttggtgctgttggtgtgtgggtggtggtatattttttatttttttctggttacgatcttgcagggttataattttataattgttttctgctctatcaataatcgcaccgtctcatgtgagtcgttaaaaaaaactagttaataacattatttttttttggttagtgtctgaagaagattaaaggaagctgggagtgaagagatggtgatttttcggcgcgaccaggggtggatatagttgcaggacagctagagctatagctctactcctattgcccaaatatccatagaatcatactttaaaatttaaaaagcccaaatatccatagaaatcatactttaaaatttaaaaaatagaagacaaaagataaatttatttagattatactagttcagccctactatgagcatattctggctcctccactggctgggacggtggtgaagaaatgtctggactaattttataggccgtgtttggttcacccccaactaccctaaacttacaactttccatcacatcacatcacatccaaaatttttctacacacataaacttttaacttttttttcaaactttcaactttccctaaacttccaattttttttaggaactaaacacacccataagattgagggaaggtaaaatattctcaataaacatagttgttaatattacaacgtgtcctgcgaacgaatagaactttacgtcgtccaaatccaaatcaaagcatgtatacgtcgggttggctatcagcaatgcactagaaaccggcttcacacataaaatgtgcctcgattcgacacgctcgccattcttacattggagagatggcgatggtgatgatgatgtatacaaagcttttgtgcccgggcacatgagatgagagtcgcggagctggcaagtaacaacgtttcttctcgttttgatagccaaattggccagtttgtctcgacaaaatttcttcccgaactgacactgtccatgtgacgtggtccacgtagtcagtggcgcgtaaccctaccaatcttcggtgtggaatgaagcagatttcctatatacgatccatgatccatcggtggcacttttttttttaacgactcgtacgagacggtgcgaagttttattgatagagtaggaaaaaattacaagattataactctggagagtcgtaaccagaaaaaagaaaaaaatataccaccacccacacgccgacatcgccaacacacacgcctaggagaaggctagcaccggatcggccaccgctaagcatgaccgaccgtcactaggccaacaaaggggcacagacgagatcgaaaccacggctgacgcaccgattgctccaccaccacacaagctttgccgacatgtgggacccctgcaccagcgtcccccgccggccagctttcgtgcgccaaagaccgcgccacacccaccgacaactcctcttctcacataggtcgcttcctccaccaccggccgcgcctttttgcgccaagccggcctcctccactggacgcgcctctcgcgccaatccggcctccctccatcggttgcgcctctcgcgccaagccggcctccatttctgccgcccgcgcctctcgcgccgagccggcctccgctgccatcagctgcgcttctctgcgccaagccggtctccaacccctccaccgaacgatgccgcgccgaccagatgcagccgtctcccacgccctcggctagtcaaccgaggccgccatgactccggtgaccgcaaacacggtcaccaccaccgcagccgctgctgccgaacacccagccacctcgcacccgactccttccctgccgccgaggtcgccaccgcctccagagtcgcagccgccgtcgtcgctgccaccgacgccaaccaccgcctccgcaaactgctgctgcgccgtcgtcctccaacaccgagca

SEQ ID NO: 38225 - DNA, 6916 bp, Oryza sativa
gggcctcccgcgccggacccggacaggagggttccggatccggccatcccgccgcctccacgcgcatcaccaccgccagcggctcgggatccatccccccgcaccagatccgcgcaggagagcgtaggagccagcaccgccttctcgtcgtcggcccggtcgcccatctcttcaaccgtcgtcggcaccgccacctcgccgaagccatgtgccaccgtcgagctcgacgtcgcagccgccgaagtcgccgccccgaagctaggtcggggtcgtgggctccgaacgccgcgacctcggggggaggaagccccaccgccgccgtccttgcggccgcgcggtttctggcggcccgctcgggcggcggcgaggtagaaggagggcggtgggggtggcacggcggcggcagctgggttgcctcccgtgtcgcccctgccctggaagcgacgcgggggcaagaaacggcaatccaagagccatcggtggcacgtatgtatatgtatgcctctcgtaactgttagcattgaaatgtattatgagcagtcgcattcgaattcgaattcaaattcaaattcgcatgcaatgcgatctcaagtgcattactgaaacgacagtgttgcacacttgcacacatgactacatgagcggtcaggtttattttcaagaagaaacagagtgcccatatcctactgcgacgttcatcggtcctgctttaagtgctgtcgattagtttaaacagtgattaaatagagggtcactgctggccattagtttaagcagattcattcaaacttgggaccgtccaagacacgacagagcagcaatgggggctttgttatgccggtgtgaatatgcatcagagattcagaggccaagaagaagacaaactccctctcctaacccctggaatccaaagctcaaaagcatcagcaagttcaaatcatctttcaactaacagtgacactggaccagcagttttgagcaaaacacccatatgaattcattaacttagtgttgtggagtaaccaacctggcttgttgttactcttgtttgcaaatcataatgggaagatgcatcacaatattttagtactactccccaacaaaacctttctttggttaatcttataagtaactaaagctgcttaagactgcttcctgtcgtgcctaatgacatttctaaacgtgtggttggcgctcgtttttcaaacgggttggttgtactcatgtgacctcgcttttgctttgctgcccaattgctatagtagcatatactactaagtattatattaaaaatcgtcagtaaactggaagcagatgtgtcttttacatagagttaaacatcaaacagaggaaaagggttagtatagatttatggcatcagttcaacagagatgattgtacatcaccccccaagtccataacagaaccccctattcaggtttgtagcacagttttcaacaagtaactttgacttattactccctattagttagctaagggggtgtttagatccaggggtgtaaagttttggcgtgtcacatcggatattatataaggtgtcgcatatgggggtcttcggacactaataaaaaaactaattacagaatccgtcagtaaaccgcgagacgaatttattaagcctaattaatccgttattagcatgtttgctgaagcaccacattgtcaaattatggagtaattaggcttaaaatattcgtctcgtaaattagtcgcaatttgtgtaattagttatttgtttagactatatttaatacttaatatatgtgttcaaacgtttgatgtgacagggtgtaaaattttgggatgggatctaaacgaggtctaacattttgttttggacatatttcaaggcaagatttaaaaaagtttgagcctcaaatctagctctagatatttagattggatgcttgtatataatgggattaatttgtctcgaaagatacttttataatgttatatactaccttagttctaaaaagaagtttatctgacatataccaacagtggcgattcctattcggggtcacagaaccacggatagatgaattaatcctagcttaatttatgacatgcctattaatatatcacttgataattagataacaagtaagtattggacccccagtagcgaaccgatacaacccccatctataacagacactttctaaaactccaatgtaattattgttttaaaaataaagtctttctaggacaaaatagatggaaaagataaattctttatgggacggaggaagtacttatcaagtttttaaaatatttggcaatattaattatagtcaagttatgtttgaaagaacacatctatgtcaaaatggtatgttttggtcactccctggccatcgcgatgagatccaaggcggtggattcggcctcgttctcgctggatccatgcgggaagacaagggtggggagcaaacaacgatatcaacggtagcgatagggtgcagtggccgtggcggagtgcaacaacgacatcggcggcggcagcgaggtgcagtggccacgacggagtgtggcagtgacctcagcgtgagcacgtcttgcttcttgcctggaccacacaaacccctattctctttcctagagccaccgtagaccacatttacctttgcaggctccactgccaccctgcgagaccaccctaaaccttcagcgtggcatccaaacctagctagaacttgagacgacaggtctgagacactgctttatacatggccttagcttagggatggcaatgggtcgggtcgggcacaggtaaagcaaaaccatgccctacccgatgcccaatgtcgccggctcaaaccctacccactagggttagcgagcaaaactccgtgcccgtacccatacccgacgggcacgggcatacccggcaggtacccaatgaatctcacatgaataataactcgaaagataagtaatttaacaaagagaaataaaatcaatattttacaaaattatcagttatcaatgataatttgaattacatcacaacttcttatcagttagcataacaaatgatccaagagaaaggggtataagaatcaagagatgagtcgaaattagctaatacaaacgtatcaggtcgggtataggttatccacgggtaaaaaagaaacccggctgttgcccataacgtcttgggtcttgggcggacgtgcccacgggtacaaaatcacacccacactagtgctcatcagacattcgggccgggtatccgctgatatccgaacccatggccaaaattgtcatccctaccttaggttcactagcttgctgaacacacgctaaaatgtcaaccacatggtagattgttctttggccatggtccactagatacctttttaccttgtgcatgcttgcctgcctgcttccatcgcagaaagccacaaagttactgtttgtcactgcaggcagcccacggaaggtatggccagtgggcagtggccactgcagccgggcaattgcctagcagcaaatggattcaagagtcagtcatgtgccaaaaggcagtgcagcttgctgcttttgcctctgcctgcctgacatcctggagtgactggtgaaaaattgtaccgtattccctccgtcacaaaaaaaaaaaaaagacaaatcctaggtttccgtgtccaactttaactgtccgtcttatatgaatttttttttataattcgtattttcattgttgttagatgataaaacatgattaatattttatgtgtgaattgttttttttaatttttttcataattttttcaaataaaacggacggttaaacgttggacacgaaaccaggtttatcttttttatagacggagggagtaaagcttacactgtctctctccaattccgattctttgttgctcgaactgatcctcactgtgactgctccggcttggtcggcacttggcagtttagcatggagagagagatcatcatcagatattcggaatccgggacaatgatatcagaatccaaagttggcttgctctggattcattcatttgtcgtggtttaggtgccgtttagttcccaaatttttttcccaaaacatcacatcatatttgggtatatacatgaagcattaaatatagattgtcccaaaaactaattgcacagtaagagggaaaatcacgagacgaatttttaagcctaattagtccatgattagccataagtgctacagtaactcacatgtgctaatgacagattaattaggctcaacagattcgtctcgtggtttccatgcgagttataaaattattttttttattcgtgtccgaaaacccttccgacatccggtcaaacatccgatatgacaaaaaaaaatttcgcgaactaaacatgcctattttgttattgacttttaagcttagatgggacaatagtacttcttgctcaagagatcactattatgcatttcatgcatggtgtccgtgtcaccacatggtacagattgtaggctcgattggtcgcatatttgctagtaattttgatcaatgtgctacagtaccatcatgtaagctgcacacaatgtttggctgaagggttttcaaaggacttgcacaggtttttaagtcctaaagaaaaaatgattacgagtaaattttacggaactacatgtactttgatcaagttatcttaaaagtataaatttagcaccaaatttattagagaactataaatctaatacaagtacaataaaaccatagatttagtattaatgttataaaaaaatacatattttagagtttacatcattagcactagcactaatgttatcttcgagctataaatgttatagtattatgattagattttctaaacttgtttttttatataattttgttactaaataaatagttgtgtgatattttatcttaaatttatagttccatttctgtaaaaaaaacgaaaatatatattttttgtgataaatttattgttaaatatattatgatacaacggtttaaatatatagttttacgatagtttggttgaagtatttatagttttataaaattcactcaaaattcataaactatagccatttggattgaaggaaaacaaagggaaatttacatgtcctccattcttaggccttgtttagttcccaaaattttcttcccaaaaacatcatatcgaatctttggacacatgcatggagcattaaatatagataaaatgaaaaactaattacacagtttgcatggaaatcacgagacgaatcttttgagcctaattagtccatgattagtcataaatgctacagtaacccacatgtgctaatgacggattaattaggcttaataatttcgtctcgcggtttctagaagagttatgaaattagtttttcattcgtgtccgaaaaccccttccgacatccggtcaaacgtctgatgtgacacccagaaattttcttttcgcgaactaaacaaggccttagttaaaacaccggaaaacaaacattcatttgttttcttttccaatgtactaaagcaggcaatttttttttccaaacacttatacaaatatatgtttcctctatttttatatcctctgttttatgcttgctttcatatgtttcatttttctgcatttcaaacacaggccaaactcattgcactttcatgttaataggcacatataaagggcctcgtgtcattgtcggcccaacacattccatgatctccggcctatatactaccccgtttggaattttcaagctgctgcgtgcataactgggctaattctcaggggtaaagaaggacacaacttgggcataactgggctaattctcagctggcttgtactacaagcccaggtaaacaagcaagtgcatcatctggcatctgctttgtcgcaatggctatatatcaacagaacaaaacatttttcatatttgctggtcggctcctaaagtctaggagctttttcactttggtttttctcatttcttggcctacgtacgtttgcgttcctccgttcagcaaattgagaagaacttttgctccccttttgacacgaaagaatgctgattcctgcaaaagaacgccgatgactaatatgtataagaagtatattatggagtactccagtatatagtactagaatactggagagagatttggaaaagaagaagtcttccgacagcatgctttagaattttatgccatttcgggcagactttgcacggcggcgcctacgtttacgctaccttagtttataatctaactagtcacctttcaaaaacaataatagtttagctagccaagggaataatgattgttgaaatgttgacttatggactttttttgaccatacgtattactttcttttgctttaaatatttatcaaatgatactctattcggtttttaatgtttaatgtcattaagttttgaacatgaccaatcgtcttataaaaattgtgtaggagtacaaataaacaaaggtataagccatttggattaaatgaattgaaaacgagagtaaatggaattacttcccccatgttcttagaaatatgttttctagaaaaaaaatcattcttcttctgtattacctagaacatttgttctaagctattgtgatgtttatttctaaaaataattaatttatctctataataaagtagataatatatagtaataatctagccgataatctactccctctgtttcaggttacaagacgtttaacttaatttgactaagtttgaagaagaaaataataacattttcaacccaggacaattttttatgaaaatatattcaattattgatttaatgaaactaatttgtattattaatattactatatttgtctataaacttagtcaaacttgaagtagtttgactttaaccaaagtcaaa

SEQ ID NO: 38226 - DNA, 11867 bp, Oryza sativa
ccattttaaatcatatcatttttttataaagttgacaaaatatatatacatttaattttttttgtcaaactttattaaatacataagaaatcctgctaaaatttggtaagatttattttagttgatatacgggtcataaaaattccagaaaaagaaaagatttttgacgttttggaccctacaggttttgaccgcgttggcaacttggctcctccaatcactcagaacccaacaagccagagcagacacacagctcctgcaggtcggataaggcggcccagtacatccacgatgcccctcgtgagctagtgacctcgtgtttgtaccactacctgcgtgcgttctatcatgcagctaccgcctggctgatcactcagtcacttgacacttgtgcgcccaattatgcctctcttctcccatcgctcccggccagaagtttttcgaaaatatttatagaaaaatcagaaaatctataaaacggaataccgtcctaatgggatagactaaagatcaacgcaacgtcatccaccacctattacgcgcacgctgattcctccgtgtccccctctgtgcacccacgagccaccagccatccggagctgttcgcctgccacgtcgatcgtaacaccctatttgagctggccatcagcaccgtcctcgagaagccgacaggagtgcagcagcagcagaggctgcatggggctaatgtccacaaggaggaggaagatgagtgtatggattttctactagtttgttgcctgcacctattcacaatctttcttttttgattgttgcttttatttcatggctagggatcaacggctaattgggacacaacgtattagggagaggaagaagaagatgacttgtttggtaccagatgataccgctaggtaccatggtttgatactttttttagtaccaggcctaatatataactactggtcttgatacgtcatgggtatcagacccagttaccactaaccttagtaccatgggtaccagatttggtaccccaagcatctgatctgatacctatggtactagatctggtaccttaggtatcaaccagatatgatacctcaggtatcaagtatcggatcaaacggtaccccaagcatctgatctgatacatatggtactagatctggtaccttaagtatcaaccagatataatacctcatgtatcaagtatcggatcaaacggtaccccaacatttgatctgatacctatggtactagatctgatacctcacgtatcaaccagatctgatacctcatgtatcaagtatcggatcaaacactggtaccagatttggtacatgacagtgcgtaccaggtttggtacccacctcaggtatcaattatcggatcaaacactgataccagatttggtacctgacagtgcgtaccaggtttgaggtttggtaccccaaatatcaagtctgatatcatagtactagatctggtacctcaggatacttggtatcgtatcagatattggtaccagattggtactagacagggacctgacgccagtgcatggacacgtgggggagtagcagacacgtgaggggtattggtgaacgatgcagacgcgtggggacacatggacgcagttggtgggggcaatgactcgttattaacccatcataatctatcccgttttaacgggataccgtggtctagcagttctctagaaaaatatacgtttttcatgtgttggaaccgtgatagcgcgtcagtcggcgcagctccaagatacgggaccgacgggaggtggcggtggcggcatgcacgcttgcacgcccaaacgcccaatcaatcgatggccgaggaaggacaacccagtggccggcgccgcccacgacgccgaaacggtggccaccaccgaatgtgtgctggatcgcgaggacgtacgccgatggagaggaggacggccaggaccccggcgcaacagagaatatcctgaggaattatacagcggaagttggcaggaatcttcagtgtagttcagtggaatggtggcgcatggggaaaaaggtgatcaagccgggggggagatagcggtggagcagagagctagcggctagccaagttcgcagttggggaactcgggatcggggatctcacgtacacggatcggttctggatgcggaagtgcaccgaatcttatcgggaatcaggatcatcggtagatcgatcgatcgagcgtgtcagagggacgtacacgcattattctgtacatgtgcctgcttgcagagtgtgtaagatcggccatgtgctgatgatccggccatcggcacgtcgtacctaggtttcactctttcaagtcttaccctgattaacatgaatctcttggtttcaggggaaaaaacaacaacgtgacagagccccagaaaaattgttaattagtctatgtatgtatgtattttcagtgacagagccccaaaaaaattgttaagcctacaaccgaatttgataattttagttaaaaattacatattttcaaaatttctatacgatttctaaaagatttatatggagttttggagcaagtctaaggctcaagcctaagttctcccgctctgcccctgtataccatcccatgcctctatctatgactctatgtatgtatacattgttaaccgagatcgagaaggaactttcacgttcattctacgacctataaatcagcactcaaaaagatttgcatcatgaaatattgaggatataacggtataaatggataaaaatctgttgtttctatactactaataaaagacagtgatgatggcagctgccaaccaccaccaccaccactgctgctgacatgtggattattaatatagttatgacttacgagtagttgtgtaggagtagttttttaagttactcttctctacaagacagttcttaattttctattgatttgcttcttgcaatcttgattacaaaaacttacaaactttttaggtttttattgtagtttaaaatgagacggacaacacaatttattgatgatttcatattttacaattatatgataaatgcattttgataacacagatggactcatcaatctgaactaaagaccaactatagcattttttttctttttgtcttttaagacaaagaattttgtttcaaccaagaatatttttttggctattttgaataatctgttgcaacgcacgggtttttgctagtatatatacaaattgatgggctgtatacaaattatattcttttgaaatctgttttatatatacaaattgcaattgtatttatggaaatagaaccttatcaggttgtatatataattcaattatacttttaaatttattcccagtcaaatttattcctatcctaaaatcaacctcccactcctaactacattttatttaataagacgtgttgtaaatttttttcttgaacctcaatctttgtgaaacaatctttggaccttataactttgagacaatgtgaaccaaataatattaattttcccatgtttccactggcttttatataaaacgtgaggtattaaggaggtaggggtgggcattcggtctgaccgaaaatttcggtctcggtcttcggtctttcggtcatttcagtctttgaaaagtgaagaccgaatttcaatgcaaaaatatcaggaccgaaaaattcggtctcggtctcggtcctgaccgaaattcaacagcattttcatatatgcaaagaaataacatggaaaattttcaacacaaaaatcacaaaaaaaaattcgtaagcacgtatgagtaaagacacttattagtttcatgcctagaagaagtagggatgtgaaaattagagtttaatcctattgaacttaatggattgtaggttgcatttagatatttttttgttaattcggtcttttcggtatattcggttaaccgataagactaaccgaattgaccgaacaaaattcggtctttcactacctaggactaaattgatgaccgagttcctcggtctctatcttttcggtctcggtctctatcttttcggttcggtcttttggttcagtctttttctacccacccctataacgagggactagagtgtgtttggatgggggagggggtggataggacatggtggcctctttttttatgggtgtttggttggtgggcggggtggcatagggcggtcgggaggggaatattctcccttagatgttggatggaggaatccgaccgttttgcccagacgtagctgctcgagcgcctgggcgagcgaccgaggtgggtcacgtcacccctcaccacgcaagtgagcgaggcggtggccagttcgaacgacgagcacgacgatgacggctgcacgggatgcgaacatggcgacgagctcggcaggcggcactagatgcgagtgtggcggcgagcccggaggccgaaggtgatagcgagggggaagaggggacggcggcagcgggaagaggacatggcggatctggaccaacgccgcttcccgggctcctcctcgtcgggatctggaggtggtagatccggtgaggcagcactgggggttctgccgcccgaacaaggcctcgagaagacgaggtggtggctgccgagcgtgatagcggctggcaagcgaggagacgtgccggccgagtgaggagacggtccagcggctggcaagaggagcaagccgacggccgacgagaagagggaggatgacctctttcttttcctttttctcattttttcccctttcctctttttatttctttgtgatttttcatttctctttagatttttttgtttgtattagatttataattttgtggttttggtgaattgaaggagtacttgccacctctaataaaggggtaattacaaccattcatccatcctaccccctctaatcaaacaaaaaaaaatagatcaccaaatccacattcctccctataaccaaacaaaaaaccgaatcaccatatctactcaaccaaataaaaaaatggatcgtcatatccagcaaaatatggttcgccatatcccatccaatcttgaccgtcaaccaaacgcacgcttaacatctattattaagagagaaaaattggcaagaaaacaagtgtccaactggaaccaaacgtgggatggctaagctccagcagatagctccttgacccgatgttgacgtgaaatccgtcgcacacaaaggcctgagagatctacttagctccaatgcaggttctatcaatcaggttctgggcgtgtcagttagtttgatcctgcaactaacaagatagatagacagatcgtataagatcaaggagtcgatcggccataggctgatgtgatgtagcgaggccagctaatgttaatagggttttgatcaatcggctataggttcaatgtagattcaaataataagataaatagctagattcatgctatcatcggttaaaaccaacttatgttgtttgccaagcaattagggccaatactgttgttaagtaaccacatttattttctatccttgtaatatagattccaaaccttcgatggacttcccaaccagctgtggatcaagaccaggacagcctaaaccatagccgaggcttgaggcaaaaacttaaaaaggttggatataattttatcatgcatgatcaatccattagttatttttaatatgtcatcgaggcaggagaggtgcttccccacctgaattttgcatttcaagttacatttgatacaaaccggccaagagaaacagagaattgctttccatctaatctactattagcggccactcctttccatctttccaatctctcagctcagagagcactgcatcttcaatgcatcgtcgaagtagtcatgatagcgaaagcggtagatttctaatgcctcagaaacaaatttttagtgattgagagggaattgcagaggtaggcagatgtcaacgagctgtcaaatgtcaaatatgggtcttcgcccggacagtgcaaggctgcaactctgcaagctaagcgtagcttaacgtaggtcaaaattgcaattggttaattaggtccgatccttatcctagccgagtgaaccaaaacgtaagcccatcactgatcacttccactatctgcaggtgacgcaaaataggagcatgacgctatcaaccgtagcacaaaactatatcaacaccacatcatatcccttaattagctttcctttttttttctgtgtaaagctgtaaagctatagctttataaagtttttttccctgctatattcaatgtatgggcacatctacgtgccgaatcgttaaaaaaaaaaatccaacgcaacggttaacggagtcagttcgtggataggtgtctcaggtttagccgaatctttgtttaaacagttttgagagaagggaaaatgagaagattaaaaagagagtaattttacagtacttgaggaggtactatgaggtaccactttttctactgtaaatttagtaccttatagtacctagataccaagaggtaccaaattttacactaaatctttagtacctcatgatacttccttaagaactgtagaattactcttaaaaagatatacaaatcgagatgaactattaaaacataacgaattgggtattaattattttaaacctgaaaatatattaatatgcatgatttttaaagcaactattctatagaatttttcacaaaaatgtacattgtttaaccattcaaaaaaaatgtgcgtgcagaaaacgaatgacacttttctttcgtgtttgtctcaactctcaagcatagccttaattttagacgaccattgcatgcatgcagaataatttaagcaacgtgacatcttttgagtgggcacgtagccaaccgttatattccctcaaattttcaagggaaatgtaccgtccttgattttgttattttttttgtcgaggacccacaggaaaccttaacttttgttgtgtacagattcctgaacttttttctttgcttgaactgatcaaaatggggaaatacaaataagttatctctagggatatcagtgtacgtcttgttatattcagtattgttttattattcaatgcagttttataaagagaactggaaagcagagtgctagacgcgacgtcattggttggtcctcccattttctctcatctccaaagcccactttgccaagaactctccacataaaccatagtactatatatgaacatgttttacatacatatatatgtcgcaagaagccaagaatgaccccaacttttgatccttacaattaatttgtctgcttaaattttaaccatgtctatcagtaagattccccgcagtaatcactagcttaacccttattctctatcagtttataactaacaaatcgttagagaaattgtcgtttaatttgaaccgttatagactgctcttcctgtgcaagtatagtattttcgatcctttactcctatctgcttgagtggtaaaagcaaatgtcatccaagaattaaaactgtagagatatatagatatatataccgatatgcagtggcatagaagctgcaaccgctcacaactttattgaataatcaacattgcttaagtgcttaacagtacaaacagtcaacacagtacacatactgatcgacagaagttcacacaacatcgagcttagttcgatgcttggagcaaatcaaatcaaaatgacgcgaaaaactagaggcaaattcagaagtagaacccaagtatacgtagatgttaaggagctagctgatcggcaacacacaatcgatcgatcaccagctatagagcttaaatgcttaattaaaagccttaattaaacaggaacgcatacgatcgagagctgctagttgttgatcttccccttgttgcctatgccggggctgttcccgggagcagtagggcgggagtccgtcgtcgtcattggcatgcttccttgtacggcggtggcggcgccgccgccgcctcgacctgcagctgcatgatcagtcgacgcagaagaagcagtttcttgcactgctctgaagctcccgtcaccttccacggcgacggcatcctcattgccgttggccaccgccgccagcctccgggcttcggcctggcctgagatgacgacgacgatgaagatcagaatgcaagtgcagaataccaccttgtgtccagccatgtcagaatgttaatggagagtgagacgaagagagagcttagtatctagctatcttagctaaagggatcactagctagctagctagctatgaaactgaaggctctactcctggtgtttttctgaagtttcccggggtttgctgtgaagtgcatcctcagtgctcaccactatttatagagggagatcgagagaggtgctgtggtttatatgccgcagtgtacgacgaagtgccaatcagagccccagtttttcacatggggtactaccactatgggtatgtggtagtggcatggtcagaaactatctccgttcatcagcacgtccatgaagttgagtatcacaaatcagcatatctagattcgtattattatgcggtgtctaatgtagtactgggcaaaggcggagccaggattatgccaagagtagggcttaatcactagattacgaacttcttgaataaattttaataagaaaattagcatattccttgtatatattttttctgccaggtatggggctcaagcccaagctaccccacacctggctttgcccctggtgctggtttgttgtattttgggatggacagagtaattgatatcaaatgcatttttggccttttcttgtaagcaatattgagcggatgacaaatgggcaatattgtaagcaatattgagcggagaaaattgcaatattggggctgcaaacattggggctttgctgttttggcactacgagtggatgaaaaatgggcccatctgtgtctatgaaatgtgggtccaatgtcattatagcaaaggttaatgtttgtagtgtcattattgcaaatctcccgattgagcgaggctattgtaactccatgtatcaattcgtggattttttttacctcaatgctactccctcatttaataagggacatctaggtcatttaattccctattaatttatcttttaaatgctacaattgtatcctttttggtaatggtacggagggagtatagaaagatatgagaaacagttgtacttgtaccttatgttagacggccttttagtttgggttgttgtgttgtgcacttgtgctacctcgtgtcgattttttttaatttgtgtgtaaatgaaaatgaacatttataatcattgtaacttgttctattaatttaattatagttagataaaaggctttatatgactataatatcactcgtaattgtttgacatttgttacaccctctgaccattacaactatcaggtttatctacagaacacccgaaaccgaacattttatagcccttaactatcagaacaaggcaaagtactgcccaaggcagtacaaaccggttctaaggatgatttattataattagtgatgcttcagtactctctactggtagtatggtagtatagtactaccattagtattaagggtaaatcagtgatttactaatacaataatacaatgataaagggtaactttgtcatttatgttttttcccggctagatcggtatgtggtcatctattacactggtatcgctcatattccatcaaaaaagccaaaaaagaagtaaaaaagggtttagtcacagttaaatgacgattatacccctccacacttgtttttttttacaataatgcccctcaacatttctactattgctaactaggatagtaatataaatatatctaaaccctttgatcaaatgagatcaacggttcaaattattttctactaccagtagagagtaccgtagtgcgtttcttaatttaatgattttatattctaaataatttatcatcttacttgtatgacacctatagaaagtaagagatgtaaaaagaatagctaaatgtaagtaaatttatattttggatgtcaaaactgtaaaaccaggttatattgcacttaagggggctatttttggctagtttgatagttgtgggtgtaaaatgtccaatttcatcggtaatagttgttttttaagacaaacctagctagtagttcgtggacgtgtaataacaatttatcccttatataaaattatttttccaagcatcgatacatccaaaagcaaatgctccaaacgggattatcataatccaccgtgatagcacatggagcttaagagaagaaaacaaaacatataaaattgtgtgtaacttgtaccataaaaaggttctttaagatatatgtatttccaaataatcagaaaccacattagcactctctaacaagttttaaatcattgtatgcccacaatgggtgcctcaataagaaagtgttccccatgctcacattgtgctccacaaaattctaatatgcgctagaggccacctaattgtatactttgagcaaatatttcagtgaaactagttgaattttccacccaactaattatgcaaggtttatagtttaatcaggattacaattatattttatatactaatcatatgtctttgaaaatacaattgcatttttatacaatcatagcaatactttaacaatgtttggccaatcaacacccttacaatttagactcatcagattaatgtggctgatctttctctctttcttaagtaacctagtaaatttataatcctaatgaacgtggtgattcccttgatttaataatacggtagatacactgttatttttaatttacagatgttccgtgacccagtggcaacgatgattcttgtgtagatactatagattactgagctagtgctttttctgttttgcaacttgacagaaaatactcgttaaaattgcaatgcattcgagaataacatgattcacatcttcgcagaaaatagaaagagtagtacggtagaatgaaggaatatatctccttggttgtgccataggtggtcccttaatttgagttaatctctatgtcacgtaaaaatggttaatttttatccaagttttacttccattctgctccgtccatcaaaataatcattttttgactggccaaggaaattagccttacatggtttagtatatatcatcttttaatcattgcacaaatctgccaaaaaaatctttttaaaagacactgttgaaacgatcattggctatcaacggcagtaccttgtgtaagctcctgcctgatagatacataagtttcctaccatcaagaaaaggtactttgattccttggccaattgcctttgtctcctcaattttaaaatacacgtatttgttgaaagaaagaataattgtattctaaaaccaacaagtacacctactcagtggtgatcatttgctgcaaatttgtttggtggcagatttagatgtgtccgtttcttgtcggggaaaagtgtaggatcaatcttcatggttgggctcactaaggaaggctttacaaatcatcgcaataaactttagtttttctacattgaactaagaattcttagtgtgtctgacgaatgagaggttaacaagcaattgctttgaatgaaaaattgcagattcagactgtaccaatacattttttttttggcaggggacatatcccttaaagttgcagaaaagaaaagtttcactcaataaataacatctaaagaaatgaaaatttcatcttgaaaaaactcatcaaaactgaacagtgaccatgagtggccatctcagcgctgcaagagtcgcttggtgaaaactgaagagagtgagtttgacagtgacatgtaaag

SEQ ID NO: 38227 - DNA, 2060 bp, Oryza sativa
tatcattctaaaatcattttcataatatttcaatccaaatcatttcatcatttcactattatctaatatatatcccgcagtaaagcgcgcacggggcatcatctagtattaaagaatattcaatacccattcaaaaattaatatcttcctttgaatctagctagctgctgggttacttgatattttaagttaaacaatttctgagtactgtttaagttgcatataaaaggattgatattttcgttacagataaaaaaagaaatggattgttaatgtggtatgcagtgatcagtcttattgttgtttatagaaagcagagatacttggtttaattcaaacaaaaagaatatgtgcgtgttgttagcacatacgtttgtactatatatgtttctcagaaaaataaagatagataacttagatgtaagttgtgagactattgtcgccatatattaaaacttctagatcgcttgaagaaacaagaatgcatgttcactcaagggtctttgtcaaatctaaggctataaaatctattttgtataatatagttaaagagagaaaggcataaacctcgatcacaactttgctgccccgtaaagtggttttttgacaggctatctctattataatttgttcaaacacgacaaagctgcttaagttgtaaccttgaaagcaacttcaagttaagaagtgaccgtccaacgactgatgaattatgttggagcaatttttcatttttaaaaggatattcatacttctttagtgtcggtaaaaaaaagtacccaaaagataccaattaatgtcataatgtgggaggtatatatcacatccctaccatattctatgtagtactatatagtttagtgcctaccttcaagcatacatgcatgataaaaaggtatagtgggatccaaatccaatttgtgatttctttgggatcattatatgaagacagaagatggttggtgccaaatagtacaagaagctagctaatttaaaagtcattttgatgctctttctattctttgtcctggacaatgacactcactgatccacatcctgttctatggatggattctagatatgatatgacctctcaaacgaatactactggtatttgactctcactcacagtccacagttccacacaaaaccaaaactgatgatgcatagcatatccctgcagcgaccggcctcagcgtctagctttctacagtgtataacaagtactacgcaaaaggaaatccaaagacaagcaatacacatcagtttatatcgagttcacggccgctgagaacaatgaaactgtcatgcacggtcatactaattattaattagggcagcatattctactaatagtggtagttgggtgtagtagaaattaaatataactatgaattttcatgagtataaaaatgttttattcaaaactgcactaaaatatctttactaatttatctaaacatgctatatgtcatacaaatttatcatggcgctatatattttaattttaattttggaaaaagtacgaatttttccacttgagtattgcggtagtacgatttaccccctaaaactacaataccggacatttaacagcccaaactcttaaaaccggataaattaccaccatagctcgattataagcggttttcagcctacgtggcacacacgtggcgatacagtcagaaaaacaaataaaagctggtggggtccacctgcgcttttcttctctctccttgccctctctctctcttggtgaacataggagccgactggcaggtgcggaggcagccgcggctccaaggccggcggcgggcaagcgcggaggcggcgggccaggagccgaggccggcgactagcgggcgtggaggcggcgggtgaggaaccgacgaaggtagtcggtgatggctggtggcgggcgagaagccgaggccggcggctgccgggcgcggaggcagctgcaggcggcgggtgagaaaccgatgacggcagtcggtgggggcgaaggcgggtgcgggcggcgagcaaggagccgaggacggcagcggggatagctgcga

SEQ ID NO: 38228 - DNA, 1514 bp, Oryza sativa
acctcttcttgacactggcggcggtgcccacggcgagtgtgagctccagctccgccgccgccgcctcctcgtaatcgttggtctcctcggcgtcctcctcctcggggctctgcgtgtactcgaccgccagctcgaccgccagcacgggccacgagccacgggccgaccgtgagccacgggccgccgttccttcggcgacgccgcttcgcctcgcgcctacgacccgtccggccccgtgcaccactgcccaccggccccgggcaccgccgccctccgcccatccgccgccgtgcccgccgctgccgctcgcggtgccgcccacatcctcccctgcaccacccagtgaccgtgagagagagagagagtgaagagagagaggaagaggggaagggcatgtaggtcccacattttttaaaaaatagaaaatgctgactgggttgccacgtgtacgtcacgtaggacaaaaccgctctgaattggatcgaggggggtaattcgtctggtattaaaagttcagggtgaacaatatctgcttttcgagttcagaggtgtaattcggtcgaccgcgatagtttaagggggtaattcgtaatttttcctttaattttagtcctatgaagtttctactacacatagaatcggatgtagtataatagaatcagattcactagatttaaagaaatgaatggctcacaaacattttaagggtaccttaaaaacctaccattactacatactagtactttatgcatttaaaaaatattcttttcttaaaaaaattaaatactactccaatccctctatccctatttgacaatcaaatctgcaaaagatgctgagaccaagacaacaaaaacccctttgttcccacagtaaacctcatatatagatcaagagatgtgatgctgtttaagtgttgcgtgcatgcaaaggtgaaggtgaaggtgaaggagtaaaatgcaaaacgcgcgcggatgcatatatacgcgtacacaaataaacgaggagacaggcagcgatgccatttgctcgtgcataaatgaacaaatagatgtcaatcagacattgatcaacggggagggatagagaaagcattatatagtaaggctgtgtttagatctaaacttccaactttttccatcacatcaacctattatacaaatacaacttttcagtcacatcgtactaattttaacccaaatttttaactttgaaaggaactaaacacagctaactggttgctcggcgaatgatttattcagctaaggcttatatataaactgaaaacgtacttaaacaatgattttttaaacaaagtggcataagacttttatttttttagtcgtaaagaaaccaagattaaaaaaaaactccgtataacacaaatataaacctaagttaatttgaaaattttaaattcaaatttggcctcaaaataccgtcccaagcaacttcgcactctgcagaagctatcatgaagcagggatagcagcagcacgaatattaaatactgt

SEQ ID NO: 38229 - DNA, 2899 bp, Oryza sativa
  unsure (1)..(2899): unsure at all n locations
ccctcttctctccaccacacatgcttcaagtgactaggagggcatcctcctttttaaggaggtccccctctcctagaataagcaaggtgatactaaaatccacatgcatgccatcccatgaggtgggctcttgtgattttccaaagaattaatcttcgagtgggctaaggcccatccattaattccaacaggatccacggcccgcggctacacgaatcaaccggcttttgctccctcgatcgcacgtacgctgccgtgccggttgcatacattgcctgcttattttaaagtatactccggccgtgccctgcagccggccggcacggcccggaacagtttgctcgcgatcgcgtgcacgagtatggattgttccatcatcaatcgagatagtactatggttgtgtttagtttagcgcaaagtttagattttggttgaaattggagatgatgtgactgaaaagttatgtgtgtatgacaaattgatgtgatgaaaaagaactgaagtttagattcaaactttggatctaaacacagcctatatataattaattaagctgatgatttgttgatctaagagaggtcaatcatgcagctaattaatttccttaatgagtaaattgcaaattgggctggttctttttaccagtgttgcaacttaaaccaggcataggacaatgttttcactttacaccaggaaaatttgcataatggttcagtttggtccacttcttcttcaatctgtgtctacagtctccactactactatccccgagcgactcgcgtgcaccatgggtctccaagctcaagcagccatgcacacgcgtcaattcgaggaggacaactcatggatgcatctcgtgctcactcatctgctgttggcatcctcctcaacggggagagaaaagcacagcatagcagaagaaggggggcggcgcctcggcggtggcttgatgctctctggcagtcctgcagcaagtggaaaggagatggagtaggggccgggcgctggccagcccagcagccactattttctaccatcaggggaaattgatgagctccctagattggacaaagtcaagatcagggaattctaatgaggaagaaggctgcttgacatgcgggccactagcccaaaatgccaaattggtaacaatgtttagtccaaaatgaaaagacttgctaatgtctggtccaatttgcaaattaggtaattaaacctagtccaaagtggaattcactcttaattttatttgtcagtagttaacctgttgtgtgtaatactgcatttttatatatagaggtggagatcagtatccctatgaccctaatatatatattcgacattttgcggtgttgcttctgtttgatatatactaccagaggatgtatagactttatatatatcccttgaatattatcgatagtcactactaanaaataattttcttttataggtagctagaattggtttgtttattgggtgtttttagaattgttctgtttggcgtatggatgcccctgcttgtattatggagctattgaaccgtgaatctcaacaagttgttgagtaatcaataaagctttctgtttctcgaaaaaaaaaataaacagatgtaccgtatgttaagagagaatatttttctcatttcttaatagaggaaattgcacgcccccaaacccttacatccctcgccaaccatcctttcatttccaccagtcctataatcgaacactatgcatatgagcatttcctggatgtacaaccccaccctctaaatacaatgtaagttgaactagttcatatgaaaatcctataaaattattgtattttgaatgaaccctaaagttatcatagctgcctttccactttcctaaaataaacataccttgtataggatgtggcacattctagtacagtaaatctagacatatttatgtgtgctagaatgtgtgttacatcccatacgaggttagtttatagtagattttcagctgaatctgaggttttcacaatctttttttttcactccggaaaaacactgtacttaatattagttgttttaaaaaaaaattccaaaacgtgccattccgtgattttagcaggaggcttgaaggagaagaaagcggatagacatggggatcaaagagaaaagcaaaagataaggaaagagaaggaaaagatcatttcttggcctcttccctttcccccctttacatcaaaggacaatgaattgaagccaaagaaagctagccaaggaacgtggcacacacggccaagatcctatagtaccagccaatcgatctcaaggatcccataatccaatagatagatatgtcatagatatatactccctccgttttttaatagatacccccgttgactttttctcacatgtttgactattcgtcttattcaaaaattttatgcaaatgtataagatataaatcccacttaaaatnctataagtgataaaacaaattatagcaagataaattataatgacgtaaattttttgaataagatgaatggtcaaacatgtgagaaaaagttaccggcatcatctattaaaaaacggaggtagtatatatagctataggttttgtaggataatagaagagaattgaagtagcatcactatatgcatagattggagaggcaccaaaaggaaaacatcgaggcttatatgccctgtggtcgtgtccacgaaagtgagcccatgtttaaagcaaaagcaataccagcatctccttgaaaagacctgagcttagctagtgggatttatacatactttgggttaaattcccctgcatgattcctgaattttttttcccttttctctgccatgctaatttcataattagtgtgtagtttgacgtccaatgtacgtatagatcaatg

SEQ ID NO: 38230 - DNA, 10961 bp, Oryza sativa
ttgaacttctacggtctttctcttctccatttgaaccccaattctatcgcctttcttagcatcttttttcatctttgtgaggcctacattggggtagagccctttcttgacctctttcgcttctactacgagttgcgttggatggagtccaacagggtgtctggttgcatcgggttctgacttcgggatggcctgaagtcgcgttatatccccttccagtgcccttcttctcgcagcaaatggaggacgaggtggttctaccttcagatcaaagattcggaccctgtcttcgttgttcccgaggaacaaccggacaagatttcgtcttggaccgcaaagccccctttgaccccctctctccagtcatttatcgacattatcaacgatctctgagtacaaggcttgtcagggtatgaagtcgctgcagacttcattggtaggcggatccagccgctccaggctcgaacccatccagcctttgactattccggaccggaggacgcgacccgggtttctcctcggggtatctttctcgcatttatcctgacatgctcatgttcgcgttcctcttgatttatcgaaatttggttctcgattctcaggtctgaacagcgaagccgtggaacgtcgtgttggccaggtgatgatcagtggtccgacaacggcgagtgccatccccgttcccctttgtgagaaaggggcggccgaacatgatgttgccatcaatgtaagtgtgctcgataggcattctacgttttccttccgagatcacattgtgacttgattacgcataggctcttcctctgactgacatcatcgggctgctcgcggaccatcaggtggtggcgtctttgaaagagaaggtcgccaatgaggcgtctgatgctgctgctgctactactacaagtggtggcaatgttccgacaaaggggaggaagttctcctctgtaagcggacatcgtcgcaaggcatcgacccccttggtaagctatcatgtcgtcagatcgtacagccagaagaatttcgccttacttcgcatcgaccgtttttcaggcctcggacgcgtctcccccgtctccacgacgacaacgccttgtgacggttggtgagaagtaagtagacgaacttaagtttccgtgattttattcgagtgttgtctgaaccatggccgtctcacagggcggcgcgggcgaaggctgcgcaagacgagtccggagggacctccggcgcatcgcccgctgcggcctcgatggatgtcatgctcgcactcgggagccacgaggcgacaccaagcggcccagtcagcgatcccgcggctagccgtggtccaccggctaccgtcctcacctgggagaagctccaggttgagatggggcgcctccttgaggctggtgctcgcggcatcggtcgcgagattgcggaggcgaggtcggcggcgtcgtcggcaaacgagcgggctgatcggctggcacacgagttgtcggaggctcgtgaggacctcaagaagatgagggagttggtggccggcaacgagcgacaatggcaggggctcgagcaccgcatgtcggagctcgggaacaatctgtcagaaatccgtggctcgttgcgggtcgcctatactggtcagcaccagttcgccggggagtgcagtattaagtctactatcccggcgaatcccgacgagttctcgctgacatcttctcttgcggagctggcggcggcgatggaggaaatcccctccaagcatgcggccaggatcggggaggagacatcaaacgggatctacaccggggcgtgccacgtccttgcgtgtgtaaagctggcgcatcctgaactcgatctgcgcgagatcttggatcagggggtggctagcaacacgcataaggaggtgatggaagaagtcggtgatctgggggaatctgttctccccctttttgaagagtagggcctcttgtactcgctagatatgctgtataaaactggatcttaaccgcctttgtgcgagcagttattgttccagcttactcttgtatgttgatcttgaaagcttttttgtcccttgtagagatgttgatgacgaggatatccagcagcgcgggcaacccgagtcaccggcgattattccggccctcacgtttgaaccacatgcgtcgcccgacaatgtagaccagaccattgctacggggacggagatggcgaccacttccttaggttagcggtccattcatcccttttgctcctccgattagatcacctatgttctcagaagaggcgtgtagcctgacttagtcgttcccacactgagcagatctcgagagtgctctcgctggccaagatcgtcgtatccaatattggaagacaaaatttgaagtagcaaaactcgagaggactatgcttgtagtgaagaaagagcaggctgtggaaacgctccgaggtcgtgaggtgtggttcaactcatacttgaagagttgctgcacatccatggacaaggtttgtagagagctccgagtacctcgtggggatcccgaggagtccgtggtcgggtatatctcgtggctgaatggggcctgtgcttaacttgatgacgtcggcaaacgtatcgacgaggccttgaagcaggagtgttgtcgatcaagccgatatgctggggggcacgtgttggcttgcctacgggatcatcgcccgcgcctggacctcgattttctctgtgagggttttgctcgttctcggaggactccggcggagatagaccacctggcgaggttgatggcgccgttggcggagaagatcctccagtctatggattggcgttggccttcttggtagtcttcgtatcctgtgatagatatctcaggaaaaaggtgtaatatagctttggatttgtgtaaaaactgtaagaagtattttgtgaaatagaaaagaaatctatctttaacaaatctttcttacttcggatgtcgtgtgtaagagtgtgttctcagttcgcgactttagtcagtcgtttgagtcgtacactctccctagcccccagccttgtcgtcggaggaattttctcggaggataaggctcttggacctttgacctgccttggttgaataagctctgatcctagcccccagccatgaaattggaaacttaatttccgatttcgcggcttggttaatacgcacggcgagaactcttacatgaccagatcttacatggtctttcgtctctatcgtctctacaggatctgacaaggccttatcggctctgggcgtccccagccgaagatcccttaggttcctcggaggccttgtcgagacggcgtaaagggacatgaggataggtttcaactctaggtgtcatcagggtaagggatcatcgggcggaaacactttgattgtaatatgggcctaagaataggctttattgatactgtaaggtgccttacaggtacggatggtattgactcatacatagaatttatgtagttggtcaatgttccaagaatctgttaactcgcgaccctcgccgtctgcaattttgaatgcgcctggccgcaagacttatgtgatcgtgtatggtccttcccatttgggtgagagcttgtttcgccctgcttggctttgaacccgtcggaggacgtagtcgccgatcgaaagtatgcgtgctcggatgcgcttctcgtggtaacggcggagggcctgttgatagctagttgctcggacggcaactcgttcacgatgttcctcgagtagatttacatcgatgtctcgctgctccacctggtcctcgtcggagtgcttctgtactcgtgtactctgatgtcgtagctcgctggggagcatggcctcggagccgtacacgaggaagaagggtgtttccttattagacgttgtcggtgtggtgcatacggcccatagtactgatgggagttcttcgacccattttttgtcatgtgacatgagcttgtcgtagacacgggttttgatcccttgtagtactatgccattcgccctttcgacttgtccgttgctttgaggatgagagaccgaggcgaagcatatcttgactcctagcccgatgcagtaatcctggaaatcggcgctgatgaactgggagccgttgtcggttatgatgcggtgcggtagtccgtatctacagaatatccccttgatgaatttgatggcgttgtcggcctggatttcccccgtgggtactgcttcgatccacttagtgaatttgtcgatcgccacgaataggaacttgtagccgccctgtcctcgtgggaatggcccgagtatgtctagcccacagcacgagaaaggccaagtaagagggatagtctgaagcgcttgcgcgggtagctttgtgtgtttactgtggaattgacaggcttcacatcgctggaccatgtcgcatgcatctttgagggcggtaggctagaaaaacccttgtcaaaaagcttttccgaccaatgtctgaccggcggcgtgtgacccacaaatgccttcatgtatatcaaggaggaggtgtctgccgtcgtcggacgagacgtatttgagaagtaccccgtttggcgctttcttgtatagatcgttgccgaccatacaatagatttttgctttacgggttattttcttagcctctgtatcgtcctcgggcaactcctcgcttgtgatgaacttgattagtgggatgcgccagtcatctgtggtctcgatatcggcaacggcgtgttctgcctttgtggcctctgagctaatgtcgggggcgttcgggctaactttgccgctaacctcttttactgatggctttatcaggatgtccagaaaagtgccgggctcgagcggttttcgtctggacgcacgtcgtgctaggtcatctggctcgatgttgtctttgcggtagacatgtcggacctcgatcccatcgaaccttttctctagcttcctgacttttgcgagatacttggataactcggggttagaacatttataatctttgtgcacctggtttgcaactagctcggagtcccttttcacgattagtcgcttgaccccaagtgtggctgcagctcttatcccggcgagtagtccctcgtattcggttgtgttattggtcgccctgaagttgaggtggattgcgtgcttgaattgatctccggagggagacgtcaagataaatcctgcccctgctccttggctgttgagtgtgccatcgaacgccattgtccatgttacgttgtcgacttggttgtctgatttgttatcaggcgtagtccaatcggctacgaaatcggcgagtacctgggacttgatggctgttcgtggcacaaagtggacatcaaatttgctcagctcgactacccatttcgcaatgcggccgacaacgtctttgtttctcacaacttcaccgagagaaaaagacgagacaactgtgactctgtgggcttgaaagtagtggcgtagtgtcacgccctgataaattcatcccgaaataaaaatcattttctaaaaggaataatagaattaattaaaattcgaaaagaaattggcaaacactaaaatgcgtacaagaaaaattcgaatgtggcccggagaatttttgttaaattctccttggtctaaaaggagccctcaaattttacttgaattttcagagcaccggaaatgattattaagcaacaaaaacaattatcagagtttattaaaaagaaaaagctaaaaataatcctccttttcctttgggccaagtttggcccaaagtcctccctctctctctctcagcccgcggccaaagtctccctctcctccctctctttccctcctctcccgggcctctcctcctcctcccggcccacctcttccctccccctcccggcccactccctcctcctccttcctcccggcctgcctcggcccagcagcccggcccaagccgcagcgccctcctgccctagtcgcgcgcgcacgtgcgccgcacgcgcgttgagcgcgcctcccgcgtgggtcccgcctgtcaggcgcgcccccaacctccagccgccggcctccttcctctctctcccgtgaaccctagcgccatttcctcctccaaatccgtcctgaatccaaccgttctttccaaattgattggggggaattaatccccattccttcctctttgatttcccccgttttcccccttgaatggctcccccaatcgccgggaacggacgcgccaactccggccaccttccatggccgccggccgtgtttcccgtcgccgttccgccctctcccatgcccggctccctcccctccgctataaaacggaatcccctcgctccgttctatcgttttatccccctcccgcgatctcccgtggtctctagccacctccccgccgtcgtcccctctctcccgtgccgccggccgtcttcagccgcccctgccgccgcgtcagcacgccggccggccgtgccgtcgcctcctccagcgtcgcagccgcctcctcttcgccggcctaccatctgtttcccgcgaagacctccggaagtgcatccccaccggcaacagtggcgttgccgccactgttccgcctccggccgcctctgccgcgtcccttgtgcgccggccgacgtcgccaccacctctcccggcaccggaacgccatcctcttccccggccaagccacggcgtcgcccgtatttcgccggaacgccgtcgcgcgcgccgcctctccctcggtctcgtcggcagcccctttcgccgtgccagtgcgccggccgacgtcgccgtctccacctccggcatcacagcggcaaggtcgccctcggcctcgcctccccttcgaccgaaccgctccgcggtccatcgtcgtcgtctccgttcgttctcctcgtcgacgtcccgtcggtctcccggctcgtcgtctcgctgcgcctccaccgtcatcgtcatcgcagcggcgtgttccacgccgtcctcgtctccgtgcagctgctgctagctgtccctcgtcgcctcctcgccggccccggtcgtcggcgtcgtcgtcctcccgtcgttcccggtcgtcgtggcgttcgtccctccgtcgagccgttctcgtccgtcctcggtgtttcgtcaaggtcgctgcagccccgtcatcgtcttcgtcctcgcctccgcgtcgtcaagcctcgtgccggccgtgtctcgccttcgttcaaggatcgccgccgaagtcgttccctcgccgtccgtctccgccgcgtccgttcgtcgttgtctttcccacgcctcgtcgcgtggtggtaaggatctctcctctcgctgccccgtcctcgtcctttcagtgtcgccccgtacccgttgtgcggttgtcaaccccggtacccgtgtaccggtgtcggtagtcgttcacgtgtgcgggtggtgactgtgtagtgtccgtgttagtgtgcccactcggtagccgcgtggtttccacgtgtgcaggccgtgtggtgtctagtggagtccgtttgtcggccactcgcctcggttgacacacggggtccgcttccgtcgacccgtggaccgtctctatgtactcggtctaccgtggtcctttaggttgacatgtggggtccgcatgtcaacagcgcagccttcctgtcttttccaggctagtgcttccacatgttttatagttgaaaaacctaattataataatccgcaaatctccatataacagcactaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttctcgaagcgtggtttgcggtcgtcgccgaaggttcggaaggccgttctctttgagcaaggcaagtcacatcatccttgagcatattgaatcccagtttataaaattattttgatttaaattaatgcattaacgctttatttaaattcccgcgttatcactgttttatttagccatgcctatttacctttgttaagacattattattgctattgttattattaccttgttcaccctagaataaacaaaaccccaactagtgggtactctattcatggttccactagtatgaatttaggtagatgcttcgctgattaataggacaacattaggtggtttttataactttagactttgggaatattcatatctcttggatactatggaatggttggcttatggtggaattggacatacccctctcttcctctttcaaagcccctaaaacctgtttttcggtggggtttgggtgcatgccagttgtgggaagtagcaccccggccaatataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggctcggtagtcgagatgtcatggcacagggctggtgtcctgctgctaggggctcaatcctgcctgcctgtcccgggggttccggctataggtggggttgggtcggtactcttgtttatggctaggatgggttgggaactatgtcacgtcttccgtccgtataccgtggtggtatgtggcatgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtgtagctctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctcaatcttcccccccccttcagtaagagaagctttggagaaaaagtcttaggtggaatcctagcttataccccagttgagcgcctgtgaagatggagccgtaggcctgctagtccgctgctgtttatttttgattgtcaggccttaagtgcctttgtaataatgtaaatattatcgatataataaagatgtgccttttgtaccatgtttgtgtggtgtaccccggcttttcctgggacggggattaatacactagcgttcgggaaaatgtatttttctcggtcgcgacacgtagcttccttgatgtcatgatgaccacgtaaagcagcttttggatctgtggatatcttgtctttgcgtcgtggagagcttcgctgacgtaatagactggtcgttgtactttctccctctcgacaacaatgacggtgctaacggaatatggtgtggcggtaatatagaggaataattcttcattaggttggggagcaacaagtacaggggggtttgataggtagcgcttgagtgcaacgaatgcctcttcggcttcctgtgtccatacacatttgtcttgtttcttcagcagagcgaagaaaggttgtcctcgttctcccatcctagcgacgaacctgctcaatgctgccatgcatccggttagcctttgtacttccttgagtcttgtgggcgacttcatgttttcgattgtcttgatcttcttgggatttgcttctattcctctgccagagacgaggaaaccaagcagcttgcccgacggtactccgaacgtgcacttctctggattgagcatgaggcgatatcgtcggaggttgtcgaacgtttcccgcagatcgtcgatcaatgagtcgcctgccttggtcttgacaacgatgtcgtcgacgtatgcctcgacattgttgccgagctggttgctaagtgcgccctggaccgtgcgctggaaggtattccctgcggttatcagtccgaacggcatcttaacatagcaaaataccccgaacggcgtgatgaatgctgtcttctcttcatcctcttttgccatactgatttggtggtagccagagtaagcgtcgagaaaactcaacagctcacagccggctgttgagtccaccagttgatctattcgaggaagagggaagtgatccttggggcatgccttgttgaggtcggtgaagtcgacgcatattctccattttccgttggccttccgcactatgactggattggctagccactctggataaagtatttctctgatgaagccagctttgagaagtttgtcgagctcttctcgtatggcttgttttcggtctggtgcaaatctccgcagtttttgctttactggcttggcatcgggtcgcaccatgagtttgtgctcaatcacctccctggggacccccagcatgtcggatggctgccaagcgaacacgtcagcattgtcgcggaggaaggtgatgagcgcgagctcctatttctcgcttagtgtcgcaccgatcttgacggtcttgttggggttggcactggagagtggaacgatcttgattgcgccgtccggtttcggcgtcttgttcgtcttgctcacttacttgggtggcttagtcgttgcgggtgggctgggtgtttgctcgatcatgtcgaggctccgtttgtcgcactgcaccgccaactttgcgtttcattgaataataattgtgcctttccgccccggcatcttgagcacttgatacgcgtactgagatgcggccataaacttcgcaagtgcagttct

SEQ ID NO: 38231 - DNA, 6276 bp, Oryza sativa
ttcgtcttgctcacttacttgggtggcttagtcgttgcgggtgggctgggtgtttgctcgatcatgtcgaggctccgtttgtcgcactgcaccgccaactttgcgtttccttgaatagtgattgtgcccttcggtcccggcatcttgagcacttgatacgcgtagtgagatgcggccataaacttcgcaagtgcagttctcccgatgatggcgttgtaagctgtatcgaaatcagcgacatcaaaggtgatctcctccgttcggaagttgttggcttggccgaaagtcacaggcaacgtaatcttgcccaatgatctggacgaggattggggagtaattctatgaaaaggttgatcggttggtgtcagcgagttcccatcgcgtccagggtgctgatgaaaagaaggttgattgagctgccaccgtcgatgaggacccgtgcgaccttgatgttccgaatagtgggttcaaccacgatcggatatcgtcctaggatgacggcggtcttggggtggtcttcttccgagattctatcttctgttcagaccacttcatcttgggtgtagccccctgccatgtctaacagacttcgcgttccactttcttgtactctcgtttcgaggagtatgttgtggaacccccgaagatgtgtgaaacgtggaggtcagagtctggatatgctgagtataattcctggggagccgcctccgcgtcctttttaaccacgcgtactcgtttgcctttttcagatgcaatgtgcttctcgagcgattttttgaaaacaaggcaatcttccaaggaaagtttgtccgtcttgtgcatggggcaccatgctttttttgtgtcgctactttgtgggtctgggcgcttgggaggattcacgtattttgctgcgaggacttccgcttgagctttccttttcccatttttgcgatttttcttcttgcttgactcaggtgcgtccgtggccgatttcttctctcccccgatcttcggcttatcgttcttgcgtcttagcgcatcatctgcgtgggcgcatcgctcaacaatctcgaacaatctccgagtggttgtgatgtgtcttgttgctaactcctaggtagtatagcgatctctgacaccggatttgaaggcgcgaattacagaagcgtcggtgattttggagattgtatttctgcactcgttgaagcaccgaacatattccctcaaggattcacccgagttctgtgtcaacgcgtgtaggtcgtctttgatcgcgtggcgcttgtaagttccttggaagttggcgacgagctgttgccacaggtctgcccacgaagagattgagtagggcagaagatgcatcagccacgaacgtgcagagccttttaatgcagttggcaaataattcgccaacgcattgtcgtctgctccggcggcgtagagtactgtggagtagacttgaaggaactcctctgggtcagtgctcccatcgtacttttctattgctccaggtcggaatctctcaggccatcggacatcacgcagggaacgactgaaagccctacacccagcgcggggggcggtgggttgtcggcgatcatgtgtccttcgtggatgtctgtctgatgatgaggaagacgaggatgatgacgatgatgatgggtcgcttggttccggcgtccgattacgaggatatcggcctggatctcgagaatcctgtcgtcgtcccccgctattgtcttggcgccggtctccatcatcgtcgtcgttatggcgacgtcctcgaccagtatcgtctggcacccgccgttcgcgatcgttgtgatcgtggtggttgtggcggttatcacggcctcggtcttcgtttaaacggtcccctcgatcttcgttatcagggcgccgtgaagagacatgacgtcgggaatgattctcgttgtctcgtgtgcgtcgtgcctctcggcggccgttgatgtgatctcggagatcgctagtgccgcgaggtggaagggtagctcgctgaggcgattccctccgttcagggttttcaccattggcatcgccagttggtggctgctctgggtgcgctgcggcagcgacctcttcgaacacgttgctgaggttggtcactgattcccgtagtcgctctgtccaacgcgcgagatcgtcgttcagaatgagattgtagggggtttccctcagtatagagttgacgactctgatgtgctgggctggagtggtcaattgattctccacttctgcattggtgcgtgctgatgtgccgacatcatcgatagccaatacctcccgcggcgcgctcattgtcgatgatccatagtcttcgagaaggtgcaagactgatggttcgtgaggatcgatattgattaccccaacaaatcgatctgaagttggcgtcgctcctcggtccttgtccttattcctgatggggatgtgtgactattggaccttaggggatggcgctttcatggcgctgagaaagaccttgcagtctgagaggtcgtgattctttgtcttgtgaataggacaatagacatcacgagttggagaaatacgctgaattccacgctctttgcaggcgcgaatttcagcgcggacgttgaggaaaacccagcaggcttgcaaagtgtgtttcctggttttgtggataggacaccaggaccttgttgcttcggaagtcatcttcctcggctcgcggttcatgtcggaacgacaaggtttggccgcatcagaacccttctcgagctgggatgtcgtcgatgctccgttctccgcctcggcgggaggatctttcgacatggagtcgccttggtttgtagccactgcattcttgtttccggtcattggcggaccggttgagatcggcatcgtggtgcaaaccgggaagacgatttcgccgacttgagtccataccagcatcgttgaagcagggaatacttggctgaggttggcgttgacgctgttatcgactaggctggatgacatagtagtagaaccttgagtaccaagtccccctacctggcgcgccactgtcgacgggtgatacccgtagaccggatatagagggtattggggtacattggtacaaggatctacgtaatacgacatgaagtagacaaaagacgaggattatactggttcaggccccttggtaggtaatagccctaatctagttgatgtgggattatatggtggaaaacacaggttacaaagggaacaatggaactttagggatccgacgagatcgtggtcgagttggttcgactagatccttggcgatttggctccttgcaggctccgatttcgtaggctgtgagggttgtgttggctccgagattcgatgccccaggttcccctcggggggtcccttttatatcgcaagtcaggcggtgttcaagtagaactcggagataacagaccctatacaatacattgacaacccagtcttgtcgagtaggactctttccatccgtagactccgtgaaggattttcttagtgtacacaggaagtatccgtatgcgcgtaggtataccctaccaatatgtaacatatatcgaaaggtaaagggtatgcctaacccggaacctgcaagaactcgagttacttctgtactccctccgtcccacaatataagggattttgagtttttgattgtaatgtttgatcactcgtcttatttaattttttttttgcaaatataaaaaacgaaaagttgtgcttaaagtactgtagataataaagtaagtcacaaataaaataaataataattttaaaaaaatttgaataagacgagtggtcaaacattacaagtaaaaactcaaaatatcttatattatgggacggatggagtattttcttttggttttttccgagtgaatttgtgggactgtggagtactgtactgagcacttgtatttttgttggttttaaattagtcttttgcccttcggtccgattgaccaaagctgacttgacccagcggtcgtctcctcttcgacctctctctcattctagagtcattgcatagtgacgaaactgcgattcccctgattctttttcattaacagttcaagcacactagtaaaaagccgttcctttggcaatacggcacactcgaatgagtttgatcttgcggtgtttcttcggagttgaaaaaaaaaggtactcctacctcgctaacgttaggcccgagcacgaaagctaaagataaaagcggcgcattggtggtgcttgaattatagtttcttgatataagatgctcctacaaagaaaagaggttgccatggggtctgtgcaatgggccaaaacacaagcaacacatgagcagcatttgtaactgctgctgagttatgcaggcacggtgtgacaaatcagctttgcatgcttattagtcttggtcattagcaaaagtttgatttgatgcttacttaccaggctaccagctagtagattgatatatctagtgatggcgctggcgcaccacggttggcatgcatgacgtagtcatgataccactctccgtttccctctccacatgttcccctttggcggtaatcaccattgtaaaggcaatcattaggaggcaaccccgctgtctttgcttggtgaccgaggtgattaaaaggaagcaaaggcgccacagcgaagaaataatctattccaaacaatacacttgtagtagtagcagcagtagcagtactgttggatcaagccatgcaggtatatcgagcaagtggcaccattgttctgtgtggcaaccgcctggcagcgaacccccaactgctaggtttctgatcccgagacgaatcacatcctcatctctctctctctctctctcgaattttctggcgcgcgaattttaatgcaggggccagagggggcgcaacggcacacagtaacacagtaagagcaagtttaatagtatagctaactactagctttaattcatctatagccaatctaatagctcatctatacaatagttacatactacactattaatatctggtcccacctgtcatacacactgcgtcttggagtccgtgatatagttggctataaatctatagcccgctgctcttctctctctttatttatctttttaaaatatgtttatagctggcttatagcatactattgtacatgctctaatcacgtcgttttaaacccgtgtgcctctgttgttgccacacgcatccccacggagcgcggtcaaagtggcacatcgaacgcgtcagtgtgttgtacggcgcgtgcagccttaaaccgcttggtctcttggctggctgcttttggttgccttgatcgagcagtgcttgcagtagtacagcaagttcacttgtacactacggagtacgcttgggttgctcgagcagcaacgcaccgctgggctggagccggcgaaagtgaccgggcgaaccacaggctcttgcagcggacagatcgatgtgttcctgagaaagcagcagcaaatctttcacgaaaggaggagaaaggcaaagcgcggccggctaggtcggcacagtttaaagccgcgcgcgccacctaaagccatccccagttggcatgggatggcacggcagcgtgtctggagtgggaatatggttcagccgaagaatttgttttcagtttttggtatttaggttatccaaaactgaagatcaaatcatgctatgaaactattaatatttttttggggccagcggcagatgcctcaagtagattttatgtcaagatagaagaagttcagtacatagaactaacaatcattatctgttatgattcaaacgcgtcccaatcgataccaacccattagagtgaattactacatctctctaaaagttatttttagtgaacatcaagtgacatcttagatagcggactagccaacctagccgcagaccatgcccaccattctccatgaattccccgggctattttccacagccgaaaagttgccaatactaattaatttggttttgtagcttggcttggtattttggttgtcatgtaaatgtttgatagctttaggcagggcgaggagggcgtagacattgggggtacggcgggtggcagcttggctcggcctgtggcaggcgacaccgtgggtgattcatgtgggtgtgggtggtcagtgggatatatgggaggactagtcgactatgaatttaggtttattgtatagggtctattgggctaaaggcttgtttagattattgccaaaatcaaccataccaatatttgggggaaaatatgtagtgcaaaccacatatgtagtg

SEQ ID NO: 38232 - DNA, 10327 bp, Oryza sativa
ttagatgccgaatttctattttttttccttaattgtatatctatatggatcccatactctacttctaatattccttatttttaattccgaatttctattatttcctaattttatttctatatggaccgtatactctatttctaatattccttatttttaattccgaatttcaattatttcctaattgtatttctatatggactctagtctcctcttctaatattccttatttttttaatttcgaatttcaacaatttctgaattgtatttctatatggactctagtctcctctaatattctttattttttaattccaaatttcagctatttctaaattgtatttctatatggactctgccttttctttttctctaattaatgtgagaatttctaggtcatgagagcgaacatggaggttcctttttttttccgaattttagttagttttaaattcctatatagactctatactctacttctaatattccttattttttaatttcgaatttctatttttttcttaattgtatttctatatggactctatactctacttctagtattccttatttttaattccgaatttctattatttcctaattgtatttctatctagactctttactctacttataatattccttatttttaattccgaatttcagttatttcctaattttatttctatatggactctggtctcttcttctaatattccttatttttaattccgaatttcagctatttctaaattgtgtttctatatggactctgtattttctttttctccgattaatgtgagaatttctaggccatgatagcgaacgtggaggctcttttttctattcctttaattatataatagattctacaatatcccaacaaaaattacaaattcaaatatgaaataatattttatcgaaggacaacatccctaccctttcatatgatgtgaatcaacataaaagtatgaaacaattcaataacgcatgttaccgcatcatacatagtttttcaaacatttacagctaattagatatagaattaattcaagcatgattagtccaagtcacgacatagaaaatttggtgcctttagttcaaggaaagatccaatcactctatgaattttttgaaatttgctcgagtaatcaagcaagcctaatagtccttatgtcccaaaataagaccaatacagaacatgaaaagactaaaatacccttactacatcaaatcctaatgcaattatgcctctatttttatctatccccaacatatttatcctctagttcaccaacttcgatgtaatgattactaaaattaaacttatttggaaacaaaccggatggcccaaaataaagttattatagaacagagggagtaatcttttacgtaagtcctctaaaatatgttctatgttccaatctttttttttgagaattacacagtacaacacagatactcacaacgcaaacacactcacctctatgaacgcacgcacgcacgcaaaccctacccatatgagcatcttcgaagactaggccggtaaatccttgagattgacgaagtcatcataggcgcttcgctgtcgacgagtacgtctcctactactaaaagcacaactccgttaaatcctggaaaattcgctcgcttctaaataattatctaaacaatgttgttgagcattatttaaaaaaaatcatactttttaataatggcataaataattcggttgattttctacccttataaacgcaggtaaaatacatgcccgagtatttatacgggttacctttatagttaattttaaaaagtaactatcattacagacacatgattatatattataggatttttacataaaactgtgtatttccttaagaaaacgtacaatctaaaatccgtttattccggaagtggcctaaacatatcaggtgcccacctggaagccaccgacgtgacataagtataggaggcagcggcactttccgtcttccctttaccttgcaccttaagtaccagccagatcgaactccaatgcttgatccatgatatggtaaaggcaagcacaccaccactaacacatgacatgatacggattagcttgcaagctacccatcgcgcacgttgcccagacacgacggattcgttctatccaccacactccaaaaccccagacacggaccgagaactcaaaggccaacccaatccaaaccaaccgcggtgcccccactccacccccgcacactgaacacggtacagctgttgccgcaacacgcacggacgctcggtcatgctcaccatcaaattttgccggaagatgcgaaaccaccgagccgacgccgagccctttccgcttaaaagcggcctcgtccttccgccccgaaacaatccgcggtcacatgcaccgcccaactccccaccccacatgccccgcgcccgcgcccgcccgcgcatcgccacggacgcgcaaagcggccgcatgcgcaagcctcacctcgccggcaggtacgccgcgaatgcgcttcgaatcctttagccccattttgattcaaaggaaatttacaggaattttaaaggatttcattcttataggatttttctatatatccctttgaatcaaaggaataaatcccatataatcctatgaaattcttatagaatgcctctttctatgtaagaatcctttgtgtttttcatgcggctcaatcaaacggtcattcctatgtttttcctgtgttttgtatttccctgttttacacttatatttctgtcaaaatcctatgtttttcttattactttggttttttttcattcctactattcaaaaggcacccttagtgtgcatcatggccacgtcgccgtcgtcggttagtagtactacgtaccatcaacactactactatctcgcaatgataaaaagggagggcgggtgtgcgagggggtggagcccatgtcatgcaggggccgtggggagctggggcaacgaacattacttgtcacgggctccagttgacaaaaggcaaacggatcctgctgcccgatcgtgtttttggcgaaaaggagccatgggggccatctcgtccgttttgcgcgctgctcgctcgtcggctcgttcaagagatgaaacctgtctatctatctatcggccatcgcaagcaaagcctctccacttgcaaaaggaactggttagtaggacactgtcatcatcgggaaaatgaccttaaaaagcatgagcctcacgttgctgcactgatgttgacggcactgttgagtcgacaaacaggagagcatagcaagcagaggctgatcagcatttgggaagtaataagatgttactagcagtaaacatcaaggaaaacgttgacatctcccttcgtccaaaggagaccacggagtttgatcgatttcacacgcaaatctgacaggggaacactggtaaattacagaagcatagaatgttttgctactatcgtacggtgggcgcgagcaggcagaaaatcgcagagcaagacagcaacaaggccagtatgagttcactgggcagcaggatcatcatccacgcagcattcagtcacctgcacacagaccagatgacgttttcagtaagaaatcttcagacattgcaggatacagacataaacacgcacgaagtaattggggggagatcaagtagtcgtaccattagttgatcgagaactggccgccgagaagtcagaggatgccattggtatggagatcgacagttgggtgcctgagaatgacgaaagattagcattctcatcagcgaggtctgaccatgaatcccttccctttggccactcatcaaagaagggacgcagcgtctggttctcttgcttcacagaatcgacagccgcatagtcgttcccaaagaacgaaagtggctgcctctgaacctttgaaagtgagctgggggtgttctgaccaaggtcacttagtgcccccagctgagaatagcttgaaaggggaaatggcgagttctgagatggcagcagccgccatggattttcaatagatgtgttgatagcttcagtaatgagttgactctgctcatccgccaaagatcttgtgccataagcagtatacctgaatttgagaagatacagtgattgggaattagtaggaaacacgaatgcaagtgctaggcatgtacctatcgaaaatatgtcaattctaactttttagaacagaattaggaagaaaatattcataagggctcaattgtaagaatgaaataaatccatgtaccggaggaaatgtagttaacctaagtccgacagataaactagaaagaatccaaagcattattatcatacaaaaaaaataaaattaccttttccaaaagttagtattcttgtcatgaattcatataagaaaacatagaaccatggtttaactaatcatatatagcagcagatcatggcccaagaaacattctattttgcagtaaaaccagaagacagtttagttgcagcagcaagtcagctgaaccctaaacagttgatgacaagagcagaaagaaaaaaacaatcaaagactaaggtgaccgaataattcaataactaaactaaaccaaatcaacacgaacaagcactgtagagttatacatttggtgaagtaaataatgaggctaggtactaaggtcagactgagattcaccgaagataaatcaaagagttcctttttttttgtagggaagataaatcaaagagttgcattgttaaaatctaatcatcaacattggatgagtatagagttgacttggagcatcatgcagctcacgctggccactggaaaatgtttcaggtatagtggtgatcggtgagacatcttcagagacagtattttgcaagggccaaataattgactgcccctgaagagcagagacagaaacaactggattctgtggaggaataaagaagtggagtaaatgccaagggaagccatgatcagctaccagcaggcacaagcactgcgagggcagacacaaatatgtagtagtatcatctttatggacagtacatgtttcaaactactgggccaaagccatgttaagaccctgcaccccagtttcacctgagcagaaatctcttatggagactgtccccggcttctggggctgaaaactgataccagaaagtatgggaagggcaaagaggcagcactctggaaacctaaacataacacaaatttttgcagtgcagagagtaaagtttcagactttcagtgattgcagcaccaaatcgaagtagtactactgagcatggacagctgattcgattgccaccaatgcaaacaaatgggacacagttattaaccgatcacaatgaaaaatacagattcataactgcatccacctgacaccaatcagttagagcatggcaccttttttttagacaacggaaggatacatatcatgattcaagacagtgctaaacaagtaaatatggcgtttgattaaaaaaaaagaaatgaacaatcacctgagatctttgcctgttccaccaccaacagctgcataaggggcagcattatccatgtgcagctgagaacccaacgccgagccaaatgagctgggcatgttcctccccccgcccccgccattgctgccggcaatagcagggtaaagagagtggttttggaagctgctgccattggaggcagcagcaaggggcgccgccgcagaaccgacaacagatgagggcggttgggactgggcgaccagctgcgtttccacaggctttcttgaacggttgcggccgcggtgcatgtggcgctcgcagtacttggaatccggcgcggcctccttcgagcaccgccatttcttgccgtccgtacgccggcaccgccctggctctgggtccagcttcttgccgaagtacggaccatatccaactgtacaaaaacaggcacatcgtagcaaccgtgttacacacaagaatgcatttgttggtaatgcattttgagttcctaatagaatggcatttgaatatttgagaagtccatatccgatccatatgcagggcatagttatctgttcttagcaatcgctcaaaaatggcgagcaaaaaaacagtttgccagggtgttggttcacagagaaaatggcttatcccatgggcatactgataaacaaaagattttatttcagacaagagcgtgtgcacgtcctctatcagatcaaacagagacagaatgatgggcaaacttccccccccccccccccaaaaaaaaaaaatgatgcgctaatcgtgaagcgagcacgagttttggatttaaaaacaagcctttttattaccaaatccggaggatagcataaaaacacacacgcatgtttcttgaatcgcgtaacccggattaacaaatgacccggagccaattaacaaatggaagcaaagtacgcctgatcggaataaacaaagaagccgacactaaacaagcatccaaaagcaatgcagcgatggtagaggagaggcaagaaataggaacacgacgtacgggcgggatggttgtagaagcgggcggcgagggagtcgagtccgcggcggatggggagcacgagatccggcgggacgggcacgcctgccaccaggtacttgtatatgagcgcctgctgctccagctcctcgtactgcgccgcggtgaacggcggcagcctcgccgccgccgccggcggccacctcgcggtcatcggcgcgtcctcccccatcgcgacgccaccaccgcccctgcacccacccacccacacacaacgtctcaccgtgttgtcacatgcaccactggagccaagaaaatgggttgtagccgcgggttcgcgttgcttacgcggagagcggggtggagcggcagaaggggaggagggaggcggtcgcggctgccggggacgagcggtggtcggccaccgccggagacagggaggcatacggcatcgccatcccttccctctctctctctcaatctctctctcgctctcgctcgctcgcaacgcaagcacacgccgcggtctttagtaatggtgctttgcttcgctcgctcgcgcgcgcgcctttattgcgcggcttgtctctctctctctctctctctctctctctcccgctgcgcctgcgagctctcgaccaggggcgaggagtcgcggacgtcgagcccgacacgagaaggcgcgctccgacccgagctagacgacaaacacctgcctccccccgggcctgtcgacctagcggacgtagcggcgtggtacgagcagtagcatttccattttctcctctctctctctctctctctctctcgttatctcgtggcgtagtacgtacagcaccgatttttcttcgagtacagtgcgaggctgcgtttgtgtttggtttgctgtatttttatttggaaaatgggggaatggatggatagatggatatacatgcagagacgctgtagtgggcagcgcgagtagtgacaagtattgcgtggggggagagaggatgggggaggggggtggaggggactgtcgatttgggctgttccattgttgcggttcccaacgccggagcaataaaaaggcgatgagaggatgacggagcaaccgtcgcagttgcttttcgacctgccatttttttgctactgttagtctgctgctccaacatcttcttgcgtctacatagagcgtgtgcatcggacatcttgaaggaaaataaaaagagttttgaattcagggtgtgtttagttcacgctaaaattagaagtttggttgaaattgaaagatgtgatggaaaagttaaaagtttatatgtaggaaagttttaatgtgataaaaaagctgtaagtttgaaggaaaagtttgaaactaaacttagcctcggtactactccatagagatcgaagacatgcaaccgtaggtcaatgaaataaatatatgctcatgcactgttgccatcgataatttagttgtatgcatagaaattacattttatccatggcaattttggaacaaagtatttttaactaaaattttataggatcgaaattctataggatttttttttctgttgagtcctttcctccactttttagagaattcaaacctaacctcaaacctcatgatttaatttcctttgaagggcttatttggtttataggattttcaaattataagaataaaaattgcaaggagttaggtggtcacatgcactctagttcttataatttttttcaagtatgtcttacctcgtactaaaaatcctacaaaataagaaacttagaatgctaaaaaaagtgcttaaccatctcaagtgcttgtatatacgtatacagactcaatttatatgtatagatttaatagtattgtatgtcaaacgatgcagtcaagattacaagatataatttggaaattctgattttgggttatacgatgaacaatataaaacgggagagcagtagtaatagtagtttgtttcagtttgcttgccatgaggcaattaatcactaccaggtttcgagttcacaataatggtgtggtacttctctgttttattcgacgttggaatacctcaaaacagtgtactaatatactattactacctctgtcccatattacttgtcttcttgagtttttgtttataatttttgatcattcgtcttatttaaaaaattttggaattattaattattttgtttgtcaattgctttattatcaaaatactttccatatgacttatctttttttatatttgcactaatttttcaaataaaacgaatggaaacgtccactatactaggacggagggagtactattactactacagtaccacaagatcagtaacatgtggagctggattgacgtactataatgcagatgcagattttttattaatattatttggtgtgggttatctgggttttagttcttccagtaacattttccaaagactaatcggataaactgcggttgataaatcgtaaaaaataaattgcaaataaaaaaattatatctataatactagtggtttgaaaaccggctgcaagaaaaactacgatgaaaagaaaacttagaataaacactttaagttctaaaacttaaattaggccttgcgtagtttccaattttttttctcaaaaacattacatcgaatctttggacacatgcatggagcactaaatatagataaaatgaaaaactaattgcacagtttgtatgaaaatcgcgagacgaacctttcgaacctaattagtcgatgattagccataagtgctacagtaacccacatgtgctaatgtcggatttattaggcttaataaattcgtctcgcggtttccagtcgagttatgaaattagttttttcattcatgtccgaaaaccccttccgacatccagtcaaacgtctgatgtgacacccaaaattttctttttcgcgaactaaacaaggccttataagccaataagtaaattgttagacctatgttcaacgaattgactagtttattagtggtcgaactgtatggagactcatgtccattaatgcatttaccattttggtcgatttgttttaccttcaatcaacgtataaactgataaaaaaggcgaggcacctgaatttttttcaaaaatcgggcgctgttccatcaagtagaccggaattgtttcattaaatagattgaaaacgtttcaattgtttaaaaagcttaaactcaaccaaaccacctcatggaacattttacttcaaagtatgaaacaaacggtttccaaaaaatcaggtgttgttttaccatatataaaataatgtttcagcaaatagcaaaaggatattttaattcactgcaacatttgatctatacatagtgaaacatcacgagtacacttgatgaaatattgttggtgaaacaaaagttgaaatgatccccttaatagagcgtttccataatacgtgggtgatttgttgcaacgacgcatgtggtggggcgtgtggtggggatggcgcggaggtgcaggaagcagcgggtgcccgatttttctggcgttgatcgggagcccgattactagcattttcctagaaaaggcagcggatagttctcttgcccctaaagtaaccaatataaatgtaacctagtataggtgtgacgtactgacctatcctaagaatatgaatctggacatcctagaatatatcacatatgtattaggttgcagttatattaggacgaagggaataataggaatatcctagggtatgtctgatttcgtactctatcgaaatattggtagtgccaaaatttaggtaagttttggcagtggcactgccaactctttcgttgggtaaa

SEQ ID NO: 38233 - DNA, 7773 bp, Oryza sativa
  unsure (1)..(7773): unsure at all n locations
tcccttatattataggacggagggagtaacacatagttgctgagattataatcgaagaagagcaaatcttaagtttagatagcaaacgtttacacgtttttcgatatctaggctatccaaaatctttttttttgggacaatacccacggcagtccctcaaatttattccaaggtcaatttattagtcctttagttccattttgttcagacataccctttaggtttgtcatacagttcaatatggttcttagtcccaacaaaagtgccatgtggacataagcccataccctaaatcttatgtaagatatatagtgaaaagtgtctagctttacggttataccacataaaaaacaacaataaattttccatgctttttggcctgatcaaaggaatcgatatgtacataaatttgaatatattatttacatttgatgactaaagaagtaatagattttgagtatatatatgcaagcgaagtgtgtagataattttgtgtggtattagtaaggataaattacacattcagatatagattttgtataagatgatattgttgagatatcgttttaagtgcagggttgaaagactgtattagaccttaagacatgtttttattaaaaaattttactgaacgaaacttttgagnccnaacattcaataagccattaaattttggacaactacttcaatgtattaattaagtcttagagctgattcgaaaatttgtcacttatttagcactatcaaaattagagatggatcatccgaaaaacttaantggggttattcgctccctcttttaattttagagagctccacctgtcatacacacatgtatcttggagtccatgctgcaactgtctacaaatctgtagtccgcagcttttctctgtcctcttttatctccgtgaaatatgtttatagctggcttatagtctggtggtgtacctgctcttattgtgctggtaagctagtaaactaacttttgatgacacggtgaaaattgcagccgaccgtaggcgttactattgatcttgctctaataacccaatgtaataagggggtggggcttatagcccctctctcccaaacaccccctaacacaaccggctgggactcctcacaatttgttcggacgctgtattagagcaagtctaatattaccgtccactactaactccattcatctgtagtcaatctaatagccattttatacagtagttgcttactatattatttatatatggtcccacctgtcatacatacagtgtgtcttagagtccgtgctgcagctggctacagatctatagtccgctgctcttctctcttattatttatctcgttaaaatatgtttatagttcgctaatagactgctattataactgctcttacgttccaaccgttacaggtatcatcaatgcgcattgtgttttttctcacctgcccaagatcgcatcctgcaaagagcaagagcaactgcccaactggcaagagctcagtgtagccagtagtactaccaggtgctcctggaaaaaatgttgaatttgggttcattaattagcgaacagactagccagacaacctgctgccctgctctcaagtttctatatgggcagttaatggcctttcaaaaagcgtactacctctatttcaaaataagtatagtagtaagaattcatatccaacgtttaaccgtccatcttatttaaaaaacttataaaaaatttaaaaattaatcacacataaaatactagtcatatcttataataataataataataataataataataataataataataataataaataattttaaataagagtacacttggttagtttttctcccccggcgccagcttgagtgacaggcacagcggcactgttacaatattgccgcgacagtgccaactcagactgtgtttacgtcaaaattaaaaatttaattaaaaaaactagaatattaggaaatgatctaatatcaaataattaggaggggtgaggctttaaacccaggtcgtctagcccaccaccttgtggagctagccggaagacccctgggcatttctcaaaaaaaaatttaattaaaattaaaagttttaaaaaaagttaaaagtttatatgtgtagaaaagttttgatgcgatagaaaaattgaaagtttaaagaaaaagttagtaactaaacgagcactcacatgacaaaatgcgtagccccggaggacgtttaacgtgcttccaccgtagagatgccgggccacggagacgagcacgacgacgacgtcacgcggaaccgcgagcggcgcgactttttctggccgaatccatgtgggagtcgccgtgacgacgacccgcgccgcgcgagcccttgccagagtcgccgcgccaccgcatcgagtaattcgttttctttctcttggaaacgtgcgtttccctgaacacgaagctggatttgtttttgctccccatgctgtactccggggtgatcacagaatcgcaagaacggacgtcagcacgctggtgcagcgccggactgcatgaagatgaaggactagtaaaaaaacatcaactcccagattattttgggttgaatttgcatgcctgtgttgcccgtgtactcctagtatgttcctaccaggacctcgccggtgtcagctttgacgaggaaacggaaaaagaaaaacaaaaagaaacaggtaggaacagtgcatgcatgcgacccagctggatcgctcggcaccacccagatatcttttgtgcagaggggaggaagggaaaagtaccccacgcacgaaaagaaaaaaaaaatctaagtactgtaccactgtgatgcacagacggccaaaagttttctctcgcagcctccctcgcgccgtttcaccgagcaggcaaggtatcaaaccaatcgacggagcaggccagcaggggccagggggagcagcacagtagcggaagctagcggatcggagcagcagtaacggtgtaggggcacagtagcgaagcgttgcaaccgtgtcgcatgcatgcgccgctgctgcagcgagccgcgcgacggcgaggtcgccgttgacgccgcatgcatctattgctgctcgtcgagttggcaatggcatatggcatcggttggggctttgcaggacaggtggtgcacgtgatggggagggaggaggcatgcttccctatattagcccagctacgggggcgcaggcgctagagtaggatgccaatgtcacgtcacgcccgctagctatagctgcaactgcgtctgcgtctgcgtctgcatgcctacgcttttctctgctccatccatcgtgacactgtgtttcctcagggggagagtagtacctctacctgcaactgctagatgcgtgatgggccgatgcgccgcagagatataaaggagcacttggcttttcttccccctggccaagacgggtcccgtccgtcgatcgatccatttcttacggtccaagctcgttcacatgaagtactagcctggatttattatatttacttaaaaaaaactagcaaaagtgcccgtacgttgcaccggacgattacgaagtgtgtacagtgaaaaaaagcgttgtttggtttagacatttaatatggtaaaaaagaattgtttgtttttaaataaataatatgctttatatttgcggaatatacatgatgtttagtttggatgatttttagcatgggagaaaatggatggacgaacaatgcacatgtagataaaaatagattatttagttggagttagtacatttttttaagaaaaaattcccgtgcgttacaacaggaaagatttagaaaaacaaatgaaatttggaattaaaaataaaagaaatattgaaagatgggtttagagtttacatagaaataaaatttagaaataatagaaattataaattatactggatgagaagtctagaatattctccaaaagagggtagagtacatataggaatacaatttagaaaaagaattgaaattcaaaataaaaaagaatattttttgaaaataaacagtcataaacaattaaaatggtattaatgctatttctgaaaattacaaaaatacttaaaatcaataagagagaaaaaactgatttaagcccgacccaatagagcggccttctgtgcttcgcacgtgcggtcggccccataggttggcccaatagcgcggcgacctaaaacgtcgctcggcccgacgtgggagaagcatggaccgtccgatctgatgaacagtctcgattgatcctaacctagataaatacccgtaaccctaaccttaaccctaaaatctctctctctctctcgatcccctaacacgctctctctctctttctttctcgtaaagcaatggcgccggcggcgactattccaacaggcgatgatggcagcggccttccccaccgagcagcggcgacgaagcttctcggtgacgtgttggcacatcagatccccaccatagcgtcggtcatcggttcagaatctagccccccgagttcgcaacctccattgcagcgaggtggcgagaagcagcacgtgatggcctcatcttgtggtaatatttttgatgttctttgatttcgatttatatttggactgtgattttgtttttaattggattgtgatgatttcaatttttagataatatttaactattcattttattcaattgtgtaaataagcaaaagtataagtcatactaaaaatatctttaatgataaaaccctaacaatcgagccgagtcggtcgagctggcggggcccacgcgagtagataaggatctatctagatccatccagtcgccgcccctcccattctcgcccagccctccaccccttncgccccttcccccagttgcctccttcgttcgccgctctctcagccggccggccggctacttccctccccatccatcccccctctcctagccggccggccgtttccctccggcgagcagaccacttctcctcccactctctctccacttctcccccctctctctgcggcggcggcgggaggggcggcatggaggcggctgtggcccggcgggggcaagaggggcgggccagacctcgcttccgccagatccagcggcatggaggtgcggctgcggttcggtggggcgggagaggcgacgtcgtcgtctctctctctctctctctgttcatggtggggaggtgcggcggcggtggcggcggacgtcggccgccacctcgcctccgccagatccagcggcatggaggctgctgcggtccggcggggcaggagaggcggcggcggcgtctctttctctctctctctctctgttcatggtggggaggtgcggcggtggtggcggcggacgtcggccggacctcgcctccgccagatccggcggcatggaggcggttgcggtctggcggggcgggagaggcggcggcgtcctctctctctctctctgttcatggtggagaggtgcggcggcggtggcggcagacgtcatggaggtagtgggacggacggtgtggaggcaggcggccgggcctcgcctccaccagatccggtggctgcggccgggcggtggcgggaggggcagcgggccggacctcgcctccgccagatccggtggcatggaggcggctgtggtccgacaggggtgggagaggccgcggcatcgtctctctctgtgtgcatggtggcggtggaggttgatgtgttcttggttgaatgttttgttctgtgtgttattgatggaatgtttcatgtgtgttttggatgaatttcgactgggatttttcttgggggcagggggcgaacgaaaaatccctgcatttggttgtgattttgggaattgattcccttgtatccgggatttgatttgattttgtgagtttttttccttgtatccgattctgagagggattggagggatggggattcgggggctgcgggcgaaggcgcaccgcgagggacgaaggtgaccttcgtccgacttgtgacgaccggaaaaatccaaatatttatattagttatagatatactcccacatactagtataacaacttgtaagggggtgtttagattcaggggtgtaaagttttagtgtgtcacatcgaatattatatatggtgtcgcatgaggtgttcgggcaataataaaaaaaactaattacagaatctgtccgtaaactatgagacgaatttattaagcctaagtaatccgtcattaacaaatgtttactgcatcaccacattatcaaatcaaggagcaaatagacttaaaagattcgtctcgcaaattagtcgcaatctgtacaattagttttttaacctatatttaatacttcatacatgtgttccaacgtccgaggtgacatagtgtaaaatttttggcagggatctaaacatgcctttaagttctaacatttaaaatttataccaaaatataacatttttttagcctacaactcttctcaaccaagccattcaccatttaaaattttcacttaaatccttttctcaagcaatcataatctttcccaattcaattccaccaactttcttaatacccttgtccaaactaaaactttttacatctcaggacagagatggtatttcacaaatatattgctaaaaaacttattctagacgccagtaacctagtgtcaacattcatcgccacaacaccaacgatgctagcaacgataacctaatctctctagcaacgataacctaatctctctagcaacaaagatgcagaggggtcagtcctagcacagaggatgtatttataaaatattttttttgaaaagggttaaatgtaatttattttttacaaatatatcctcggtgccaaagaggttggcactgaggactatttgtaagaaaaacattattatccgtttcaagataagtttatttttcatctatcctggacatactaatacaaaactaaaaagactagaatacctccttttatcgaattccaatataactattccttactttatatactatcaatacgtcctagttttcacaaactctaattcaataattactctaataatgattttgaaacaagtgagatgtgctaaaaatgaacttattgcagtacggaggaagtacattttaagccttttttgtttttttacaaataggcccctgacatcagtgtctttagcaccgacccctttcacatcagcaattagctaccatgggagagggtcgcaacgacgtcattagctcttagacatttaaccttgacacaatgatcctatcaccaagaaaaagatttatttctgaattaagtattttcataaatccatttatataagaagtttttaaaaagaccaaaatattttttaaaaaaagttctagaagtaatactattttttatccccatccaaactcccccttaacttgagagtgacatatgccatactgacccatcattcagtaactcggatgagaattgtgttctctataaggatgactaactattaaaaaaaatcactggcttcgccactctcatgttaagggggagtttagatggggctaaaaaaatttagtccctgtcacataagatgtttgacactaattagaagtattaaatgtaaactaatgacaaaacccatttcataaccctggattaattcgcgagacgaatctattgagcctaattaatccatgattagcctatgtgatgctacaatatacgttctctaattatagattaattaggcttaaaaaattatctagtagattagctcttatttatgc

SEQ ID NO: 38234 - DNA, 1113 bp, Oryza sativa
gaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttccttcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggcc

SEQ ID NO: 38235 - DNA, 465 bp, Oryza sativa
aagcttctagaagcggggtgaggcaaggcgaggcgaggcgagccggcggttagggcttggtttggtggccgggggagggatggcggggtgctcggaggggggaggaggagacggggaggtggcctgctgcggcgttggggatacctcgccggggaccattgtgtgggtgcggcggaggaacgggtcatggtggcccggcaggattctggggcccgacgagctgccgccgtcgcagatcatgtcgccaaggtccggcacgccggtcaagcttctcggccgtgaggatgccagtgtgtgagttctgattcccttattttccatctgtttccaagtttctacttctgttgctgatggctaggtaatttttttggttagttgctgcctctagtgcatttgagatgctatgcaattttcctgttcagtaatttagttgtttgaaacttggacggaagaaggcgagaggca

SEQ ID NO: 38236 - DNA, 687 bp, Oryza sativa
caatgtattgtatagggtctattatctctaagttctacttggaaaccgcctgacctgcgatataaaagggaccccgcgaggaggacctggggcatcgaatgtcggagccaacataaccctcacagcctacgaagtcggagcctgcaaggagccaaatcgccgaggatctagtcgaaccaactagaccatgatctcgccggatccctcaagttccattgttccctttataacctgtgttttccaccatataatcccacatcaactggattagggctattacctaccaaggggcctgaaccagtataatcctcgtcttttgtctacttgatgtcgtattacgtagatccttataccaacgtaccccaataccctctatatccggtctacgggtatcacctgtcgacaagttccataaacaagcgttgtagtactaattttggaacagccgacattgccgggatgtcgccttccaacaccaaaaccgccaccgtcctcgctgccagtctcggcggaaacacacgtccccgacacccacgctgccgcgaccttcttcccaggcgcgacgttggcgtcgcccgcgcgcacgcgcatggcccgagcccgacaacacaagttggcgggttgccaaatgccaccgcgaccgcgagggtggcgaagccggccgctagccacaagccaactgccaac

SEQ ID NO: 38237 - DNA, 2660 bp, Oryza sativa
  unsure (1)..(2660): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccgtcgatcatcgatagagcaacgtgtcgacgcctgcagcagcgtcggcggcggtcgacaccctgcctctgccgctaaacccgaacgttagctgcctgaatgctcccctccccttcggcaaccgcacagaggccaacggaaccggactcatggaccttgccgggacgccgttcgccttctccgggaggaacacgctgatggccgtcggctgcagcaagcataaccacctgcgccaccgcgtgccagggcagctcagacgccatcgctagccactcctgcagctcacgacctgagcttagactaggcaatcggtaacaacagcagcgaggaagcaacaagaggcagcagcaagcttgctccaccggataaatgcaaggcgaatgcttcgactcgctcggggagagggctgtctctgcaattgccgcagggctttgagggaatccttacctggatgtcgggtgccaaggtaagcgccttcttttcagacatttgcattgcaccttcagatatatagatactcctacttgtttccggagctggaagaggaagaccatgcatggaaagaacctgcaaactcaatagtattatatataagatgtcaacgagatgtactttcgtagtagaaatctaggaaggctaaacatgaaaaggaatctatttcaggggaatcacatgtaaatcaattttaaggtgtgcagtaaatcctagattttgtttagcttgtgctatatcttatctactacctactacctaggcgaataagcaatggaaaatccaggattcagattaatgctgttctatgctaccagttatgctatgataattcaactgattgcccttcactgtctttacagtggcaacttgtcccagctggactaaaggacctcatgtagttactaaatatctccagttttttcagcataactcttctgaagttttgatctttcatgaaactaatgttaaattatccatgttattactagacatcaattagtaccaacttccgccacaaaacaaggattacccttgcaccttcacacagtactgcaacaacactccaggaggatttcagtgctcttgcccatcgagcatgattgataatggttacaggtcagggacgggatgcactcccttggttttagttccacctccacctagtcctggtacttcctgtatatcctgtttgcaactttgttcaactacatttgtcaaagtcaagtcatttacagataatagggtatatcatacttactaagaacttattaacctagtcctggtgtttactgtacatcatacacagtaagcacttatgatgcacttctacaaataatagtgtcgagtctaagtgatattgcatttctgtttacagtaagcacttctacaaaaaatagtgtcgagtcttgtgatattgtattcctgtttacgcttacacatttgttatgttatttaaacaaagaaaaaaaaactccacaacacttcagagatagaaattattttcaatgcatgacatcaaggctatcagtattaacaacgaggatcaattatatatctattaggcttgtcaaagttgcataaaaaaaggaattgtagtatctagaaataaaattgtcagtgaaattcagctagttctaacgaaaagatcgatgacatgcctatcaacattcaacagacacatcctgtccttatccttattccaagttactggcattattttgattacacttgcgtctagattatcgccagttctgactgtctgcacatatatattctcaaaaagatatctcaattaaaaacagttaggcttagaaatagtactctccacatgattaattaaatagctttgattaggcatgacctacagcatcaggaagctaaaatatgttgattggttcctcttgatgcaggttcccccttgcaacgacaaccccaaggtttgacatatcctccaaatctattaattgtgcatacaatttagcatttgatggcagccttcaggtcgaagttttcttttggcaactatttttctaggacctaaagcatgccacagggcataagtggagatggcatgactaaggggaatggctgccaaacgggtcgaaagaacttccccatcactatggtaactcatcagcttctggagtgctacctttatttttaacctaaaaaaactacagattctgaacaaacagttgaaaaaaacataatatctacataagctattgaatgcaaatcgtttt

SEQ ID NO: 38238 - DNA, 419 bp, Oryza sativa
ttctctgtgagctggctgtaaggtatccaattgttccttgaacaattgtcatatgagtctgatcaaatgggactgatcttgatgcaccaaagtcagataccttggccacataattcccatctaatagtatgttattctctgtgaacaattggtatagaaggcacaaattgcaaatgggcaagagcaatgagcattccggctgtgaatatgctgtaataaagtcccattaggaacaaattcgtataccaaacagtggcacttgtgtctctaggcagcaacctaagagcttgaccacattcgggtggtcaatttgtgacaggatagaaatttcattgacgaattgttccacctggctctcattgaacactgtgaacactgtggaattcttattgcggagaatgcctttgtatacctcagcc

SEQ ID NO: 38239 - DNA, 42488 bp, Oryza sativa
  unsure (1)..(42488): unsure at all n locations
tattgattctcaacttaaaaatgcatatcgaggataatgatatttcaatcagtgataatcatcataaaaacaagtaatcaacacacaagtgaaggttttacttattgttggtttattgctctagaagagacataaacatcgtgagatattggagtgaacaacaaatggaaaaaagattagctgaaacagggccagtatcatttaccatgggatgtccatggacagcattatagtgttatccatgtcaatatcattatggcctaaatttgacttctaatccgcaaaaatttgctcctgatagttctccttgctaagaaattggctatcattgccatccaggatgctgtctcctcagctttctcaactccttttcacacatcaagttcaattgcaacttctacatcctcggctgtcttcccctttagcctcgagcatttcaaaaccaactgaatgtcagcattaacatgcctaattccagcttccttaaccactgcactatcgataatatccaatattgattctgctgggcaagtgaagtaaaacgtgagcacatatttcccccttctgcctgtgataaagttataaggctctttccccttggtaattnttngtanaagnncaaggctttttcaaaaaaccccaaaaaggggggaaaaccccccaaccccaatttggtgaaaaaaaaaaagaggccctttttggggtttttaaaaccccccgggcgaaaaaattttttttttttactcttatccgttaacaggcttgtttcaaagcgctcaggatctaagtgtcctaatgtcccttggcccttgcactagggttgtcagttgttggccaacttgacaccccgttggaggactggtacatttgtagctagatgaagacaagagagtgctgatgcagtttcagttgctatccataaacgatgctcccatgaaatcagtgtcaacttgttattgtgacgggtacgggataccatagaaggtgctggtacttctagttttttggatggagctttcagctttggttcagttttttgaccaagcaacccttcttcttatcctacagcatgtgacgtcaatttatcatctatttcatggagcaaacttgcatagttgcatagagtaccatagaaactgaccgacggcacaggcacagttctgaacgagacgaactactactcattattaaaagggttaagacgacaactggtggactcatgggcctcgagtgcagatggccggcccaatacccatcaatactttccatttaaaaaaaaccaaaagtgcagcagaaaaataaataaaacataaactggacattccctcaaaaaaaaaaaaagacataaactggacatggcataaaaccaccggttggaacgatctgacctctagggtttttgaagatcctcgccgtcgccgccatgtatgggaactccggcgagggccccccgtgaggcggccggacaccttccctgcatcctccaggacgcggttagcagagtctccaccgcccagatcctccactcgtccggctacaccgcggcggagccagccgccctccgcgccctctccgacatcgccgggcgctacgttgcctccctgggccgcgcggcctcggccatcgccgaggcccgcggccgcacggagcccaacctcgcggacctcaccctcgcgctcgaggaccacgcgctcggcgggttccccggcgcgtccgaccccgcccgccccgtcctccgtccggcgcgctctcggagctcgctggcttcgtccgcgtggtgcgggaggtgccgttcccgaagcccgtgccgcggaggggaggggccccacgcggcaaggcgtgggagagcttcgcggcggcggggaaggagcctccgccgaagcacgtgccgcggtggctcccgcgctttcccgacaagccggagccggagcccgaaccaaaggcggcgtacgacgaggcgacggcgaggtgggaggcgcgcgttcgccacgaggaggaggcgaatgcagaagaagcggtggtattgaagccgagcgttgatggcggcggggagcgcaggggagtagtaccggagaagagggggaaagtgagcttccgcgtgcgggcggagaggaagaagcggcgggtgggattggaccagcagtgaggcggtggcttcgaacggttcgcggagaatcgagaaaaatccgcggcaatagtgcgggcggcgagcaaccaccgctcggccgtggccgtggagaatggagatggacgacacgccgcggcgttgcccggtgacccctgtccagtcgaggggttgaagaagacttgacgagttttgggctctgcctgggccacacgtggcgcctataggctactagcccacgagccacctgccgtcgtggctgaactggccgaaaaggtcaagtgtgtgggtgattgtacaagttataattgagttgccacagtttatcacaaattttggctttagtttgttcacgcggtgaatttgtggcgtagagctggtggtttcaaatttcacagtactctgcttgatatactaaaagatcaatttcttgttttttgaggacgtctgagatcaaatccacatgtatccctgaagactccctcggcgattcattcgatcatccctcctgagtcctgccttggattcgtgatttctcgtgggttcctcaccgtgagattcatcattttcatcttcagatcttgacttgtggagacgatgaactgggtaaccgagattcccatccattaaacaagaagaatcccttgttgaaattaaagcaggaactgagacaaagatgcaaggaggaaaggcaacagttcagagtgctttttgacatcaacgggatacagagaaaaactacattgttaacatcaactggtgtaatagttatgatatattacatcgaattgctacacatgcttataaacagaacatacagtcgaagaaactattaattctttggacagtaaataacaggcaaatctgaatataactgaggggattatacatgacatcagagaaactatgaactattgactatgagatgaatgcataagattagctaaatagacatcctaaaatgctgaagttagtactttacaggagacagctatgccaaaagccatttttatagtcaccaacactgttgctctgcaaagaatttcccctccatggagtcattggctcaactactgtgtgagaaccaagaagcactcgtgatgagagcctaaagggtctcaacctccagttagaaatatacaggtgctgttgatctttacatgtcatgtcaccactgctaattagttatcagctgttcccaagttatattgaagtaaccatgccatttgctctttactgactgtagcccaaatgactgaaaagcccgcatcttcgattagctgggaatgtacacgaaacttgcaggtccaaggctagcaaatcaacaccagatacatttaacatcacagttgacgcctatgaaggatctcgcaaggcaggactagccattctaacacggtgagcaacagccaggggcggcctgccaacagcttccagtatcctagtaaaggcaaccttcgcagggacacatgtgacaagtggaattccccctggtttgatcaagccgccaaaaatgccactctgcttatgtgcttttgcttgaccacctactccatgatgcttttttccagggaaatggaagagagggttcggaccttctggcttgacaggcttgcttttttggattgcttcttttgagatttagaggctgacggccccctaacatttgagatgcttttcttatcaaccttaacctgatgatttgaatttgagtactttctaaaatctgaatttgagtactttctaaaatctggtttcatctcccagtctggatatgcaagggtaccttcatcatcacaatccaatgcccctgaggggttagatcggggaattctttgcatggcagtcctcctgcctgtacaccaagcaggttgccctccagttctcccttccaaactaacatcaccacaaaaaaccaggtggtcagtggaaccatcttcaagtatttcaatttgaacaggatgcccaacaattgctttgccattcagtctgctcattaaggaaacaagaggaacatgctctccctggtagctagcctggaccttcaagtcaacatcaaacaacattgggcccctgccacgaagacgtgaactgtacttttggtagaatgagggtccgctccaatatgcattccgatcaaaatgaaatatcttatctgaatccctgtttaggggagaaaccttggaagaatcatttccatagtcgttaaaatagctgtagcttcggctaaaatctcttgtagccttcaaacatgaagaatatgttctaccatggtacaagttaacctctgaatgacctgtgtcctcaaaaaaatctgtttcttcggaatcgtaattgacctcttcgttttggtaaaaattttgccccagcaattgctgattgggaatttgcatactcccttctctgggatttctaccatttattttatacggagatccttccatgaaaccatctgatttgtctaaccagggatttccatctgccatatccgatctcttaggtgcattacggctattacgtttacctttcatatgccattgggagacgcccaactcagaagagccatcctcttctgattcattcacttgacacatataagaagaataggtcagctcatcagcatcagcatcaatattcgcatgcctgaacttgtcagaagctggtaagaaataaggatcatgggcatgtgatgctggatgcagaatcaaatccgaacctgcccaaaagatcaccacagtgatcaaacaagccaaaatcccaaactcaaaataaaacaagagcatagccatgaaaccatagacagaactgatgaaagcttagctagagctaaacagaaacaaaaacaaaggtacacttaagataatttgagggattatctaaatcatttggctatctcctttttcttggaccaggtcacacctcgattccaaatttggcaggattcattgtacatacccaacataagctcagataagtccttattgtcatataagttcagaataatagaatggctgctaatctgtcttataatatactgtacacaactaaaacttcacaacaaagtaagtttggttaaacccaaacggtgttgttttgttgtctcacaacctacatattgtttgagtcattgtcggttcaaaactttttaaaaaaaaagggtccagaaatgtttgggcacctaaaaaacaaatcaagagtgagcatatttgattactttgatgctatactgtaagatataaattgtttgaaccttatgcaacaacaataatatggtaacatttttcgcaatgtgaacccacgtgtgtacaagtaaaaattgaaagaagtattagcatggtgtgaacacatacattgtaaaagttcagcgtcatcttctgtctcactctcagagcattccctctctgaagactcatatatgtgcttctcaagaagatcagaagatgtctgctcctcagaaaaagcaggatgatgaagataactttcagtctcaaaatcacctcctgtagaagccacttgtacggaaggtaaatcactatgactatgagtttcaccagaatcagtaggtaggaatacatatctacttcttttagctcggtaattggcaggtgatcgatccatttctccctgagttaggacatccccatagccatcattgtgctgtgactgatgaggcaattttggactgctgtgcaaaatctgaaccagaggttggcgtctgtcacatttttcaatagattcatcaaaatcacttccatctgatctaatcttttccgcagttgtgattttctccttgctatccaaattttctccggcctgtatatgcctcacatgcgagatgtctcccaagtgattgccaaaaagattatcagaaatgccccgagtaggagaatcttgaaagtttctctttgagccagcatggaggacatattgctcagcttccttttttatatcagaagaagcagttatgcccttccgtttcttactctttttgctcttgtagcgggtacttccaagatctttgttatgtttagagcaaactgcatttcacaaagataattgaggttttatatccaacatactcccttgaagatcatgcaaacaatttagtcaacaatgaaggaagctaaatcaaactttgccaataaatgggcttaccagaaacgttagcaggtctggaaccttgagtctgatgctttgatgcaagcagcttcttctccaattcaagagcatgaagaatagcatcttctctacgtgcatacttctctcttttcttaacagaagtcccttcagtagcctctgccttctcaatacatgcatcaaactccccacacctaaatgctttgacgcgctttgatttttcaatgttgtaccagtcgctatggataagaaaagacaagtacataagtttcagaattcaaaatatacataggcaatcatgtaaccaaacaaacaatataaatgcatagtgtgactattaattcatgagaaaatagtgcaggtaaaatagaatcagaatgatttctaaaaggcaaggcaaacatttcaccaatttacataaagtcaaagttatttcccaaagaaccaccatctgtttggtttccacatagcaaacatgcaaatttctctacagaaccaaaatgctgaacatagcaactgtatagcaacctcaggaataaggaagcaatcttataatcctcctagtttattttcagttcttcaagaccaaacatggtcacactgaataccatgaaaacacatgtttagcttattgttttttttttacaaggaacagtttgcaggttatcagttgcagaaatttcactacacattttatattattatacattacagatataagttctttttcttttttctcagaatttaaacatcgaggcacattaaaaaaaactgacatggagctaaactacaaaaatagaccattttatgcacacagctatacacagattgcctctcgccttcttccgtccaagtttcaaacaactaaattactgaacaggaaaattgcatagcatctcaaatgcactagaggcagcaactaaccaaaaaaattacctagccatcagcaacagaagtagaaacttggaaacagatggaaaataagggaatcagaactcacacactggcatcctcacgggcgagaagcttgaccggcgtgccggaccttggcgacatgatctgcgacggcggcagctcgtcgggccccagaatcctgccgggccaccatgacccgttcctccgccgcacccacacaatggtccccggcgaggtatccccaacgccgcagcaggccacctccccgtctcctcctcccccctccgagcaccccgccatccctcccccggccaccaaaccaagccctaaccgccgcctcgcctcgcctcgccttgcctcaccccgcttctagaagcttccctccctctcgagatctaccctccattcaaatcacggagggcgcctgcatctagaagccctctcctccgcgctcgctagatcgccctgcccctcgcgctcgctcagcgccccccccccccggcagcttctagaagcttctcagcgaggatcccaaggagagccgccgccgccgcctcctcaccccccttccccctccttctcctcctcctcctccacctccgcgaggcagggcccctccggcggcgccgctggttcgctgccgccgaggcggtcgccggaatatttttttccctcctctttctacgacagaaaagggtgggaaattaaagggcaaataaaaggattattttcttttttcctttcgggtagtagttttgttcttggttcccggtggtccgttctgcaagagagagagagagagagagagagaggcaacggaacggaaggtaaccgacgagtcgaaccaccgaagcccggaaggaggaggactgcgtggcgtaaaacatgagccggaatcgaatccaaggggcgcggacggcgcacgttacgggagcgcgggggggagtccatggcttccatgtgacggagtcgcgtctcgcctgcgggttttccgttctcgggcttgattggcacatgtacgcgaacaccgtgcggctgtacgcctgtacgtaagcacgcttaacgggtgtgagttttgagggacatatagctacataccacttttaagacgtggtaattaattatttatcactcatatagctatatgggctctcatgtgtccatgacatgtaggtccaatgataaataatttattccgagttttgatgatggcatatgggcatgtctaccaaatgttccggaaatatttgaatgtgtgtcaatggattttaatctagcatgtatagtacgttaaatattgtacaattataaaaaaatatttatttgaagttaatattgccaattaaattttaggggtagagtagtagatgtacactgaaattaaattaaacaacaacacacagagtagattctaagtctatcgtagttatagctggatagaaacactgggattgttgttttttaaaaaaatagttacattggatgggcaagggaagaggaaaatggaaaaaatatgatatgtgaaggataagggtaacattgatattgtaagtaaaattggttacgatatggttttacataacatcaacaatcagattcccataaaaatatgttagagacaatagataaaaagccacatgttgtttcggaagaaaaaaaagataaaaagcgacatgtatttttttatgtagggaaagatgtctgtcaactatcatggatcctaatacctagtgtgccttatgagttatggtggtcattacactctaaaaatctaaggataaatggggatcaagaaggtgcaatcgcgaacgatgatgtactcaagtagctacaccactttcgcactgcaaactcaacttgagcgttatggttgtagaatgaacacaaagttgtcccgcttaatggaatttagaatgctgatagattggtcatcgttggagctctaatccagaagctgcaataattcttagttatgcaaattggcgatggaaaaataacattattttgccatgatatatggttaactgcatctttattggcggaacactaccttgcactatacttgcatgcaacatctaaacacatcatagcaggtacgtccatgagacaatgactttgctcatctataatctccatgttatcatctatggcaattgactaatagtcgtaggctcttagctctaactagaaattgtagatgtgcgcatgagtcgtaacaaaggatgatgatgagacacaatgtgccacatgatgctcccatccctctaaatttatttactacaaatgtagggtgacaatagaggagtgacctaactagttagcgatttatatgggataataaggcggcgccaaaaataaccttcttgtatggttaatgtcaaaggagcatctccctatacaataaatctatctattccacaacaaaaatgacaaatacaaacaagttggatggtaaataagagtcttagcatgagataaatcttatctctactcaattcaggtttgtccaataaaatgaatttatctattcttaaaaaaaatgacaaatgcaaacaagtcagatggcacatagtcatttttcactgtaaaacattttccctgtaaaacaccggcccatgggacgatttaattggaatggcccatataaatggcccataagttgcagaataaattccattaggcccatatggcaaatactcagacgcttggtcgtcgagccagcctgctcccaacttttgggctgcttcctgcacattcctcacatgcgcaagccctaaagcccataaagcccagcgcaagccctaaagccagcaacggctaatttctcccctcctcatcgctgcgcactagccgttgcgacttgcgagttgcgatcgccgccgccgcccacctcccatgtcccatcggccatcgcttcctacaaatacgctcccctgtcgagaccctaaaccccacaaagcaagcatcgcatctctcttcttctccccccctcctcgccgcctctcccctctcgtcgatccgacgcgcttgggggagtcgacgctttctcttctcgcttgctaatcaaagctctcgcataattcccgtctctgtttcgttaatttccgcttgtttcatttaattacatagtcttcttagcgtgttgatttttctgtttgatcctgtgattgatctagtttacttctagtgatctttattgctgctggtattactgctgtttgtttccttgttatttgcgtgcttgtgctcttctgtttctgctaaccatggacgcaggctcccactcgatctcgtcggagaagagccacggactcgcgccgcggccgccgctccaggaggccggctcccgcccgtacatgccatcgctgagcactgcctcgcgcaacccgtcggccaagtgctacgtgagtccttggtttccccccgtccatgcgtgcgtatagactgttcgacgaaatgcctgaccgggtattgtgctgcgcgtgctctgcagggggataggttcataccggacaggtcggcgatggacatggacatggcgcactacctgctcacggagcccaagaaggacaaggagaacgcggcggcgtccccgtccaaggaggtgtaccggaggctgctcgccgagaagctgctcaacaaccggacacggatcctcgccttccggaacaagccaccggagcccgagaacgtctctgccgcggatactgcttctacccaccaggccaagccggccaagcagcggcgctacattccccaggtaacgcacgagctttgatgttccttcctttacattgatgcaacgatgtgggattgtgattactgatgcggctttgaaaccgatgtagtctgccgagaggactctggatgcaccggacctcgtcgacgattactatctcaacctgctggactggggaagcaagaacgtgctgtccattgcgctgggcgacacggtgtacctgtgggacgcctcgagcggatccacatctgagctcgtgaccgtggacgaggacagcggcccgatcaccagcgtcagctgggctcctgacggccagcatgtcgccgttggcctcaactcttccgacatccagctctgggacaccagctccaaccgactggttagtacattgttcggtatcctataatatttcgtgtcctaattcttgcttgatcagtacatgaatcagattgttctttctctgcagcttagaactctgagaggtgtgcacgaatcaagagtcggttcactcgcatggaacaacaacatcctgaccactggcggtatggacggcaacatcgtgaacaatgacgtaagaatcaggaaccatgtcgtgcagacataccaggggcacagccaggaggtgtgcgggctcaagtggtctggttcagggcagcagctggccagtggtggcaacgacaaccttcttcacatttgggatgtgtccatggcatcgtccgtcccatctgcaggccgcaaccagtggctgcacaggctcgaggatcacacggccgctgtgaaagcgcttgcatggtgcccattccagagcaacctgcttgcaactggaggtggtggtagcgaccggtgcatcaagttctggaacacacacaccggtgcatgcttgaactctgtcgataccggatcgcaggtgtgcgctcttctatggaacaaaaatgagagagagcttctgagttcacacggattcacgcagaaccagctgacattgtggaagtacccgtcgatggttaagatggctgaactcactggccatacttcccgtgtccttttcatggctcaggtgagtttcttcttgattagtagttttgcagtcactgcctataagttaatctgttatttgctgatcgtcttactgtgattgaactacagagtcctgatggttgcacagtagcatcggctgctgcagatgagaccctgcggttctggaatgtgtttggtagtcctgaagcccccaagcctgcagccaaggcttcccacactgggatgttcaacagcttcaaccatctcagataaggatgaaccaggtgaacaaattcgtctatttgatctggtcctttggacagcttaaaaatgatcgtgctggtatatttctagaactcgtatttattcctcgattgtttaaccatgttgagcctcaggctttggttattgatcttttgctcactgattttccttttgcaatgctcttgcagattgagatggccttggcacaataggctgtgcaagaagagcattgcagtgcttctcatgataatgatccaatcgtttcggttagtgtcattgctccctagttagcacttaacacaaatgcatagtacggtgtaaatgatctttgtttgtttcgtttgctagctttcaaacggaagatcgcaagtgagatttggcttcatcgatatcttcatctttgattggtagatactatcttcgacttcaagttcacaaagagcaccaaaaagaacctggaaatgtgcaaaaccttatcacttatcggggaatgaaatgctgagttggtgacttgagataggaatatatacttctggcaatttagttagttattctgtacattatctaaaaaaaagttagttcttctgtagagcatatgtaaagcacacacatagtatctaaaaaaattgatcttgttttaattgcgccaaaagatcaatttttgaagaatcttttggtggaaacatcaaatgatcggtttgatgtaacaaaacaagaggtgtagttcaaatatttatgtacgttcttcctccgtttcatatcatactattcaaaactagtcgtttgaccttttttagtcaaattttatctagtttgatcaatttttcaatacaaaacaaacatatttgtagtagtagtatttttgttagttcatccagagtacggacacatttgaccaaggttctaacttctcttaacagatagtagcacttgcattttttgttcatctgaagcagtagtagggctgaggtgccgtagtagggtataacaatattggaaatttgattgaaattggaacgatgtgatggaaaagttaaaagttttgatgtgtaagaaagtttttatgtgatgtaaaaattgaaagtttgaaaaaaaattaaaagtttaaagaaaaagttggtaactaatctagaccacagtagaagggaaccatgaggacaaacaaaggaacagtgatttccacccatgtggcccgccaaatcggagcgggcaggattagattttaattccacccctcccttgtcgcgttatgcctctccctcacagactcgcatccggtatccgccttctccgacccgagcgcggtgccaggctagccagttcgccactaccgcacggcgcggcgcggcgtatggtggtaaaaaacaatacgatgacacagtagtggagagcacgagagattccgtgtgcccccgcggccgcgtgcaccagctcaccgtctgacttgctgcttcgccgccacccaacagccagacccgcccggccgggctaattctcggatccccttccgcgccaacgacacgcgcgcgcccggatgcatgtgaccaccgccatcaacgctccgccgcgcggacgcacgtacgttagctcatctgctcttgtggagtggggtttggctacgacgacgacgacggcctcctcggttaatctgctgtgatgctgctccatatgtacgtgtacgcttcacgatcctgtgttcgcttgcggtgatttggtttgaggctaattgccaacgaacgcaggctctggctaactactaacctaggaacatggaatgatgcttgctggactagagatagtactagcatatatatacaggtactggtggttgcggatgttgtctgttggcgtccacacagaacattacaagagatgagggtagtagcttagctaggtgtttgatgagacgatgatcagagctgtggcatctacagttagtaagtgctatttatgtgcacacaagtacactgttccggggagtatggagaaattgagccttcgataattggtgtcacaagctccgatcagaagtgataatttgttcgatggcatcagctccctcgctttaagcatacgattctatctccaaaactgaaacctaagtatgcgattctcttggatggggaagaagtttacttgcttaaaggggggataattaaagtgggaaccggaacaaagacaaacgaaacgtgggctcctcgaatctacatgcaaggaagagagaatcttatgctgaccaaagtaccaaaccatctctctctccctggctagctgtagtagagtagtaccgagtaccgtcacttgaaccacctaacacctaccgccgtttactgtcgcaggcatcggattccagcaggattactttggctatgcatacacaatttcatgtcttatcatcagctattcaccgtgggaattttattccaggttcccaattttggcttacacaccgatcgggccaaacgtgtgcactgatcctcacagcgatggactcgcaaattgcaaccgtgccgtcaccgtcgtcacagtttagacagcggctccatcgaccacaagataatccatccacttacgcaggcacctttctctgacgaccaacacaaattgcgtctcgtctgcatatctgtcgcggcagcgactgccatagtgccatcactcgcgggcgtcacgactccacactttacaaaaccagcacagttatcgcggttattacgtgcgataaacttctcagcttttaaaatcacgatatatctcatggtaaccgtgtagttacagtgatagttgttaaactgtgaggtggtggtaaccccaacccaaaacgatttagagaaaccgacgactcacgccgatgcatgccatgcctgcatgaacggcggcggcgatcgatcgggccggggaggaattgaaggctaagggagaaaaaaaaaaggagtattggaggggtggggcggcggtcacaaccaagttggcgcaaatattcctcccgggcgaggccaaggcaaagccacgcgacatctccccgcgtctctctcgccggccgccggccggccccaccgcatcgccccggctagctagcttagctatggctctcgatctcaccaccaccctttcgctctccgccccccggctgctacttgcctgccgccggaatattcttatattctcccccggcaaaacggaaggctaagtacaaccgcagctcgctgtcgaataaacgaccaaagagcgcatcgcgtattcgcgtgcgaattccatcggcacgaacgcgcgatacgcatggagagatggggttgatcaggccgctgttgctttcatcgatcgaggaaaaaagtaacgggattctctctcgtcctttgggttgagtttttttcacctggcaatgccacggcgcatatgcggttgaattgttcttggcatcatcgggtgtaaccgtgtaacaaccgatcgatggtcgtcgatagagcgcccggccggcgatgctgcggcatcgtgatcattgaccggtgaggtgacacctaatcaccggtagtagtactactattctttatgcaaaatctatacgtactcctcctagtaatgatcagagtatcagaccggacagaccagacagcttctctggccgacgaccgaaacgcagcggcacacatgaacacatggcaggggccgctcttgtcggggcgcgaggcgtccacgtggcgccccctcccacatgcccttcgttgtcctgttcccccccgctcgaaggacgctagtacgtgcacaccgctcgatccgacggcagcggcgccggcggcccgtccacgcggcgcgccgcggttgacccgcgttgcctctcggcacaaggctcccctgagattccggccgcgcgcgcgggcgcgcacacatgagctcatgatgtgaacgtgatgatggtgcgcggtgcggcgcgacacgcgacgcgatatgctttctctctcctcctcttcttttggctccgcctcgcgcgccactctcccgcccaggcgcctctctctctctctctagtttctcgcaccacctgcctacatatcgccacagccgctgtcgtcgtctcgtctctgtgtgtgtgtctccatcagacgccggccatatagctagcgagaccggcacattcccatcgggaatccgcctcgggcttcgccgcaatcccacgctaactcacgccgcaccagattcacgctcccagctacaaactcccagccgcgcgccggccgcacgcgcgtgcgcacagctagcgatcgatcgtgatcgtgaccgcggccgggttgactgccgctcgacgagcgcacacatcgatcagccggccggacgaggagattgtcagatcgtctcggctcgtcgacggattggccatcatgttcgaggggatggagagggcgggctacggcgtcggcgtcggcggcgcgggggcggtgggagccggggtggtgctgtcgcgggaccccaagccgcggctgcggtggacgcccgacctgcacgagcgcttcgtcgaggccgtcaccaagctcggcgggcctgacagtaagtaccaactccatgactccatctccgaacaccttgcaccatgtcagtatatgtcaccatgcccatgcttcgatctttctctgtgctacatgcgtccaaactccaaacacaatcgagctgctggagctgtaggccagcagaatttattagctgtgatgaatggaacagtgaaggaaattaaatcctgttcttgtttgcttgcttgtttaattggagcctttaattgtctaacagcgaaaaagaagcatgtccatgaaccatcatgagagatgccacagtgatccgtatatatgatcatgctgatcatcactcatcatcctcatctcataccattttggggccatgcatagttacatctgcatagtcctgtactgctttgtgacagcaactttatgctttggggttataatttcgttttccatttgactgtgtttggacagaggcaacccccaagtcggtgttgagactgatgggcatgaaaggtctcaccttgtaccacctcaagagccatcttcaggtctgatcatcttttttttactggtttttcttttgctttatttgcttcttttgatctaccacctacgatgctaatatgtgcttcttggcgacatctttttattgatccacagaaatataggcttggaaagcagaacaagaaagatacaggcctagaagccagcagaggaggtacatgcttttgtaaatactaaatacttctcactaagtactagtaacaaagatgtttttaaaaatgataaacccatcacgcatgattcatttctgtttcttctaaaccttacatttttcatgctctttgacagcatttgctgcacatggcatcagttttgcctctgctgcacctcctaccatcccatcggctgaaaataacaatgcagggtaagttagcagtcatcaccatgcttaattccagcttatgccaagttgattgcagtaagggcaatctaattttgactctgtcgcgtcgaaagcaacgccttcaagatcatgaagaggtgtatccgtgcaggactaacagcatctttttagttggcagggggggtacgagataggctttgtatatagagcgattggtcgtactatttgcgatttgtaaatacggtacaagtcatctactcttacagaagtaaatgcggtgcttaatttatagaggaaaacggtataggctgctaatgatttggaagattaggttgtgtgaaagggacactgtgtgctaaccgtctgcagatcaggtcaggtgttaactggtctgttgcgaaaatggaattttgtagtcatgttacatggtactagttccacaaaataacataaaaaaacagctaataagcagcacaaattgagtattcaggaatcggtctgtctctatactctgtcgaagcattattatacagtatactataaaaaatttgccgacagaattgcattaattcacttgaaacaaaaagaaaacaattgatcgcaatcttgcatctaatgcaatcactttctgaagtactaatccattttagaaaaaacaataagtattgtttgttttatgctttggatgagacgagcaattattcagtttggttttcaatgtcgcattcggattggcttataatttcttgaacaattttgtcatgattcagagaaacgccactggccgatgcgctgcggtatcaaattgaagtccaacggaaactgcacgaacagcttgaggttagattgccaatgcatcacccattagcttccctgcttgaatcgtagtgtagctcagaacacaaaaactaacaggtcaatgtgttgctccacgtacaggttcagaagaagcttcaaatgcgaattgaggcccaagggaaatacctgcagacgatactggagaaagcccagaacaacctctcctatgatgcaactggaactgcaaacctcgaagcaaccagaacgcagcttacagatttcaacctggctctttcaggattcatgaacaatgtttcacaagtgtgtgaacagaacaatggagagctagcgaaagcgatatctgaagacaatctcagaactaccaatctaggctttcagctctaccatggaattcaggattccgacgatgtcaagtgttctcaagatgagggcttactgctgctagatttgaatatcaaaggaggaggatatgaccatctgtcctccaatgccatgcgaggcggcgaatccggtctgaagattagtcagcacaggaggtaaagattcagtagaatggcgaccatctgtagtttaaattaagagttacctttgtcctatgagaaattcttttgtggcgatattgagggtgcttaagtacagtgttggtccagagtgtactaatgtaaaatttgtggggtaaaggctctgaataatcgtagctaatcaatcatgtctagatctgaatatcagaatatatacactgtatgagtattcgtacctgcactctaaacgactaaagcaaaagcattatcaagtcttgcaacagtccaaccacgttgaacttctggtcattttgtagtagaaaagaatccttcgtggtatcattttggagtaagcacaccacatcagatgatcagagcaatcaacggcaagcattttgccattttactacaggggaaggtctgactgaacattggtgtagtgcagctacaaccaagatgtgcagcagaaaactacatctgaaactgaaaggatggaactggagcttctgaattctgaaacagagctccagcattactgaggtaatttatatcatttgggtgctaaaaccagcagttagtgcagggttcaaatggatagtagcacatgtgaaattgaccaaacagataacaggacgcaaaatgattggtttccaactttccagcgaacagaacaaaatgcaccaagaatgatgcagtctacgctaaactgaataatcaatgtattaacccacaaacagtggctatcttatggtagggagttcaatagcataattccatgcacacatgaatccggatcacgagaaatcatgtcaactcgtgaacataagaacattgttatttgatactatttctcatgtatgttcctaacttcctatctactactgcggtagcacagatcaacagcaactcgtgtttcttggtaacaactgcagagctgagcaggacacaagccgccgtaagatttcttcagtgataatcgagcggggcagggatatccttgagatccatcccctgaaaatgaacatcctgcatgcacatcacaagcaaaagaacaatccagtcatcacaagccgtacacaaagcccacagcaaacttaggaattcacacgcacgtaccgacgcgaagtggttgacgtcgcggtggtgtgcctcgtcggcgcggacgacgacgacgacgtccttgagcgtggcgccggcggggaggcgccagtagtcgatggcgatcggcggcgcggggacgttctcgatcttgccggcctcgatgtccttgaggtactcggtgtaggagtggatggcctcctcctcgaggtagccgacgacgcggtgcgcgagcttgggggacaggaggtagccgaggaagtaggcgttgaagaagacgccctggacggcgagcacgagcgcgcgctcgtaccacctcggcttggccacctccatgaaggtcatgaggtgcatccgctcgttctcggcctcctccagcagcgcgcggatccagccgccgctgtgctcgaagcggcggagcgaccggaggtgcagcagcatgccgcccaccatccccggcaccgccgccaccgtctccagcatcatcgcgcggcacccgtacctcctctgcaaaatcgttccattgattcccatccatttcgatcagcaaaatagattggcatgatctttgatggaaaattagttgtggttggttacctggaagaagatgtcagtgggcacgcgcagcgccttgacggtccagtaggcgaccttgtcgagcagcaccttcggctcgtggtgcttcttcaggtcgatcgtcgtgtccggcgagtacgtctcccatggctgcaaattagcaaacacattaattcatcgacgcagttacacaaattgaattcagattagttaaattaacagcaaaaaagagaggaagcgatctttaagcaggatcatggataaatcgattcttactctgaagcaagaccacttccactcgacgccgtccttgctcgcgagcttcgacgcctcgatgccccagtagctgctcgccacgggactcgcagtcgcactggccggcccttccttggcggccttcgtcgcctccgccttcgcggcggcggtgctcccggtgttctccttggacgcggccgtctcctccttcgccgcggcggcggaggtggacagaagtcgcgcccacaaggccacgccccctccgccggcgccggctaacggaggccgctgcgcatgcgcatgcgcagccgcagaggtcgagctggagactcgggggcagaggtggcggaggaggactgatccagcagcgcgggagcccatcgccggagatcgtggagacgctgctctgctcttcgctgaggtgtgcgtgttgatgctctgttcgtggctgcagacgtgccggtttctggagggggctagcttcagcgtgcagatccacgtgtcggcgatttcgttcgttgctgcttcttcggatatacgaggctgttcattttttaaaaaatatatttaaccgtttattttattaaaaaaatttaagtaattattattcttttccaatcagttgattcattattaaatatacttttatttatatttttatttatatatatagttttacatatagttttatatattttgtaaaagtttttaaataaaacggacggttaaatatatttaaaaaaaatcaacgacatcaaatattatttgggcacgaagagagtattatactgggaaaaggagttcatggtggctgctaagcggcaagctgatagcatcatagcagtggactggtctttcgtccacttctttcttcgtattttctgtggactatatagttgctttctgtgtagaaataaaaaacgtgtggctgcgcacaatgatcaggtgacatcgatcagttatgtacgcggagatgattaaagcgtataacatgcgacatctaggagtagctacgaaaatattagaaaaaaaatatggggactaagttttttttcttttggcataaggttcaattctttctcattttttagcaaaatggcatcctaattacatatataaagcatatccactaatcagtctatttttttaagaaatccaataaaattctaacaaccacggtaaccttttgacatccacaatataccataagaatgagtcataagatattatgactagtcatatacattatgggcactagccataagacattaaatgttaaaactagccataagcttacggctcaaccttaagaaataaaataataagataaaatacactaaagagtatgaaaatagattatggtatggtaggacctaccttaaaatataatttgtttacatagatgtgagacacatcttaacatctattcttgtcttcaatattatagtcatggatatatggtatgatgggacctaaattattttcaccaagaccttaagcattgctgttgcccttaatatgggaggagatatcctgttttttcatattaaataattatagaaaaaaatagtttaacatgtaacatattacaacacaagcacataaattaaaatacgatatgcaacaaaatgaacaaattaaactacaattagttaacatatattcataattattttttaatttatataagttaaatttaactttacatgtttatcaagtgatccagcacaaataatatatatttttaatttttcataactatttggataacatataaacaatgagggaaatagttttgtttccaattgaatattaatattagtgcaccacctttttaaatcctaaatgaaaaaggtaaaaaaaacacaaattgaaagtttacaacacatgtaactaaggtgccatgattcctgtaaaaaaaatgccttaatgcaatacatgacaagcacgggattgcatgagcagcaataagatgtgaagacgaggtttgaactcacagtcttcattcaaaacaaagaaagagctttgaactcatggaaaaatttctccaaaattccaacagaatagtgcttccgttgattttcagtggatttcgttggattaaattctttttgttgcaacgtatacatgattctgcaggacttcttttttctccctatagttggactgcaatccaaattgtccattttccagttccagggcctaactgatttctgggcgtcctacggaaccaacggctcgtccggcgcggcgggcgggcgaatcacgccgatctccgggagatccgggttaacggagaacctcagccaccgcttcttctccacgaacctcagcgccggctgcagcacgagccccatggccaccgcgccgaggctcaccaccgccaccttcagcgtggacagcgcgagcaccacggcgatcagcgccgtcggcggcaccagcatcgccacgcacccggctgtgcccagcggcaccctgtatgggcgcgccgcgtcggggcgcctcacccggtgcaggatgaaggcgacgaactcgaggagcatgccgaagcagtagaggaagttctcggccgccacgatctcctggaagctcatcatcgagagcagcagcacgccggaggccgagaagaggatgcccgccagcggcgtgccgtaccgcgaccgcgccgcgaagaaggacgggagcatgccccgctccgccatgcccagcagctggtacgagtcgctgctcatctccgccacgaacatgcccatgttcgacagcgccgccgccgactgcacccaccacatcagccacgcgccgccgagcagcttcgcgatgtccgcgaagtagccgtctgtccactgccccctgtccagcggcacggctcccgtcccggcgaggagagggtacaggtaggcgaccaccacgaagatgaccgcgtagaacagcgccttgggcagcgtcttgccgggattcttcacctcgccggccaacgtgctgatcgaatcccagtagttgaggttccagaacagagtgttcaggtacagattccaatcgacgttgtggaggtcgatcacgagccacctcgccggccggagcttggggagcgcgatgagccccatgacgaaaaaagggaggagggagaagacgccaaggcagatcgccacccatccgacgacggtgagcccccggtaattcagcaatgtcagcacggccgtcaggccgacgacggcgaacgccctcggcgcgcctccgccgagcgccgggacgccggacttgaggtagtccaagaagaggacggggtagagcgcgttgtcgatgacgccgctcaaccacttcatccacccttgctggaacccccagtacgggccgagcgccgacgccacccacacgacgtacccgccgttctccgggaacatggcgcccagctccgccgtgatcagcgcctccgggatgctccagatgacggggaggaccaagaagccgatgatggcgagcagcggcccggccgcgcccacgctgtcctcgatcccgaacggcccgccggacacctcgtagaagatgaggaagatgagcgggatcatcgaaaccgtgcgtgccgacgacggcattggcccgccggcgtcgccgtcggggaggcccctgtactccgtgccgcactcgcccatcggagcggcaccgttcgccggttgggcgctctcgacggtgggcttctgcatgtcggagaagagaagaataattggttatctatacgaaagcattagcagaagagatgtattgttgagttgtagtaggcaactactcgagttcaacaaggagacccgcctgcaaaaaacacaagaaaaacacaatgacaagaacaaaccatgtgcatgtagccacatagtatgtttagacaaaaattcttgacgaaaccaggcgttttgtcagtacgaacgaagatgtaataccgaatcaaacaccaaccattggcccaccgtgtaatcttgattgtgaagaagggcaagaactcaccaccagaagaagctgcttaatccttcaatattctaatttggtagtctcaccggagggttcccatctcaagatcgtgatggacccgaaagaacagctagaacctgaagagggattggctcctttgctccgctctctttagcatctttcagaaataaggtacttgctgcatcttcgacgaagacatcctgcattcctactacgtatcatcaagctatcaaccaagcccgcaagtggatttgtttggtgaagcagcggcggctcacagagagctgagagaggtggtgccatgcggcgttcggccggtgacacctgttgcggcagagacggccacgcagtccgctccggctacacttgtaaactgcagggctaggtggctgcttctctcccgcctctccgctgcttcacggcccaaaagccttctagcacaaacttacaattgggccatagatgttagctaaggcccacgtctagcaaattgggccgaatcggcgaatctcgtcagccctgacagaccaagacatcgatgcttcagttccttcctggtccatggctgcaccgtacaggttaaaaagtcgtacgagatgggccgaatcaatgcggaaaacttaaaagatcttatcccaaacaggggtcagattgggattggtagcgatgcgacgagagaggggaaccgattagccgacgaagcgatcccggtgcacggctggctggcgaacatggccgcggctctcactcgcacacaagtagacgtaggagtatacacgagcagctaccggcggcaaaaccacgagaaataggattgagatggagacggggatcgagcgagctctcacctcttgcccggtgtcagcgtggccgagatccgccgccgccgctgccgtcgtagaagctgccgggtggcccggcgaccggaccgtggccagcgacacctccggccgtccgccggtgtccgccatggatcccccgatccctccttcctcctccccgtgccccggatgctggagctcaacctgattattattacgcctccggccgtgcggagtggaagcgcgcatccagcataaatagtggcagtacgtcgctttccagtttacaaattatcaccagcgtgagcataaagcgcgcagcacatttggactgaagttgaaccaaacgaatagaaaaacacacacgcggggaaaaaaaagaaaaaaaatcctcacaaagcgattgcctttctcgagagcaaatcttgcactgtagcgtgtgcacatggccagtgcccatctctaccgtttttgctcctacacgagacgagaatgtcagagtacgcggcatatgccaagcaaggccgtgcgggaacacttggctttaggttgagttcgagtttcccaactcactcccttcatttttcgtgtgcacgttttttaaactgctaaataatatattttcagaaaagtttatataaaggcgctttaaaaaatcatattaatctgttcttaaaaaatagataatacttaattgattatgtgctaatggccatttcgttttccgtgggagagtagccgtgcattgaataaaaattggtctcgagcagggggcgccgctaatgctagccccgtggtagtacaatactacaacgcagcagggcgattcaacccggaaacgatggaaaatcaggcatcttcccatgtgcacatggcaaagcaaggggcctctcgttctcatctgctgttatgactatctgtgcgagccgttccggcggctgtgataaccagatctagcacgtgatcaagcagtgcgatttatggacggatccccgcgacggtcgctgcgacgctgcctcttgacgggtcagaagttaatcagcaatcaggagtattcagctgagaaaaaagttcctaattgactgtcaacaaagtgacaagacttcagtcgactggctgagttagttcggcagggttagaacaactgtcaccagaattagaaaggagagaatataagttgaaaaagtgttaaaatgagcatatccgaataattgcacattgagcggtatgcctagaaagtaaagtccaatgcaactagaactggtttatctttggatctgattctgacggattactacaacaatagtatcgtttctttttacagcgaatcctgcctactcttgtagtcttgtgatgatcagcatcaacggacataaaaaaaatgacagggttacagcgaccaacattatctgaaaaaagaaatactgacagggaatgccgcttgcagtttcactgcgtggagtatattcccaaacgttggattcaacagaaaacaggtagtaaatcatattaccatctcaccaattccgccaccctaataatcgaagatatcatggtccatacctgttcccgaaaaaatacaaatccaaacggaagcaacccggcccaaaatcccaatcatagaacaaaccacacacatttgttggcatcctgaaattcataagcaggtcggcttctctctctcaaaaaaaaatagcaggtcggtttgtccgtcagagcttaaagatcacatcaagctgacagggcgaccagccaccaaccggggagagggagagcgagaaagaatggacaggcccgctgcctgcgcgcaccaccacctgctgctctctctctctcgcgtcgggggccagccaatacacttctccgctccgcatcaccgtcgccggtggggaccgcggcgaggcgatgctgtcgatggcaaggaatgtagagaacatcggccccgtggctcgtgaatgggaggggagatcatcttcgtgctttggcaggtctaacctaacggctggcaggttgcgcccccactgcatttgccctttttcttgttagcgaaatcactgcacttgatgtggtaaccccccatcatcagtaggagtaataattatcacgatccaacaacaccatcgcacaaaaaaagtccgcccgatttaaaacgagcttttgccgtatcggctcgcctgaaagcgtgtcattagcatgagccaaaggaaggagagggggtgaaaaaaaagggggcagaaaggaatactttcccttccgttggagcaaagcgggttaaaaaagggttgggaggcagataagaggggagagtcccggacggagcgcgatgccggagacgggacgggtttgaggttggggagtatggttataaaaagtaacggggcgcgacgcgggtagaaaccgtggtggaggcaaaggcgccgcgggcttggcttggctggcaccctctccttctcgtcttcggcttcgtcttcccccgtcaaacccacccacgccggccgccgacgccgccgccgttgcggcgggtgcttcccccgctcgcgtcggtgccggggggctgaggggaagagggggagggggagggaaggcacgcggctgacctcgtgggggaggggagggggggaacggggcgacaccacccacccaccgccaccatgtgctcgttgcccgcctggtaaggtatggtatctgtttcattccattgccccccatctttctcgtgcttgcgcccctgcccccgccgctgtactttcgcgtgccctggattagctggttggttcatctgcttgttgcggcgcgcggcggatctgtgcctccagccgccggatctgggtggttcgcgggcgttcggtgcaatgcgagtctgcgcgtaagtttttttttgtgtgttgtggtgaacagtggtgataattattgcagggtttttttttttatcttgtgggggtcgtgtccctgttgggacctcggatctgttcttgtttcgtggctaatttggattttatggcagaaggaagacgttttgtcacaatagattgagaacgctctctttttccttcccatggatggtcataatctgtgccttttggtgcttagcgttgtaatttgtgattagggtagcaatgcagattgtttcacatcatgttccaacccaaggcaatgcttctgagttacgaaatgtttgtaatatttatgaccttgctgtcttgccatgcttgatcgatcattgttgttaaattggatacccgcattacttccaattttttgcacttcttaggtagttaggggtataggatgatcattccatgtcgacgccttattgcaactgattgaatagtagcatcggtgtcaatattttgtcaatgcagcagcaacactctaccttatcaggcaatgttacctatagtgcatttttttttattctaggaggaagtgtatttgattgctgccaagaaggcagtgcttcattttgcacacatcagttttggtacttgcatcatgtggcctgtacatcattgtttgcaaagaagagaaagctgaagcgctataaatccttcaagcagttttttcggtctaaacccagccatatctgagtatgttagaatgattattatgtgcaaggtttctgtcggttttgattgtgatcctcagacataccttgtgacgcagatattcatgctgagttgattccttctagtcactttgcatgtacctatagtttgaacatgtgcacggaagtaatgatctttgactgtgttatatgtttctgacttaaatctgttatattagattggaccagctgtgatttggggagcttaaagttttgatcagagacatggaaaaagtgatcttctgggcacatctccttaaatgcaagctttttctttcaaaagaaactcttgattggtgtgttttagctcgtgggaacacccaccacttctctctggtgaactacacatagtggttttatgctcctttatgctcaagaacatttggctgattcaatctttttcctgaagccatatttcaagtctgccaaacatctacatgtaatgcacctacttcatagcttgttcttccttcattttgtgtcatatggactaatttagctaaccaccatctttttattctactagcacgtcatctctaaagaagcttcctttaagttgtagatgctgatcatataagctgggtatgcctctttttactgttcattgatgcatttattggcatttagagaaataaattcttgcaacttgaaatattctaaacaacttactccttcccttattttgtagggttaatacctttgctcatttgtttgtcatctgttgctccctagttaattaccactagtgttgcattgaggtcagggttcatccttgctatagtatgcaactatatactatggttgctgcttgatcttctgagtgaaccaagatccaagaaaacataaggtgctggggctactgttcaattgactggttgcatatatttgttcgtgctaatcgatagactagtcaattggaagtggtggcaaacacctgtctttgtgacttggctgtccaacaggaaaaggctagcacaaggctgacattgaccggcataatggacaggtaactttcatattgacttactatttttaggtcacctttttcttatcaagtatgttgtctttgcagattcaaaatgattaaggaagttggtgacgggactttcgggagtgtatggcgtgctataaataaacaaaatggtgaagttgtatgtatctgaagataaatccataggaggaaatatgcatttcatacttttgcaaaatattcccagtgaaataaataactgattgtaagcaaaatgtgcactgatctataggtggcagttaagaaaatgaagaggaaatattattcttttgaggaatgcatgagtctacgtgaagtaaaggtattttaactgaaagatgtaccctctttcctgctatgaaccttcaactgatatttctcctatattgaagtctttgcggcgcatgaatcaccctaacatcgtgaagctcaaggaggttataagggaaaatgacatattatacttcataatggaatacatggtacttaaggatgtcatataccgcaaaagtttaattagctctgtatcgcttttgttaagtctcccatgttcttccaggagtgcaatctctaccaacttatgaaggatagagtcaagcctttctcagaggcagaagtccggaattggtgctttcagatttttcaggctcttgcatacatgcaccagaggggttactttcatcgtgacctgaaacctggtaggttctcttgtttagtcaacatcttcacctatatttctgtggcaatcaaattatgaaactacggatgagtatcagatgtaggtatgcagaatcagggtattattgtattgagaatatgagacatttacctttatttttaccacatctactttgcaaactgaccgagatatactttctaataaatatatactttcatgtgggattgtattgtgcttatagctatggcactaatcactgtactaatgcagagaatctgttggttagcaaagatgtcataaagctggcggactttggtcttgcaagggaagttacatgcgtgccaccatacacagaatatgtgtcaactcgctggttagtagcactctactcgcacacgtggacacaaaatccttttctttgttaatgttgatccacatgtgtttgaacatatcaggtaccgagcacctgaagtattgctccagtcatctatctatgattctgcagttggcaaagtttctactatatactttgtattttggcacatatagtacatactaagtcatgattggatgatcccctttttgcaacttgcagatatgtgggctatgggtgccataatggccgagctgttgacactttattctctttttcctggcacaagggataatatgcatatatcatatgtatatgcattgttggtatgatttggagacacgtatctctctgtgtttgccatgtattttgggcatctgttattctgtctctcttattatatttcttctttgtggtggtcatatttgctcattgctgttctctttatccaactgtttagtgaggctgatgagattctgaagatttgcaatgttatcggtagcccagatgaacaatcatggccacaaggattgtctcttgcagagaccatgaagtttcagttccctcaggtcagtattcatcttccccttttccctttgcctatatatgttttcttttgggggtaagctctttgttgtgattatacttgtttctgaatgtgtcatgaatctttgatatgtgttgagcccattctgcaactgtttattttaatcccttggtcattctctgatgaattttgtccttgtgcctccctatctctctagacaatggtggaattatatcacttcgcatgccttacaatctttcatctccattagtccattgcctccttttcctcgcatattatcataggtttaaaagcgtagtgtcttgttctaacttgattcatgagtttgacatagattgtccataaatagtgggcttaacacttaactaatctcatgtggatcttatcaatgcaggtcagtggcaatcaactggcagaggtaatgacatcagtcagtagtgaggcagtcgacctgatttcagtaagttctacaattctgttgccccagatggcgtacttaaaatctttagattattttattatatttgtttctttctacatctgcagtcactgtgctcatgggacccttgcaagagaccaaaggctgcagaagttctccagcatactttctttcaggtaaaattactattcgaactccgttgctgttgtctgtacctctgttgcagaagataaatcaaatttatttttgccatccactagggctgtacatttgttccacctactgtccggtcaaaagctggagtgctccctaaaacgcctccatgtggttagtttccacactgttttgcctcacaaccttggtgttcctggtactcttggttatatctatgatctatttgtttcagttggagtaaaaggagtttcggagcacggcatgcctcgaagatactctacaggaactctatcaacaaccaaacctcatagtaatgcatctctgaaatcaagtggcttatctaagaccggtaatatgtttaatcttttttctcaattgcttgttagcttgcattgtaggctatatttttatttctctttccaccttccaggtgtacaaagaaaacttcaaatggatcgtcaggcgccacagaagattaaaaaacctactgagagtaataataaactaaccactaatcgagtacctgcaaggaatagcccaggcaagtttccatagttgctttatttgaattctacatcaatttgtggttgactttgaagatttacattccctttgtggcaattataggtcaccctgtattaaggcattcacgcagtttacctgaaactggccgggcaacaatgcacaaggtttcaacccttaccgagagattaactcatatgtctgttacctctcgaacgcgtactactcccaagcctgctgccccgttactgaaggctgggctcggcaagtctgacttactgggaaaaacagacgaaatacctcctgcaaagaggttgacaagaaaattagtaagctaacgtagcagcatccatacagtggaagctggttagctggtgcagagaggtgttataagctacagagcaaaatcccggtctgctgaaaatgatggcactgccggagtgtttgccaaatttgctgcatccaagtgccatagtagaataagtcgagcctgccgatccacgtggatctgcttttgccccaagtttgttccatgtttgaatagaacatgagtgtgctatatcgatttgaattgttgtcgaccagtgttcactcgcatatgcggtctgacaaatgatagacccgcgagcaggaggatgtttggcttttgcttgtacagtttatgagcttttgggtggcggtcaagtctttgtcgggtccttggcaaatgatacaatgcatagtctggttttgacttcgtctgtggctctattcaggtctttgtttgaagatgatgtctcatttctcatgaaccttcgaatgttggaaatgacctgattgtatcactatcgtctgctctactttggacgaacctgctagttgtgcatgaccggtgcacttaacaagcaatatatacaccattctaccgtcgaggatcacatgaaaccatgctaaaacaaacgaattaaacgaacaccctgtccataaaggttacaaacggaagaccaaagtggtcagttaacaagagtagcagcttgactgagcctgctgcttctcagaccacagcatccttccccctcatcctatattcaccctgtaaaaaaaacctagtagcactaaccgtagcagcggcaaagtagtagtatcatcacactcttaactattcttcccggcgacgcgttagcttctgtcacagtatcacttcactctcatcaacgatgggtctcgcgttagctcacagatactgcgcgtgtatccggtcccggttctgctcccaccacaccttggcccgctcctcgccaaatctctcgcggctgcaacgttgcgcacagagagaagtgttaaaaattccacgcgaacacgaggaaaatccagcgtgatctgccggtattggtgacgtgttagcgttttcgggatgtgtgtgtggactgtggagtggcttgcctgaaccggacgcggcggagctcgcgggtgccgtcgccgaactcgcggatggtgatggacaccccaggctcgtcctgctccacccactccgtggcctccaggtcgctcgcgttgctgatggacacggacgcctcgtcccgggacgacgtcgtgccgcgcgacgggtcgtacggcgccgctggtccggcggccgcggagttgaggaggttgaagtggtgcgcccacacgtggtcggacgggtccggcacggccgtggacgggtagaacggcggccgagccgccgccaccgacgacgacgacgacagctgcgccttgctcgacgctgtccggctgatcgggtgctccctgccagcacccgacgacggcagcggcggcggcggcggcatcatcatcgccgggctctccctcgtcgagccgacgcgggagtagaacgaatctctctgcaaacatcaaccatcatcagcaacggaatgtgcagagcttttgctaaccagtgatggaacggaagtgacctgcatggcttcgtcgacggaggacgtcggcgtcgagaagccctgctgccggctgaacgtctgcacgttgtagagctccaccacgcggtcgtagttctccccccaccaccgctgcgcctcccacttgttaaacatctcccggctgcatatgcatcgccacaatccgttagctcatgctcatcactcgagcaccacgtgctcgacgaaatgtcatgtcgcttgattggcacgaacctgaaacggatgcgcttcagatcgttgccggcgccgccggggatggagacgaaggtgatctgcacgccgggctccacctgcgccgtccactcccgcggcacgcggtcctcctccaggaggactgtctcctcgtcatcgtcgtcgtcgtcgtcgtcgtagtcttcctccccgatgctcggtaccccgctcgcgctcgggctcctgatcacgcgcggctggaagctgcggtggttcaccttgggcggcaagtcccacgtcgacggcgcggcccgggcgccggcgctcgccgtcgtcgtcctcatgtaagtataggcctcgccggccccgtccgacgtgaagcccgactcgtcgatgatgcccgggtacgcggcgaggcggctggagcggtggaagcggctggtcctcaacgacgggctcccgccggacttgtattggtgcctgccgctgccggagaacttgagcaccatgtccttcaactgaaaccacattaaatttgtgcagattaattaattatcctcctgaataagggatcaattgattttccattgtaaaaatatttattaaatatccattagtcaagttaacatcatccttttttttttttgaacgaatgccaagttgacatcatcatacaacagatgatattatatatctgaggtaacatttttgccttgcatattcagtaaatataatttcttgcaattggcaacagagtggctgcatataacttttaacatgccattgcctttccagtatataaaactgcgggagtttcgttcggggcatcaacattcaccactaacgcacacgcctcagcaatcaaatcctacgcgacagctcggtctctcaagtaaagcgccaatcatatccacagcagggttaatgatcaccgatcgattccatctccatcccgatgattagggctaacaaaagcaggacagggcgcacttccgacccccagattagtcgcgtagacgcctagcagaagggctcacacatcaccgaaaagcaccaacaaaaccatcacaatgtcctaaaacccaggacatcttttgcctgaactctcaagcaaggaacaaagcaaagacaaagcacacccacaccacaccactcaagtttctcaaagcaacatcgtggacagcgcccccccccccccaaatttttgggatcataataacaccagagagggaagggaatcgatccggtccattcacacacacacacacacatagccacacaggtgcatgtcatgtggtgcgtgcttatgctccaaatatgtgtagtactagtactgctactttaaaagacggcaaaggcgaaagcgtgcaggaagcaaaggacgagagtactcgagtcccagtgacgaggcgtgtcatcatggagtagttcagagatgggtcgcagcgagagcccatcttaagaaacaaaccagcccatcgcaaggaccacaagtgtgtgtttctgtgcatggcctacgggctggctacggcccagctttattcttctctgagtgtccaggaccgtcttgggggggggggggggggggtccctcttaagaaaagaaaagggaaaggaacatcttggactgaagagagtagctgcttgtttgataactcgaaggggattgggagtttacacgagggagttgatgatgagattaagatgggaatttgatttttaatcccaatatcttatttggtagaggtgatagaaattgatagggaatttagttggagattaggtcattaataaaaacggatggctgagatttggttaaacaaagtaaaggatgaattccctcctaattacctgcccctacccagttattgaaaaggagtgagttccttcctcaattccccatcctcatcccaccaaaattcccatgtctcccaaccaaacaaaaattttaatagcttcatccctctaaattcccaatccctactaaaaactccctccaaccaaacgggccgtaggagtaagacccaggggttaagatcaatcaaccagatagtgtctttccaggagggaaagatcacattagcagctactaggataggacagtcttttgttgggagcaagcaaagtgaatggatggatggatggatggagcaagtgaaaagggcaggggaatggtagtatgggggaacagaagtgaccatatcaaatcagtccaaaacccaaagcttgaggggatccatgcaagaaaaaagcaagagccttctctcccccaccaaactctagtcatattcccctgggccttgagtccttgaccaactttatcaaggaatgttttaaaatgtagttagagcactgtcattcaccttgtacttgtgattccatgcaggatattgccctgattagacacccggtgaggaagggaaaagaaaagagaaacggtgtatatcaccacaagtgtactagtattggttgtcctcctgtacgtagtggtactctgttccctttcaaaggccaagaacaaggtgacgacaagcaggctaggacaaaagaacaactacagtgtaatactttctcctccgtcccaaatgtaagcatttttgaggctgacacgggtattaagaaagtatatgagaatgattgaaaaatatgtgtgattggttgaaaagagaaaataggtgaaaaagaatggttgtgattggttgagaggaaaagataggtagaaaaatagcttcattttaaaataaagtactgtgctagaaatagctatattttggaacggatgtagtactagaagtactagcaccccactgctaaggagcagcagagggcattcaattgactggttaatgcaacagaagaaaatgtggcatcaggtctccgcccatgcgctagtgcacaacatgtgcgagtactacggatttttacttgtgtacggagtactggagtagtataagaatgcacatcagcacatgtacctgtgaagtcagagacttgccggagttgggcgtggcggtggcggaccggtgcccgccctccccgccgtccttggtcgaacacgcgatgcacgcaagcatttcctagcctctcgagtagtccagaaccgcgcaaatcctccttccctgctcagtcacaaacaaagtccatcgaagagccaagggaggagattgtcactcgttttccgcgcttttcaaactactaaacggtgcgttttttgtaaaaaaattttctatagaaaagttgctttaaaaaatcatattaatccatttttaaagtttaaaatagttaatatttaattaatcatgaactaatgactcacctcgttttgtgtatcttcccaatcttcccaatcctctctctctcaaacacaccctaagataagaatctggtcctggtgtatcaaaagaggaactgagccgtcacgcactcacacggctaaaatccaacatgtactagcaacgtagcagtgccattgatccagtgtgtgcaaggagtaaatacacggaacatttctagtagcagcaggtacatcagattacactgcagccactgccatggctgcagtgccagccggccggccggccggcatcaactccgagctgagtagccatagccagtgagtaaacgccgctctagctaatgcatgccatgccatggcctgcgccgcaggcttttgccttccttaaaatcgatacaccgacagcaacccctcgccagccgagtacgctgccaccatggggcgcacacgcccgcgcgtgtgtatatccatgcccttgggccttggcgcggccggcctgggcccgaacgcatgtttgcacgcgccggctcactgcagaccactgccatgtttgagctctggcttagctaggggtaggcgaggcatcgagcaagaaacggagtcaatgccccccaagctttggctgctttatggagtagtacgtagtatgagaggtacagggaggtagctgcggcaaagtatagcccgggtggtggattgattgattgatgcatgcacggattgatattactgcttaatgctgctgcaccggtgggctcagtgtgcaggcgtgcagctagtacgtcgtcgtaggtagagcattcattcactcaacaagcataggcttaattatgcttgctactgcagcaacaggcaacaggcaaccaaggcatgcatgccgataatacacgagggagcagagaaggttctgagaaaaactgtactagcaggagctcttttatctactcctacgtgaggacactgccactccgaatccaagtgcatcgtccagttccaagcgaaaggttggaagcttggagagcggccgatcgagctgagcaggaggcagatagatagacggatgatgcacatattgcacatttgcatggatagagagaagcccttttaggaccagggccctcatggaaattttatcagtggttgggagtggattggaggacccactgaaggaaatggaaaggcaaacagaagccttcttgcagtgtaacatcccaactaaaaaacagtcctacttgcacctacaaaattcgcgtgtattgtactattgtaatactaccgtttttagtttaagcttgttatactacaaagggtactaggagtaattaccaatggataagattgattatatagttaagtgtggatgacgacaagtgagaatactgcttaccagttagcaagccaccatcaggctattgctcatccaaagcaactcccgccaatcacagtctcgcagcaatgcttgtgaccacgcggacagtggtatctcgtcactgctccttctgacgcaaagatgatctgaacaacagcgacagggaagagaaggtgataaagattacgcaatgtacatgtggccgactagaaaagcataatgctcacttttatctgcaaaaatactgctaggacagatatttagccgattgttcgctgtccaaatcgacaagcctgactctataaagaaacaggccagtactcattgctgcaagaggctgtcgacgctacggaaaaaaaaggcaacagtgggaagcaatgggattgcctccccaaatggacccaatggaaggctggagatctcaatgatcgacaacgcaaacggacccagagatgaacccccctccgaaaacgaaagcgcagcaaatggacactagagcagagcacaggacacacggagctactccaaatatgcacaccataaaaaaagaaacagagaaagagatggcaaagatctcgttctccgattcaaggggaaaggaaacagcagtagtcactggtcagttaccttcttcctcctcttcttggacggcgggtggctcctctctcggtcgacagatcctcgccggcgcgcggcggcacaagagctcggaagcgacagaggagagcggctgagctatcaggcgatcgactgccgccttttgggtggtagctagcgaacgagctgccgagcagcgacgccaacagaaacaggacgaagaggagatcttttccactcccccttttccttttcttttctttttttttccgcgagggagagaagcagggagaaggaaggattgagaggaaacgggcggggagcagaggcaggaacagagcgggagggaggggggagatccccggattcgctcgcggccgtctgatccgcccccgaaatcgagcgaaagcactcgccgaccgagccgtcgacggctatttatacaagggagaaaagcgctcgcgatcacggccgtccgtatgtttcgctaggctgcgacggccaggatgcgtggcgcttggttgggggagtggggtgctttggcccacgtcccaggccttaccacgcgcaccgtaccacacctgctctgcgtacgcatttttaacgtggtgcagccgttggcagttggcttgtggctagcggccggcttcgccaccctcgcggtcgcggtggcatttggcaacccgccaacttgtgttgtcgggctcggaccatgcgcgtgcgcgcgggcgacgccaacgtcgcgcctgggaagaaggtcgcggcagcgtgggtgtcgggaacgtgtgtttccgccgagactggcagcgaggacggtggcggttttggtgttggaaggcgacatcccggcaatgtcggctgttccaaaattagtactacaacgcttgtttatggaacttgtcgacaggtgatacccgtagaccggatatagagggtattggggtacgttggtataaggatctacgtaatacgacatcaagtagacaaaagacgaggattatactggttcaggccccttggtaggtaatagccctaatccagttgatgtgggattatatggtggaaaacacaggttataaagggaacaatggaacttgagggatccggcgagatcatggtctagttggttcgactagatcctcggcgatttggctccttgcaggctccgacttcgtaggctgtgagggttatgttggctccgagattcgatgccccaggtcctcctcggggggtcccttttatatcgcaggtcaggcggtttccaagtagaacttagagataatagaccctatacaatacattgacgacccagtcttgtccgagtaggactctttccatctgtagactccgtgaagtatttccttagtgtacgcaggaagtatccgtatgcgcgtgggtataccctaccaatatataacatatatcgaagggtaaagggtatgcctaacccggaaccctgacagtagcccccgacttctgcttaaatgaactcgtgtaaccattcgcgacttcttgtgttgagactgttgtcgctcccggtgtgaggaccatagagtcaggacgtagtcgagaacaccgtgtgaagcccaacggtcacgagtgaatttaaactgaagtccaaaaaactgccgcgcgtaacggacccagaaatctccagcgggcatctctcccctttccttggaattcgcaccgtcggaagtgcgtctatttaagggaattttggggatccattttgaagtccgcctagtgtgaagaaaacatcccgcctgtaagcgctctttgtcttctccgctgccacaagaaaccctagttcatcgacttgagccctctcttcggcgatctccgatcagcgatggatctcggcaaatcatcctccaccagtgcgtcgctgaagaagcttcaggaagacggcgcccttcccggtcgcggaaccatggaaagagaagcaggaggtactaatccccagcccgtcttaggtcgtatggttgcgatcgaagactatattctctgcggttttctccctccgccttccgagtttcttctcttg

SEQ ID NO: 38240 - DNA, 3878 bp, Oryza sativa
aagatcccgtcggtcttgcgacatcatatatgaaactcaagatactataaaaagatatctagtaggttcagcattgttttggtttggtagaatcgcaatatcatagtcgtagcattttatgataatactacgatctggattaggatatttaatcattgtatactcacatggcaaaccctttcggttttctctcaattatattgctggatagctgtaacacttccccgaatggtaagagatcgaacccatccaattcaactggcatgatcaacaccgcggtgaattatcaaccagcgtggccagtgttgaactacaacgactcctactattattactgcatcagtttgaggaataaaaccgttataaatgtttactatccggcaggctagctacccagtgtccagaggagctcggctaacaggctaactgctcatatacatcaggtgtgtttaggcccacgccaaaattgaacattcgattgaaattgaaacgatgagacggaaaagttagaagtttatgtatgtagaaaagttttaatgtgatgaaaaaattaaaagtttgaagaaaaattttaaaactaaacttggccttgatcgaatttcttcgggcagctacagcaatgcctagtggtggcaactcttgtctttgacccccacagagcttggtcaagaaaggtgacagctagctaagggagatcaaaagggcaaaaaggagaagcgaagtgacaaggctaactaacccaaagggacatgagttacgcgcatgattgaaaaccagctagactggcaggctggcaagtgtatgttgccatgttgggttgcaaccccaatgtggcaaaaaaccagataacaagcatttatttcaagcctattacctagtagtaagcattatgggaagaggtagtagttactacctggtatttgtgctattgccggcaacaaccaaataaaatataagatggatggattttttcaggtggaccccagcttgtttaccactacactcatataagcattgtgagaagagttgcagcttactacctcctggtcatgggcccatcttatttactagttgggtaagatacattgcgcatgccagggcaaagaaaatccgaacatcttttccccaaagctctctctggccacttcaaccttctttacgaggtgtaataaaacacgcaggacggctctccagtttgcccggcgttttgcatgcgcgcggatgagatgcactgccatcatcatggtccagacgtcctcgcaggctcgcacacgaacggcgatcatacatgctccgcaatggaacgagtagtagtatagagaagctctgaacttgtccaagtacggcgatcatacctctgtccatgtatcagatgttcagatattagctcctctcacactggcgttcacgagcagacggaaaatctagcgcccggccgtagaggggagaaacaccatggaggaggagacaagtgtaggtactgtgctaaagctgtgcagctagctctggagtacgtcttctgctacgactgcatggtggcgagacatacatgcagaaacatcagcacagcaatgatactttacgactgcatgcattgttgagagacagtacacagacggagatcagttgtacgctgcaacttgtgtcccgacaggaagctccaccataccacttcaagaagagtatttgcttcttcgtcaattatactccatatatgacgacgaaccaacgatggggacctactgatttcagctcttctcttcaagattctcactcgagtgttcttcaaaacagactactccgaacatgtagcagtacctttgtactgatctacctcacctcacagcttttctcgtaatagtagaacagatgctgcatgcgctgtgactttagcaaccaagattcttcatcctctcctcctatccccaaggcatcatctgcctgcagccacccaaattgctcgacacctctcttgcccctttccttcgagctgtgcaataatactgttcatccactgctccgttcaacataaagatacaataattccggtatcgtggaaaaggggaaaaaaaaatctctcgagtgccagctcgacgatgatgctcgccgtggtgggctggcccgcatgacagtggaagcaggacgggtgggcccccacggggtcaccgtcaccggaacgaggccttgggaggcccacctgggccggcctttgccggacagcatgcgcacgtgacggcacgggggaggcatgctccctctccaggaccagtcgccgcccgtcgcctcggccggcggccagccggccggccaccggctgctgcacacgtcgacatccccgtcactgtttcctcctgaacagtgggcccgaggaggagagcatctcctcggtttttaccgtcctctctttcctgtgtcactgtattggcggtgatgacgattctctgctgctggttggctacttcggctccaatggtagagcactgtagggctaagctttgactgtagcaggtgtaagtttttttttttcttttgccatgtgtgaagcctgtagctgtttggtggtatgtaaaagtcgccaatgtctgtcactcagctggcagggagggagggagtgaggggagattgtgcagggagaaaagagaggtggtattgcaatgggccaaggtcagtagccgatcgatcacactggcatctgctcaactcaccaagttggcgaaactgtttttcacagacgtgtcggccggggtaaggagcaaagaagggatctttcggtagccggatcgtgaaatgtcggccggacggcaggaagagtgacaaatggtgctagactgcattgtccacaacaaggccgttctgttcaccactggctcggcacataccggatcgtgtgcatcagtgcatatggagatccgttgctacagctaaaacatcatcaacagtgaggccattccgctcacagctactattacctggacctatatagcctgctggttttgctgctttaccaggcggtataggtgcctctacgtcatacgtacgtccagtccagctcggcttctctcaagagtgttctgtaaggccattgacaatgcatctatagatggcattcagcccaagctgtcacgtacgtaggagattcctctccatgttcgtgcaagtcatggcctcctgaagttcctcgtcccccacaaagacctgcataggaccactcagcgtgggggcaccatcgctcgtgcaaccgtgttgtgaagatcgtgtccatcgctggccctaaaacccagctttggtgcctcaacgagggacatggagtagctcgccgattccaacggccatcgcactggtcaagcaaggccagtgagtgaagggcttcgatttgcgccggagaagagagggcacaagcgcacgagacgcctagagagctcgtcagttgcgccttggagggtgctcgttcctccgtctacttgttgtcgcaaagctcgtcgttgtgccgggcgccgatcactggtggagaaaccatctttggtcggtcggccaaattctacaatagtcccggttctaataaaaaccggaactaaaaagcatctttagtcccgatttaaaagttgaggggtactttttgatctttagtctcggttggtgttaccaaccgcgactaaagatcatttttaatcccggttcaataagtcgtggggttcaagacagaccccaattatttttactcccggttggtataaacagccgggactaaaaatagtcccagttgtttatcccaaccgggagtaaagagtaccccgaaccgcgcgccaaatattatccgcgtgccaccaaaataattgtttatatcaaatatttttactcccggttggtataaacaaccg

SEQ ID NO: 38241 - DNA, 6484 bp, Oryza sativa
attttgtgatgtgatgtattatgatctgtgatgcatttcttttcaatatgtgatgtatttctttccagatctatgatgcactttgatttggggatgatttgggaatatgatcggggatatttagggagcaaatcgattttaaaaaaaaattaaccgggattgctcctaccatctttagtcccggttggtaacaccaaccggggctaaagatggatttttagtcctggttatttcacccgggactaaagatacccatctttagtcccggattcgtagtctcggttgtataaccgggactacaggggtccccaaccggaagtaaagcctctttctccaccagtggatccctactcaaccaccttccttcctaacttctccaccaacgttgggtggctgggaggagatggagttgagggaggagggaggggggagggggtgcgcgaggggtggcgctgccatcatggtccatgtaccctaagatcggcgaccgacatggccacatgaggttggaggggctggatccggaagttgcagatccttgacctccagtgcgtcggacgaggagcggcttgccttggcctcctctccgccgttgtggtgttgccttgatttatttattttaaagcggagtaagtatcaatatagtggtgccaattatatgaattataaaatgtgtactagctcgatactaaaataagttaatctagtattgaatgcttcacatcttagtattatgaatctgttcaaatttatagtattaggatgtgttatatccgatactaaattaacttattatggaacggaggaggtataaggtacttaacaaatattcagtagctagtgacatactcatgctactactatacacatattataggatgaggatattgtggcgatgtgtcatgcaattgacatagccaagccaagagggctgtgtggccagcgtgtcagcaacaacaacatcgctttttggctgagtaaaggccgtgtgttttcgcacaacttgcagctgttccctgttcccatcccacaaactcgtagggcctctgcccactcattgatcagtcagcgagtcagataacgacatgtcaaccctgtaattaattaccctaccctgccggccgtgatcaagtagatggatcaccggtttctcggttagtagtgtaccccgtactctccctatctcgtaaaaaacgaatcttagtactatgacgtgttgtatctgatactagtttgattttttatgggacggagagagtaactcgttttaatggattacgtaccctgcccgggtcatgtcaacaacatgctcaagaatacggtaaaaggacaatacagtataggcaagtcgatttcgcagcagtacatgcgagttaggagtatgattaacaatgacgcacacacaaagcaatgagtagtcaacgcatatcaaaattcgcgtgaagctgtagtatacgtactcccgagtgaaaaaactgaaaatggacagtgagtgcaaaatactactactacgtatcctaggaaccaactaatcatacacgaatatcacacgcaaacaaccaaatccagttgcattaaactgccaatctgaagtggggtaacaccagagatcgtcgactagtcgtaagctgaaaccgccagaacgaatacaggtaggtaaccaatcggttgtcccatcaatcaaagtatcaaacagcttcatctatcgccatgggtgcagcgcaacgccatggcccatggggcaatgggtgcagcgcaaagtggccacttgaccagttctcatgtgcctggaaactcgccaattcgtcaatcgccatgggtgccgctggtagaatagaaagagagagaactaggtcatgcacatccatcaggtggggtgcacgtacgtgctgggcacgtacgtgctgggctgcccaaacctgaaactgccaatgtgtttgttaggcctaccgtactagttgggtctatttcgttcttttttcttctcagcgagcggttaggcctatttctgtaggaataagttcactttaggcccctctatatttaatttgtcgccaagtttaaaattcatccatgaaccgcatgtgacatgtcccttagcttctaaaatcagtgcaaataagatataagacggtttaaaacagtggtttcgcttgacgtgttgtcttcattgtgttgacgtgacacttaaaaaccgtgggacccaaatagcactgaatgtttggtttaaaataaaaaaaattacagtgggatccacatgttttggggtctgccacgatgacctggcgacgggctacctgctcaatgagttcaccgacgactgccatgcaaatgtgtggatacatagatgaaaagttttagcgtttcacatcggatatacagacacatatttaaagcaataaacatagactaatattaaaacaaattacagattccgcctgtaaattgcgagacaaatttattaagattaattaatccgtcattagcaaatggttactgtagcatcacatgtcaaatcatagagcaattaggtttaaaagattcgtctcacaatttacacgtaatatatgtaattagttttttttttgtctatatttaatacttcttgcctatgtccaaacattcgatgagacatgatgaaaagtttttacgtagtaactaaacagagccctaccaaacactccacaaggggttcaactgtaatgtggagaagaagacaagatagcaccattgtgagcatagatgccgtgccatattgcgacactcgagccaatcgaggtcacccaaatagtgctatacatctttttttttttggtaaaacacactacaaatgtagttgaccataacacgcgcacgcttatccttatgaatgcatacatgcactctctactattatgagcacctccggaaggtgaccataactcatgcacattcatccctataaacacacacaacacacactttatcactatgggcaactccagaaaattaggccggcatatcttgagaatgatgaagtcaccacgaatgccacactcgcctaccaataaaagaataattataaatgcgtattacatgtcaaatctaagatttgaatctgggtgggttgttttcatcataataaatctagctagttactcacttcttagataattatatacgtctgcatatgtacatgagtaggctggtatatacaacaagagaccactactccgaaagtatcaaaaggactaagagtgaaaattaattctgattagttcccgcaaccccagttaccccacctctaaacttgcaacaccctttctaaaagttacgaacacagaacactctataaggggttcggttgtaacctgaagaagacgagattgcgagcatagatgccgttccgtgttgcggcactcgcgccagtcaaggttactcggatggtgctatgtatctatctagctatacaatggagtagaatggtacacacccatactttgtatcgtcattttcacgttcccgcaaccgaactgatatgatggaggacctcaagcatacgacggcaggttgcagcgttaacgctcaccatcatgcccatgacatgaggccaggatcgactacaccagaatcacatcatgtcattagcagcggagtcttcacgtgctacggtgctaggatgctgctatctactggagtctggagtaggatggtaatatctccgccctaaaataattttacttttagctattaagatttaaattgacaattaaaaaacaatgtgatcaattttaataataagaaaatagtacgagaaggttcgtaaaaagtaccgaatgaataaaacttctcggtactagttaaagggatagaagtgaacttattttaagataactagcacaatatcaatgcgttgtaacggatattataaaagaaaaaaggtaaaatttacaagtttttagcacagtaaatccatttggcatataatgcctacctggtgttaagatttaatgatgcaatacaatcaatgtattgataggcataaacttcgagacaactaaaagagctgatttaatggggtgtcaaacctatgggcccatacgtcaagaagggggtagtgctagcaaattcaatgccactaccattgctctcttttaaaatggtatggacttatactaccatcatcacattctattatgatgttggtttattttggtgtggtgggagtacacgcgaggcgtgctctctaaacgcactagaaattattaaagaaatagaaaaagtagcctccacgttcgctctcatggcctataaattcctacattaatcggagaaaaagaaaaagcagagtccatataaaaatacaatttagaaatagctgaaattcagaattaaaaaaaaaggaatattagattatgagactagagtccatatagaaatacaatttacaaatagttgaaattcggaattaaaaaataagaaatattagaagaggagtatagagtccatatagaaatacaattaggaaataactgaaattcgaaattaaaaataagaaatattagaagtagagtatagagtacatatagaaatacaattagaaaataactaaaattcggtattaaaaataagcaatattagaagtagagtatagagtccatatagaaatacaattaggaaataataaaaatatggaattaaaaataaggaatattagaagtagagtatagagttcatatataaatacaattaagaaaaaaaaatagaaattcggaattaaaaaataaggaatattggaagtagattatagagtccatataggatttttaaaactaattaaaatttgaaataaacataataaaattaaaagtagagtttagagtccgtataaaaatacaatttacaaataactaattaagaaaaacatgggaagaagagtttaaagtcaatataggaatacaatttagaagtaactgaaattcgaaatttaaaattaaagaatattgaaagatgagtttagagtccacgtagaaatacaattagaaataataaaaattcagaaataaaaataaataatataggaagaagagcatagagtctatatagaaatacaatttacataaaattcagaattaaataaaaaagaatattaaaagacgagtctagagtccatataggaatatatataatttacaaataaataaaatttgatattaaaaataattaataactaacacgtatataaaatacaatatgaatactacacattagtagtcttgtaaagttattgcaaaatttaaaattgtgttgtcattttaatatatttgaataatataatgagaaaacatatattctattatttgagaaagaatataatgatgctagccgcgtaatctgcgcggactatcatgctagttatattattaaaggaatagaaaaaggagcatccatgttcgctctcatggcctagaaattctctcattaatcggagaaaaagaaaaagtagagtacatatagaaatacaatttagaaatagctgaaattcgaaattaagaaataagaaatattagaagaggagactagtgtccatatagaaatacaatttagaaacaattgaaattcagaattaaaaaataagaaatattagaagaggagaccagattccatatagaaatataattaggaaataacagaaattcggaattaaaaataaggaatatcagaagtagagtatagagtccatatagaaatataattaagaaaaaaaatagaaattcagaattaaaaaataaggaatatcagaagtagagtatagagtccatgtagaaatttaaaactaactaaaattcacaataaacataataaaattaaaagtagagttttcagtccatataaaaatacaatttacaaataactaaaattcgaaattaaaaaaaacatgggaagaagagtttaaaggctgtgttctttgctccatgttcccaacccctctccctcatattccgcgcgcacgtttttcaaactaaacggtgtgtttttcaaactaaacgaaagttgtttaaaaaaaatcaaattaatccatttttttaaaaaaattgttaatacttaattaatcatgcgctaatggaccgttccattttccgtgcggggagatgggttctaaaccatgacatgcgaacacacccaaagtcaatataggaatacaatttagaagtaactgaaattcgaaattaaaaattaaagaatattgaaagatgagtttagagttcacatagaaatacaattagaaataataaaaattcagaaataaaaataaataatattgaaaaaagagcctagagtatatatagaaatacaatttacagaaaattcggaattaaaaaaagaaatattaaagacgagtctagagtccatataggaatatatataatttacaaataacttaaatttgatataaaaataactaataactaacacgtatataaatacaatatgaatattacac

SEQ ID NO: 38242 - DNA, 6864 bp, Oryza sativa
cgaggcccccgtccagctgccatgtggcggggacagcaagcgggaaggggacccaggctgaaccgctatcaatgcgcgcggcgccccaactgcccctcgccgcattaaatgcggtaggggcagacatgaggtgccgcccgactgacgcacatcagtcaggagtgaccggtctgtgaccggcctatcgccggtcacgtctgactggacgggcggccgtgcccccacgtcgcctctgtccccggcggagtggaggtaggtatgacccgtcccatcggagcgtgattcggagctccctccacgagaaggacgtccaccacaagtcttcacccatttatgagggaatgacagggctgtcccccgtgtcaggcagggggcgacgatgggtcccgcttaaggacgagcggtggcttggcttccgggcgaaggcacgaattgtgatctggtcaaggtagggtgggtccccaccctgtagaagagtaggtagaggcggtgcatgtggtttccccttgagctataaaaggaggaccttacccaccgagaaagacgacgactctcaggaagcctgagctctaggagaagagaagcgagaacgctctccggagtttaggaacccttgtaactctcaaccttaaatcccacacacagaagtagggtattacgctccatcgcggcccgaacctgtataattctcttgcccatacgcgactagcaagacttagggcggatacgcgatctctagaggcgagcccttttccctagccgaactcacaaaaggggatctcacgatctcccgatagagaggattactcctcgacaatgtcattttaatatatttgaataatataatgagaaaacatatatgctattatatgagagaaaatataatgatgctagccgcgcaatctgcacgggccatcatgctagttttaataataagaaaatagtacgagaaggttagtaaaaagtactgaatggataaaacttctcgatttacatagcaaatactagttaaagggatataagtgaacttattttaagataactagcacaatatcaatgcgttgtaatggatattataaaagaaaaaaggtaaaatttacaagtttttagcacaataaatccatttggcatataatgcctacctggtgttaagatttaatgacacaatacgatcaatgtattgataggcataaacttcgagtcaactaaaagagcttatttaaggggtgtcaaacctatgaacccatacgtcacgaagggggtagtgctggcaaattcaatgcccctaccattgctctcttttaaaatggtatagacttatactatcatcatcacattctagtatgatgttggtttattttggtgtggtgtcgcgtgttctctaaacgcactgtgtcgtgcttcatccatcttaaaataatcttatcttttacctatttcacacgtaccaataaaaatctctaatttattaaatgctaatctcttcgtctcaaagtgaacagaagaatatactagtaatacaattatttctcttctaatccgctctcagtagatttaccccgtacttacagccctctacaatcctccctaaacacagagtgctatagcactgtgcagtgcagtgcctcattcgtctcaaaataatcctatcttttacctatttcacgtaccaataaaaatatctaatttattaaatattaatatctccatctcaaaataaacagaaaaatatactagtaatacaattactacttatgttccaatccgctctcagtcgacttaccccgcacttggcagtctggcctctaccatccttgcgccgtcgcgcgctcgtgccggggcttggctgcgagcgaataaaaagaaaagaaaacgtcaaggcctcagacgccagagcgctacaaaatggcccacgccgccgcggccacgggcgcactggcaccgctgcatccactgctccgctgcacgagccgtcatctctgcgcctcggcttcccctcgcgccggcctctgcctccaccaccaccgccgccgccgccgcagcagccggaggacgaaactcgccgtgcgcgcgatggcaccgacgttgtcctcgtcgtcgacggcggcggcagctcccccggggctgaaggagggcatcgcggggctctacgacgagtcgtccggcgtgtgggagagcatctggggcgagcacatgcaccacggcttctacgacgccggcgaggccgcctccatgtccgaccaccgccgcgcccagatccgcatgatcgaggaatccctcgccttcgccgccgtccccggtacgtattgcccgccccactccgcccccccggaatctacgcttgcctggctgcgcggctgagcccatccagcttttctgtttggctgcaagccgctggccatagagaatcccggccatttttctgctgcttaacagttgtttctgcctacctaacccctgctcgcctcacggctccagcacgtacggcaaaatcatgagatattcagggggttttctttttctttttctttttggagacgataaactcaccatcttgattggtgtgggtttaattttgtacagtaccactattttgttccattcattcattcacttggtactcgtactacgaaaggtgtggacctgtgacagttttggcacgcactattcccaacaggggttttgcagtcctatctcacacggtagaccgtttgagcatttagggcccttttaaatcatagaaataaaaaaacaaaggaataagaaaagcacaggattctaacaggaatacaattgtaaaacagaggattgcaaaacacaggaaaaatacaggaatgaccgtttgattggaccacgagaaaaatgtaggaatcatatgagagagatagactcaggaaatgttccaagaggttagacttcttgctaactttcctccaaaatgtgcataggattacccattccataggaattttaaaggattgtatatgattcaatcctttgtttcaaagaccttcatatgatttttttttccataggattgaaatcctctaaaatttctacatttttcctacaaatcaaaggggcccttaagttcgttagcttttctgtttgaaacatgttttgcacggattatttagttgattaacacgataaatcaatattttaagaaataaactttacacataatttagagtaagtaatctaacaatgcagtagaagtttttttttttttgagaaatcgtattttaataagagtggagcaaaaacctttggcaaaaatttggagaaaagaagctcaaaaaacaaaatccgtggcgaaccggcgattgtggtattagtactgcaaagaatacgaaaaagaccaaaattgttgcctgaattcagccgtagtttacccttggagtacgtacatggttcaattaatttgctctagctgataattgtgcttgatgcctgcagatgatgcggagaagaaacccaaaagtgtagttgatgttggctgtggcattggtggtagctcaagatacttggcgaacaaatacggagcgcaatgctacggcatcacgttgagtccggtgcaggctgaaagaggaaatgccctcgcggcagagcaagggttatcagacaaggtgcgtattactactgtttattctgttctaaaaaaaattctactgtttattcgtatcgggatttaatctcgctgtagctagtcatagttacatttgacaatatcagagggtttaagctctgattactcactgctggtgtgacgacaatctgtttaagcaggtctcctttcaagttggtgatgcattggagcagccttttcctgatgggcagtttgatcttgtctggtccatggagagtggcgagcacatgccagacaaacggcaggtaagatactcctcttttttatccttacagaaaaaaagaaaatgggaaaatgtaatccctccgtttcaggttataagactttctagcattgccacgttcatatagatgttaatgaatctaggcacacatatatgtttagattcattaacatatatatgaatatgggtaatactagaaagttttataatatgaaacggaagaaatatcttggatcggagaacgtttcaaatctagccatcaggttacggtggcatgggttaccatgcatcggttggaatcttggttgagcaatcgcatctgtcgattttaatttgccgggttgcgaaaatgtagaaaaacgagaggatattaatgaaacaattctgctatttattaaaatcagatgtcaatcaactcatcttgagaggagtctgtattggatgttactgaatagtttttggatcttttcactctctttttttagctaagagttcttacctgagtcttttacagtttgtaagcgagctggcacgcgtcgcagctcctggggcgagaataatcattgtgacctggtgccataggaacctcgagccatccgaagagtccctgaaacctgatgagctgaatctcctgaaaaggatatgcgatgcatattatctcccagactggtgctctccttctgattatgtcaaaattgccgagtcactgtctcttgaggtaaaaaaacttttcatgctctgaactcgtaagtgaatttaagttacaacttgatatggtttgcacatcaacttgcgtaccatgccgatttgcattctcgcaagagattcttgcatgtgtgtgacatgtgaaatgtgccaggatataaggacagctgattggtcagagaacgtcgccccattctggcctgcggttataaaatcagcattgacatggaaaggtttaacttctctgctaagaagtggtatgatcttgccatcttcctttcctccacttatgattatcggcaaacagatgttggacaaaactgaactaatttgtgttggcttcgtcttaatttgaagggtggaagacgataagaggtgcaatggtgatgcctctgatgatcgaaggatacaagaaagggctcatcaaattcaccatcatcacctgtcgcaagcccgaaacaacgcagtagtaccctagtagtgaaattacgctcctgctatcttctccatcacgaataatgcaaattctgacgagttagcacctactgatggcgatttgttgatttggggaacagccagtgcactgttaccacgtcattgattttgtactcgtcagacttaaaaaaaaaatatccatgaatgtgcactccaaatacgtcaagaaattcttagatcttcagaccaactcgtcagctagaggtggctaaaaagctcatttagctccctcggtgcaagattgctttgattgacctagttttcttcttaaaactaaaactattttactttggatggaagttagtttcactctgtctgggctcggctcattagctcgttaagaaaaacagtttcaaatgataaaataacataataaatcaatttcgaagaaaaatggagtagataaaaagcacagccgggctcaaccgagggcttatttagattgaaggattttcatgggaattttggaggactcaaatccttgataaaatttctacaagcccctttggaacataacaggatcgctataaatcctatgcctcccaatttcataggaaaataaacatgagctcaaactcatgtttttatttccctttgagaaatctaatgcactctctccctatctctctccctttgagaagtctaatgcactcgctccctatctctatagtttctctcctttgaaatttctgtgtttacttgctactaatcatccaaaggcaactactctatagtattcatgtattttaaatttctgtaggattttatagagcgtggcatcttatttctatgttttttttatcactgtgtttttaaaattttgcgctccaaaggcgcactagcagtgcagcagcgtcactatgtcagctcgacgccgaaccgccatccttctccgatggcgcggcgcgctcaccacgccacccgcgccgcacggtgaaccaaagctggcacggcacgggcaggcaccagcacagtcgggcaaccgacggtctgccgcgcgccgcgtggtgctccggtcacggagacgtcggcaatcggcgtccatcgatgttgccgtctcactctcgtcgtccttcaggatgacccacttgcccgctccataattcacaaaaatagccaagcaaaagaacggctccatctggtacgaaaatgacagggccctggttaagaaatcaacgacgttgcgaagaaagcttggtctctgacgagagaatggcaggaaacgataaggtagtcaggtagagctagaactgtcagtttcacacaggatcattcactttctctccagcagctcaacaaaggctcgccaaatcacatcaacaagaatgcttattgtataatcatccctcgtgttcaccaataaatctgctgcggcttattggtattgtatgactaagaacagggttcgtggctatagctgacatccgtaaatttgtaatccatcttggaattaacaaaaaggtagcacacaatttgagcccaatctctgcttaatttgtcggcaggacgtccaacttttatcagttcttcacggtggttacatgcctaagaagcatctggatcacttcaggggagacatttgcagcctgctccttcagttgcgcaattttcgtgtcagtttcttgctcaagccgttttacgtttgcaccagaatcaccgctactctggaaagaaacaggaaggttagcggcaatagctcttctaattccacgaactatacaagattgaaagatgcatacctccgcaaccttcctctggaactcagcttccatctgagctgatgaactactgt

SEQ ID NO: 38243 - DNA, 13804 bp, Oryza sativa
  unsure (1)..(13804): unsure at all n locations
gaactcagcttccatctgagcacggtactcagctatttctctctcagcctcctcttttgcctgacgaataggaaaggtattcagtttcaaacccaagtcagatctctagatgttgaataaaaaatgagtaggagtaacatgtttgtattgcgtgcttagaagcaaaagatagaacatggtttctgtaaacgatcatacaaggccatcgcattctacaaaagctgtcaaagggcacaattcagggtaacataccactttttttatacatttccattcaggtgttatttccaaaatatatgtgatatattcgatgtccaactatatgaacaaaataccatgataattacatgctaaaaagatatcaaaggaatcagacaggtactttaccttagttaaggtacagaagaatagtaacaagaaagcatgtttttcactcaattttcgaggaactaacagaaaacatgaggccatctctaattcccactgttgaacatgttttaaattccagaaagcatgttttcattctgctgaacatggaattttcccactgttgatttgcttaatgttggtacaatggaacttattcaacaaacaggatgattcaaaattaccctataaagacatcaacaaagaaatatacgagcaaaatcttgttgtaggtatatcgaagcaatcattgcacatatttcgtacaacataagcaattcccccccatcaatttccgcgttattcttaatgaatatttgtggaacaattaccgctcctagcagcattaacaatctgttgagcttcttgctctgcagccaataattgctgaattccaccttggcgtctgttagcatccatcttccttctgctacatggtgtgaggaactattttattattagacaaaataacacatagtgaaagccgagtggaatataacaagtcctaaatgaacagaacacaaatgaatgtgattgcataacatatgccagaattcgagcattcacaagatacattttaagaggtataaataaaaaatggaagatgttatcttctaataaaagccactgacttttagttacaataacaggtgctaatttggcaccggataacagttacaataacgaggataacaacaaaacaaaaggactttctctcccatacctaatatccctacttgtgctactttgcattcagaagcacaataaagaaaatagcagtagtgggcctcctattgtttttactgggagtaagagggttctttccaagctaccggcttgcctgtaattcagttatgcttgtttacccatgtacaggtttgctgaatgaagaggtcacggaattagttaaccatatcagaggattttaaaagtgtgcgtgcacaaaataacatctgctctctatcccaatctacgatcacagaatataatcatgcgatattatatttcttcttgcacaaaatcaaaccacagagtggaccaagagcttttatgatgatacgatcagccgaaaagagtcagaatactaaaactaaacaagcatacgtctatagcggcgagcagaaggcaataatcccccaagattcatccctgatccggcccacaacgatcccattgccagttttcaccacctccccacttctccacaatagtgtttgagatgcgcaagcaaatgtgagtggaaataatcaggaaaaaaaaacctactagagaggcaaagcctccagattcgcttcaatcaaccgaagattggatcgagcgagggacctggtatgcgcaggcgagaggggatcatacctgcgcgcacgacgattctcgaaggggtgttggggttgcaggttgcagccttgcaggagccaggagcggatctgtggctagcgatagaggagagaagtctgagaagccgtgaaggcacagattgacaacgaaatcgggttatgattggacacataaaattgggccgtaagcggcaaggcccaacatgttcaacccaaactgtaatggaaaaagtacaccgaaggtccctcaacttgtcatggaggtacaaaatcatccttgaaccacaaaaccggatacaacgcgtccctcaacctataaaaccagtgcaaatccctcggcggtttcgaacccggttttgtccgacgtggcagctgactcagcgtgggacccacatgggccccacgcgtcagcctcttcttccccacccctccatctctcttcctctctctctccttccctctccacaggcggcaatcggcaggctgggcgcggcaggccggcgcagcgggctcggcaggctggtgcgacgggccgcggccgacggttggcaggggaggggctgggcgtggcaggccggctggtggggaggaggtcggcgaagcgagacggcagaggaggaggcccacgggtggtaagagcggcaggtgtgctcgaacaggttctgtgccgtctgcgcgcggtcgttcccgcggcacatgacagagagaagggagttgagggcgactgcgttcagctccacgccgtactttcccatgacattgaaggcctcgacggcttntctgtggttgccgctggcgcattaggaggagaagatggaggcgaaggtggcgacggtgacgaggccgctgccctccttgttcatggtgcggacggaggacggcgtcccacatgggctactccatgccggccttgccgaggatgtcgacgaggaggttccaggcgtagccggtgtgattcaccgaccgccccgaccagacgaagaagcggacggcggacttgggacgggagtagcagacgcgggacctgagcacctgctccgcgacctccgcttccgcatcccccgactggacccggcgaggatctccaggaacgcctccgcgcgcggtgaatcctcctcgccgtccagccgccccttctccgtcgccgcgctcatcggcgacaagcgaagggattaggatttaggaacaatgaaattgcttttgggattgaactgcttccgattctctgaatctcccctcaaacagcattgactggaaggttgttggtgatgagtttccgcggtgtccgtttgtcggtgaggcggagagcgaggtgaggcggcgccgccctcaccgacgacatggagattgcgtttccggagagcgagacgagtgcgggcggtggccgacgagtggcgttgtcccgctgcagtgacaaggacaatggtggctagagagagagagatggatgcgatggatgtggtgacggcgacgacgacgacatgcggatggatgtggcgctccgtgggctggtgatgagccgagcacggtagcgtggtcggcatccggtgacgcccgagctcggtgacgccgccgccgccgccggtggcagctcctccctcgccagccgccacccgcgcccatcttctctctgccaattgcccgtggagagaggacagagagagaaagaggtgaagaggagaggggaagaagatgcagacatgtgggacccacgtgggtcccacgctgagtcaactgccacggcagataaaatcgaagtcaaaaccgtcgagagacttagtttgcactggtttttgtaagttgagggacacgttgtatctggttttgtggttaaggacgattttgtaactcgatgacaagttgagggaccttcggtgtactttttccaattgcaatttagcagggcaataggccctctggagtctggacgcaaacgtgcaaactgttgctagttccatttggatttacaaaacacggtttcattcttgcatgaaaatactacctccattttttaatagatgacgccgttgattttttcttacatgtttgaccattcgttttattcaaaaaatttacgtaattataatttattttgttatgagttgttttatcacttatagtattttaagtgtgatttatatcttatacatttgcataaattttttgaataagacgaatggtcaaacacgtgagaaaaaatcaacggcgtcatctattaaaaaacggagggagtatatatttttcttgaattctaaatgggccttaaagaaaactgtattttttttctctactggttgttagtgccacttgtaatcttgtcataggggtaggactaaatccatcaggattgaattatggcattcttttaaatactagtaatatgctcgtgctaaacgctacgattttattctatctgtcttaaataatttttagaatttcatgttagcaaaaaaatatttttacatgatctatgcatttgaactttaattcaattcatatcatacataaaatatattttatgtaaagtgcagtactatgatattgcgtgggcacaataaaactttacaagatgaggcccacatgtaagtcataggagaaaaactaaaaagcgtagggcccactcgtcagccctattctccctctctgtcttttcccccaaaaacagcagagcaagcggaggcggcggcgatggtgatggtgattgcagtggtgcgggctgtatgctgtggatggcgatggcgatggcgatggcgatggcggtggtgtgggctgtctacggtgcattatccatttaagttgtatggatgaaccatgataaaaaaaataatccagaacaattttgtaagcatatgtatcccttaatataatacagaccataattacaatctcaaatgacagcctggtgcaaactgacacatctagtgtgagatagtatgtagaagataatcacacgacattccatataaaaggtgatggtgtgctgtacaaaacaagaggacgatggtgagtaacattcgatgagcaatttactatattcaatatttttttgaattaatttagatcatgcgaacctacctttgctcactagtcaagaacgtctttatacacgatatttctagtgctcttccctgttgaatcaatttctttctttggctttgccaaaatccttgttgttagccttgacacaccccttgacaatgcgacatatagctgaccatgtgaaaacacgggctctagaagatagatcccaacatttgggatggtttgtccttgtgatttgttaatggtcattgcgaaactgagacgtattgggaattgcttcctcttgaatttgaaaggtagagatatatcgtcggagcaagacaaagggattcgtgggatgaacacccttttgctggcatgttgtccaccaacaatctcagcatcaattgcattatcttgaaaagctctaaccattagtctagtaccattacacaatccattatttggatcaaggttgcgaagaagaatcacgggataattgatttttactattagctcgtgtggtggcagaccatttggagtaatagagttaaggtagtccagaggataactgttgtgagggtcatcatcaacagagtcaaagctgtgataaaccttggcctgccctggaaatctgttaatcatattcgcattcagcttgtccacgtaatcatttttagtggatagaatagcacgtgtgctcatataagatgcagagcttgcattcttttcatcatcaagtgagtgaaacacatgattaatcaattcgtgtactgaatcctcgctattcccgtaagcaatcacaatttcatcaggtaagtgaacgtaatcatctctgatagtgttttcagtgccatttccaattctaaggagatatttcgaaaaccatggatcagattgagccctcatgttacgcgacaatctgatcttcctaatattttcccataaatatgatctctgcaatgttgcatcagttatctgggcccttatcccacgtgtaaccacgggaagtaactgtctgaaatcatcgccaaaaacaataacctttcctccaaatggcaatgaacaacccataatgtcttgaagagacctatcaagtgtctctacggcttgacgcttcgtcattgtagcttcatcccaaataattaaggacgccatgtgaagcaattccgcggtgccactttgcttcatgaagttgcacatgctattgtgagaaatcttaatagggattttgaatctcgagtgcgcggtacgtcctccaggcaaaatcgacgctgctgtacgagacgtcgcagttgcaatggctattaatccctcggaccacactctagcaagaagcgccttgtacagaaatgttttgccagtgccacctgggccgtcgataaaaaatacctggctcttcttattagttacatgatcaatgatctcattaaatcctgcacgctgctcatcattaagggatgtgtatatgtctaaatggtcttggtccactggcacgttaagttcgtctataatctcttgtcattacgtcgttgcaacattcacctgattagtgaaaacaaatatatgcatcatgaaactattggtgggtggtgcaaatgtaaactaataagaaaaagacgtgatagtataagaaaaaaaatacctatatcaatgacctcgggaagaccatactccgtgatatccttccccatggaatgaagcaaatcacgtatgtctcgtagcaccatctgctctactgctgcagggttagtgttccctcggctgtaatcttcagacattgcagccttgtgattgtcccatagtgcacggatatcagtgacttcgcaaaataccagtatggttgcaaataaccgacgcagagcagatggcatttggaaagtgaatgcctcgttcaaacaatcgtcatgtgacttatccgtctccacaagccctctcttctcgcatgcctctctaaaggtagagtacgttgtacctgacactgtcctcaaatcttcaaatgaggttgcacctcgcacgtggttgagaagcactctcaagtagtatctctccccctctgcagggtgagcgtacacaacccgtctaacttggcctctctttgttttccttttttgccacacattctgtccggttatccaacggtagtgttcagggaactccttttatagcagtttccttgcttccgggtctacttgattgattttgaaatactccgtaagagttgtcctggtagaagatggaagattaacaacatcctcaagattaccaccctcattatacgtgacatactgcatgttaggaatatgaagttggagctgcagaacagctggatagataccgaacagtggaaaaccaagcatcctatgtatagcctctggtggtgtcacgtatctagcatttctgtactgttgtatctcatttatttccccagatggatcaaccgagaaagatgcacagtcgtgtcctttatacacatacttatagaggtacttcacagatttgatgcttgcacaagcctcaacattgatgtgacaattataccgcataagcagtcctggattatatgggaccacccacctattgtctaacactgcacctctaatcttgacacgccatccatcatctcttctcctgtacaaagggtacgagtccttcccttgttgtgttgcttgattgaactatcgaggaaagttgaagcgatactctccatccaccatacaagcacaattcctattcagtgtgccacatggtccatgcagcatatgcttgatgacaagacgatgtagctcagggtatttggccttgtctggtatctccgtgcaaatcactttatcgtactcatctggggttgtcaatttactgcttgacttcatgatcaacaggatgtgttcatgtggtagtccccttttctgaaactcagtgacgtgcgcgtaagcctgaacctccccaaaatattttttcttcacaataagatccaacacatctcgcagcttagccctgaaaactcttgcgacaaggtctggtcgatcttgaggttgctggccgggttcaagatgttctgttatctcatcccagtatgggttgcacgtcattgtgatgaagtaatctggcctcccaaaacattggacaagagccatcgcattgagaaaccttcgttgcatgtcgcgatcacctcccggaaaagatcgaggtagcacaatcctcttaccaactgccgaaccgcttgtctctccagaagaaagcacgtcaaccacgccctgcaattattaaataacaccatgatcaaataactggtatgttgaatcacagatgggagacaatatcaatagttgtagaaatatgttataccatttacctggtatagctcagcccgaatctttttttggttctcaggttttgagtaccaatcgagtctcatatactcgattttgatgtacatgtcaacggctcattgttggaaaagtcatcctccgaacaaatgatgtttagaagtccccttttaacctgcagcctgaagcaatagtactccctcgctgtgacaaacttgtcctttttccctttgccagatttactactatcgtcattatcatcttcattgtctagatattgtcaacaacctcattctttgcgtccaaacttacatattaatatacataaacaatgcataaggacataaagtttagaaattattcgacaaaagccatgagtaaacgtacccggaagatcattaaaagtgctttcttcgttggtatgtacatcaccaaaagttgatgcttcacatgtttcatccatttccacatcacacggaatctggttgggatcgtcgtacggcatttttaggttccacccagtctccccattagggttaaataaaggatacgccaaaggatcataacaaccatggtatgctttgatataacaaggcttatcaccttttgcatgtaccaagacatgtctatcaaaagttttcatcggatcatccccctctaaccagatagtggcaacctgcgaggcggtgggtgcattatatcttcgttggtcaggtgttacattcgtgttgagctcaatcatgtagtcatctagattggacatggatccaactctactgaaggtctgcacatatgggttctgcaccaaaatacgtaaaatgacccgaacaaggttgatatcaaggtcaggagacctgcgaaccctatgggccagtgcattagcatcttctgtatcataaaagtagagctgcatatggcacggcccttgagaacctggaaccaaattatccaagcgatggtacaacgcaccgtgcacacgaaatgtatacacaccagttcctgctgcagtgctgactcgttggtcaagggtcactccaaggctcgtaaatgagaaatgggagttgaaataccgtatgtgctttctgaaatactttgcatcattatgcacttggctggtaaacaaccgtattaattcatcaggcaccgttggaatcttaacatttatctttccctccctacaacaaaacccaggagactcaaattgaaaccttatcgcctgacagtgtttgcaatctggcactttttttaaaacatggtgtgtctttggtagcttatggtacacacgatcgtgtgggtcatcagtactaatcccaatcacaccagtacatcaacacgatatgactcgtatccatcatcctccagaacttgactgacaccttcaaaatcattgtccacacattttgcgtcctcaacccccctatagatgatgcatgagacgatatattttaataatggacaagataaaataactgtttaggtgattttttgagaactcaacatcgacgacaccatctacaattgcaggctcgaataatgcactatcgaattcgacgtagttggtttgtggaatggcatgatgaacaattggtttctgtatagtttgactttgtgtaactccatctggttacaacgtatatgtttggattaatattgggtaacactataaatagagagcaatgcacatacttgtatctaatgttctcacctatgactaaaccggctcctgtctgaccaaggtttgaagcttttcttacattgaatcgaggtttgtagacatcatttctgtgtaaccaatcatttggatcatctggatcatgattctccttgccggccacctgcgcatcatttagaatggtggaacatactgttccataaagcgatccttcattaatggtggagaaagcaccttagatatcaaaacaatatcagaatattggattaaagacggagaaattagcggaaggcattaatcttaccaatagcaggggggcttgatgtagcactccagccgtcaacattgttcaacttagccttctttcgggcacgccattcacgctgatatttcgtcttctgttccctcctcttgtctatactcgacatctcattttcactctttttgtctatgctcaacattttagaatgattgaccttttgactttcagtcacttgcgagtggcaagaggtcggtgtatgaattgttttgtatgatgttacttcatctggaacattgtttgactctgccttcctctttgcgcttttctcgtgccattcacattgctttctgctcttctctctcttttctttagctaacaactgagcatgcgtcaaattctgcatgacagtggctgatgctcctccaccatcaacagaattagactgagccttcctctttgctcgccattcacgcagttttctattcttttcatctttcttctctttcactaacaattcagtctgtgtcaaattttgcattatagcatcatttgtcacaccttcttcaccaaattttgactcggccttctgtgcgctccttgcacgccattcacatagctttatgttcttttcttctttcttttgtttgtctaacatattggtttgtgacacttgattaggtgtggtaaacacaaaaggattgacacatgtctcatactcagccttcttttcatgttgatttgtgtgctttctagcaatttctctccttttatgttcattcgttgtaaaaggtgtgtttggagctgttgtagttttattgcaaaatggaaaaaaacaaaagatgtggttcatatatgtatacaaagagcagtcaaaaagtagaaaatattatacatgctacaacacctggagaaacattagttacatctctgaaggcaatacgccccccattggctgaagcatttggatccatacctagctgataaaatataaacaaacctgagattcatccaattcataattgtggtttcatactgtatatagaaatgttatacatcaattgaatgtatcactacaaataacaaagcataatataacctttatacttataacaatacaagcccaaccagatccatttcactgtcaactttaaagttgggactcggttgcaaataaaaagaagaagttatacagtatacaaatcagttatcaagtcaatgattagcggtagagcaataccgatacagtatgaaaaaaagtggctcacctgaacaggataatcaaaatgttaacaatcttatttgcaaaaggagttaatctgaataacttatattttatcatgaaaggtaaaaactgtgatatattaatgttgtaaacataaggactgatgggccatgggtgtagatatacagaaattctcatcgaggattcccaatttctagcacaatttacattgaatatattgagcataaatgatgtttttacaaaagatcgacggcagggatacttacgggaaagaggagacatattagggatggggtaggggtggggaaggggtcttgtacctttcagcagtggtagctcttgaggcggcagcggcgtcgcgttgtcggctgtggatggcggcaccctcggcctccactgcctctgcacggaagctcaaatcttaaagcttgggagcttttagagtcctagattcagatccatggaaggatttacaacttggttgcacgagtttcatcagttgttggcttgagaattaacacatattcagatggcacgtctttgtattgtgtgattagccaaatcccatactccataacctcaatggataagtttggcttacattgctgatcagataaagggaaaagaatagcatttgtagaactaaatcccaacagtttacacccgatcactaaaagtagagaaggaaattttagctatggatcgaatctgtcaatttatttcagtaatgtttctatttgaggttgcttaacagagtaagaaaatgatattcttttgtgaaagaatctatttaattctcatatgaaatccatcgcatacacacaccatgtcacatttaaaattattatatcataacacaaaatcaggaaagaatctgttagaggtaaaaactcaaccttatcgcgggcggcggcagcggtgaggtgcatgagatcgtgggcggtgacgattggatgccaagtccggagtatatgatatggaaccctataaaaacatgaaagggttcattagtagcttcatccaaccagttctatttgaatttaaaacaaacaagtgtactatgcactttgcaactcgcctatagtgttcattgatctaatatctgccaatattgctctaattttggaggtgtagaaactgttacctgcattaactttgaatgattcacaaaggagagcattttctcacatggctaaaaatgatgtataggaacaggttgacttgtatttaatccaaaaggggagaatcagtaaaaataaaccattcaggcaaatagacagaactgtctttttctttttctgaaagtgacagaaccaagttgggaaacacaattctactctgattcgagtcaagcttaatgaaagacctgatcatgcagtggtttgtcaagggttaaacaaccaaagctaaaaatcagcacacaaatttcctttaccaaaagtacatatgaacgtcaagcaccaggtagagctatcaatcatgtgcatggcaaaatttggatgtctgacgataataatatgcttgggaaaggatcagcatgcccaatcatacaaatggtccagcaagtcatataagttattttataagattacaagtttctatagattatatgatttattatcacgagtaaagcagcacaaattgttcttatggaatttataagctgacatgtcatcctattttttagtatttgtctgacagatagtttcaatacattagaatgcataccatcgactcttcactatccagtccacaaaattccaaaattctaaatattgttctttaaaaaaatgatgttgatcaaaaaaatgggggagggaagggagggatctggcagccagggacggcaaggtcggtggcgacggcggtggggagggagctggtggaggacggcgtgggcaacggggaggatcgatggcggcggtagtgggggagggatctggtggaagggcggtgaaagacgtgcgggcgcgcggaagggcgaagagacacggatcattatagtgctggctagtttaaccacatataagcgtgcaatgttaggaaataatgttcaatcagtatagtgtgggctagttgtagttaaataaaaaagtttacatatggaacgaatctgccatttttagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38244 - DNA, 486 bp, Oryza sativa
atggaaagagtcctactcggacaagactgggttgtcaatgtattgtatagggtctgttatctccgagttctacttggaaaccgcctgacctgcgatataaaagggaccccccgaggagaacctggggcatcgaatctcggagccaacacaaccctcacagcctacgaaatcggagcctgcaaggagccaaatcgccaaggatctagtcgaaccaactcgaccacgatctcgtcggatccctaaagttccattgttccctttgtaacctgtgttttccaccatataatcccacatcaactagattagggctattacctaccaaggggcctgaaccagtataatcctcgtcttttgtctacttcatgtcgtattacgtagatccttgtaccaatgtaccccaataccctctatatccggtctacgggtatcacccgtcgacagtggcgcgccaggtagggggacttggtactcaaggttctactacta

SEQ ID NO: 38245 - DNA, 950 bp, Oryza sativa
cataaacaccggttgacatagtcaaccacctcagtgaagctctgtcgtaaattaacctcattcaccatggatggatcaaggacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaaacctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcaccgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagcctgaccaagtgtcctttactgtatcgatggacaccttggcatacccagctagcaggtctgcgccgtggaccttgtc

SEQ ID NO: 38246 - DNA, 2593 bp, Oryza sativa
tcagggatggctgaaaacggggcagggacattcgctgctgcagcggctgcatcttcttgtgcccatattgcctccttgccgatgtaccctgcggtgcccagccgatgcgggtgctcattccgctgttgcagtaggcgatgtgcctcgcttgattccctaaactcttgggtggtcttgagagagcagaattcctcccacaccgcttcggttatttgagggtattcatcgaacggcgtatgattgccgggcgggttgacaaactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctagcccgcagcagttagaccatcttccaatgacagtcctgggcgccgtgggcctaccactagcgtcaacctctcttataacttgcactgtggtcggccatatattttgtgaccgcggatttctactagacctacttgcacttgtcccgcccgacatcgacgtatgttgttcctgcggcaattctgcagcacaaacagaaggcaatatttgctaaggggtgctagctaaaatttatgtggtcatgtggtgaaaatttatcctatagattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcataaattacaatcatttgcatgaagggataaaaagaggaaatcagctactaggaggaaaaagcaacccaaagaaaatagaacaagtgtagttcatctgttcttatccataaaatagaacaagtgtagttcatctgttcttatccataaagaaaagagcaagtccaggaaattagagcagtagcaacagcatggccatataatagcagcaataagagcagtagcagggccatataacagcagtaggggtatatatgccacaggggcagcaacagcagggggcgattcacataaacagcaacagcagggtggaaattcacataaacagcaacagcagagggaaattcacatagacagcaagggtatataaatcaacaagtgtagataatctgttcttatccataaagaaaagaacaggtatagatagaatgttattaagcaattcatccttggccatttaacaagaagtacaggggcaacaacagcagtggtatataaatcatgcatatattattgtagataaaaaaatgaacaagtgcagaaaatctgttcttatgcataaaaagagagcaagtgcacaaaatctgttcttatgcataaaaaaagaacaagtgtagaggtatataaccactctacactggccatttaataaggaacaagtgaacaagtggtggggcaaaaaaatgaacaagtgtagataatctgttcttattgagcaattcatcactggccatttaacaaggaacacattgggcagcagaagcaggggcaaagatactccacaggggcagcaacaacataaaacaaggaacaggtgtattaacaagtagcccacaataacagcagtagcaggggtgtagataaaaaaggagacagtactactaacttcatgtaaacagcaattcatccattcaattcaagcaagtctagataataaacagcccacaatcattgtggcagcagcagcaagggtatataaatcatgtatataaacaacaattcatacaattgacctattcatagacaacaagggtatataaatcaacaagtgtagataatctgttcttatgcagaaaaaaagaacaagtgtagataatctgttcttatgcattaaaaaaagatcaagtttagaggtatttctgttcttgagcattcatcacagcccaccattaatttatcaagcagaggcaagtgtagataataaaacagcccacaataatttatgtggcagcagcagcaagggtatataaatcatgtatataaacaacaattcatgcaattcacctattcatagacagcaagggtatataaatcatgtatataaacaacaattcatgcaattcacctattcatagacaacaagggtatataaatcaacaagtgtaggtaatctgcggccaatctatcaattctttcatttgaactaaatttcaaaccctaaacctaataaagttccttaattatcaaagaatgacagaaaacaaaatgcatggagaattttggtgtctaggtccggtccgtccatggactacactgaccaatccaccaaaaattccccatgcattttgtattctgtgatggtttgataacctcagaactaccttaaatctacagccaatctatc

SEQ ID NO: 38247 - DNA, 2187 bp, Oryza sativa
  unsure (1)..(2187): unsure at all n locations
tcacaggtaagaccacctgtgacgggcccaacgctgggggccgtcacaggtgaggtcacctgtgncggccctacagatagagcccgtcacaggtgagtttgcctagagcaattttattttattttatttcacttagttcttttattttccttaacatattttcacatacactacatatttttttatacttaattattttatttgactatttcataagcaatatactattgatcattgcgtacatattagagtcatacagataacagacatgtagacataaactacgtacataaattacaaaaataatccttcctcatggtcgacacgtgcatattgaacttcatcttcttcttcctcctcttctagaggtatttcttgacctatgccgtggacgtgctggttgtaatcatcctcgtctgcaatgttctccactccaacaattctccttttcccttcacgaacaacatgtagtttcttgttacatgggtcaactatgtagaacacttgaacaacttgtttggcgagaacgaacggttcatccttgtacgcgttgttagccaagttgacagtggtgaaaccttcattgtcaacttttacattgcaaagatcgacccatcgacaatgaaacaacgggactttgaacttcaagtaatctagctccaatatttgctcaactttaccatagtattgatcacgacgaccaccgtcactagcagcctcgatgcgtaacccactgttctgcactgtgcatttgctgtcttgctttactgtgtgaaaggtgtatccatttatgtcatatccttgccaggtggtggcactccattcaggaccctgtgacaaccactgaagtgtttcactagacaagttctgcaacctggtaattcggttcttcagccactcgttgaaagaagacatgtgcttattcctgacccaactctctgatcggcctaggttctcttgtcggataactacaaggtgttcatcaacgtacggcaccacctcagtcatatgctgtagtaccgtgaaatgagctttatcgtacaccttccgatccaacctaatagtctttcttccaacagtaccaacaccgtcaagcctcccttcatgatgagatcgtggtaatccaattgaagatgtttcagacatgtagtccacacaaaattcgatggcctcttcggtggtgtaactctcgatgatactcccctcggggtgtgaacggttccgtacataacccttaaggatccccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctgcccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggtgttgagaccatcctttgtagtacctgggttaagcagtattcccattaaactctcgcatacattcttctcgacatgcatcaaatctatgcagtggcgaacttcaagatccttccagtatggtagtctccaaaatattgacttttttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtattctgtgtccattgaaattctttctcatattcctatacgggtgacaccttgggagaaatctcctgtgacccatgtagaccgtcttgtgtgaa

SEQ ID NO: 38248 - DNA, 10018 bp, Oryza sativa
  unsure (1)..(10018): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgactacatgtacacatccacatccttaccatattcagtggttaaacgattccggaagagcaaaggtaacacaggtttgtagggtttcgttttccattggctcatatgcagattctgttgattgcgatgtggttcctatgcaagcttgttcacttttgctggggcgtctttgggaacatgataatgatgctacacatcatggtaggagtaataaatacacttttatgcataatgggaagaaaattactttgctacctttgacccctgctgaaattgtagaagctgataaagaacgagctgctagtttgaaagttgatgaatctgaaaatcagcaagtggctaaatctgtttttccacctaaaaaggataagctttcacctagttttaaggttgagggaattaagttgaagggtggtgttatgcttgcaacgaaatgtgacattggtgatatttcaaatgatgatatgtgctatttcttgatatgcaaaccagccttggtttctttagatgatattgctagttcgatacctcctgttgttactaaccttttgcaggagtatgaggatgtctttccagctgagatacccccaggattgccacccatgagagggatagagcatcaaattgatttgattccaggagcatcattgccaaaccgtgctgcttatcgaaccaacccagatgagactaaggaaattcagtggcaagttcaagacctttaggaccgcgggtatgtacgtcaaagccttagtccctgtccagttcctgtaattttggttcctaagaaagatggttcttggcgaatgtgtgttgattgtagagccattaataatattactatccgatattgtcatcctattcctaggttagacgacatgcttgatgagttgtgtggctatattattttcacaaagattgacttgcgtagtggctatcaccaaattagaatgaaacttggagatgaatggaaaacagcttttaaaactaaatttggtttgtatgagtggttagtaatgccttttggtttgactaatgcacctagtactttcatgagcttaatgaatgaggttttaaggccttttatggacgatttgtggtagtgactttgatgacatattgatttacagcaagtctttggatgaacacatggatcatttacgtgctgtttttaatgctctacgcgatgcacgtttgtttgctaaccttgaaaagtgcatcttttgcatggaacgagtctcttttcttggatatgttgttactccacagggaattgaggtggatgagtcgaaaattgaagccatcaggagttggtcggttccccaaaccatcacacaggtgaggagctttcttggtcttgcaggattctaccaccgtttcgtcaaagattttagtacttttgctgcaccattgaacgagttgacgaagaaaggcgtggtcttccattggggaaagacacaggagaagtcctttgacattttgaaggagaagcttacgcatgcacctttgctacaacttccaaactttggtaagacttttgagttagaatgtgatgctactggagttggcattggaggtgtgttgatgcaagatggtaagcctgttgcatactttagcgagaagttgcatggtcctattttgaattattccacatatgataaggaattgtatgctcttgtacgttccttagaaacgtggcgtcattatttttggcctaaagaatttgttattcactccgatcacgaatcgcttcaatatcttcgctctcaaaataatttgaatcgtaaacatgcaaaatgggttgaatttattgaatcttttccttatgttatcaaacacaagaaagggaaagataatgtgattgcagatgctttgtctaggcgctatactttcttatcccaacttgaatgtcggatttttggacttgaatcaattaaagaacaatatgcacttgatcctgattttaatgaagtgatgataaattgtaaagagggacgtacttggaacaaatttgtgatcaatggtgggtttgtttatagagctaaccgtctatgcattccagttggttccgttcgtcttttgttgatacaggaagcgcatggaggagagttgatgggacattttggagctaagaagacggaagatgttttggccatgtatttgtcacatcctgatttttgtttcaggatttataaattatttaatgaattattattagaatttatattaaatgttcattaatttacaagtgaagttaaatgtgggaaataaaattttctaaatataaagcatggatggatttaattttttattaaattctccatggttaattatactctctggaatattctcggatttttcggagctcaattcctaatttttaatcttacaaagagcatttcagtaattacccacatattaaattgatcattaaatggtctaattataattttgttaagtactttgagtgtccaagtattttcaggatttttcttgaaattatttgagcattggaagtatttttaacgattcaaagatcatttcattgattaatttaattggaaaagtaataataatcctcctcctcagcttgggccattttcggcccattccttcctttccttcctctctctttcgccggcccaacctgagccgcctcctctcctctcagccaagccggaaaagtctacttttcctccctgagctactgttcatcttccagctcaggcagatcccgagctagccgtgccgtgcacagtgccgccgtctcttccttctaaatctcgcctccccgttgctcctttttccaatttagttgaggggaaatattcctcttatcctcctctatctttaccctcaaaaatcggagctaaccgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgcccctctcccgtgcctcgtagcgccgccgccacgtgctccaccccgccgtcgtcgccggccgagctccatccgcgtcgtgccgtcgcctccgtcgtcgccgccagtcgccgtcaccgccgtaaggtgcgccgaggtgtggagaagcccggccgccggagccccgaagccgccgatcgccggagccccgaagccgtcgaccgaagccgcgccgccgctagacctcgtcgccggccgtcatcgttcgtcgtttggttcgagggtgagtaccgttgggttcgtctcgtcgtcctctacgtgtaaatgtcctccaaagtcgcagccgaccatccaatctccggcgaggtcgtcatcttggttcggccgccattgatgaggtcatcatgacgtcatcatcgtttttctttttcctgtttttctaatagattaaatcttcagaaattcataactaaatcatcgtaactcggttttgagtggttcaagttgctaaattcatctaaaattatgatctacatgtttgtttactttttatgtattgtttatttggtttttattagtctttttcttcgttttgcgtgaaagttagtcgtttccgtcgttgcgaaggttcgcgagtacgccggaagtattcaagaagattaattgaagaccgattattgcaaggcaagtcacacagatcccaaacaaccctttgagcatgttgaacccgtttaaagctattattttatttcaactatgcattatttttgaatgtcatcgggtggtgaacctttccccgttaattaatggccgaagatgatcttattttcctatgggttataattcgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattaaaatctggttaaggtgggttgtgagcatatggttttgatggttgtgctcatgacaattaaggaccggttcgcgagctactgttgtgaaacatttaccgtgccaaccacaagccagcatgggcaacggctttaccttttgtatagcatggttcattatagtgtgccagactgtgaagcggcgagaagtccgtgggggtcgctggggagtccattgcctctggttttgagggggagattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgctgttcagtgttgattaaaatttctgattaactactccactgttttacttctcttaaaagttttgctaaatgctgcttttgcaaatgagcctatattatgccatcctttggtatccttgtgcacttgcatatttgctatgtggcttgttgagtatgtcatatgctcaccttgcaataatcaatcaacctcagttgaagaaaaaggatccagaaggagaagacgtttggcttatacccgagttgagctgcctgtgggagtggagccggagattcgctagattttattttccgctgcagttttcttcatggtgaggactaagtgcctcttaagtaagtatttagcgttttagttaatttgatgaatctgtatattaaattgtcagtttgtgtacctcggctgatttctggacgaggattttatgcacaaataagttcggaaattactagtgaatttctgggcgtgacatatttcttttggccaaggatgagaaaggatgttgacaggttcatggcacgttgcaccacttgtcagaaagctaagtctcatttgaatccacatggtttgtatatgcctcttcctgtaccttctattccttgggcagatatttctatggactttgttttgggattgtctagaactaagagggggagggatagtatttttgtagtggtggatcatttttctaagatggcacatttcataccatgtcataaaagtgatgatgctgttcatattgctgatctatttttccatgagattgttcgcttgcatggtatgccttctattgtttcagatcgtgatgcaaaattcttaagtcatttctggcgcacgctatggaacaagttgggtacaaagctattgttttctacaacatgtcacccacaaacagatggacaaacggaggtagtcaaccgcactttaggtaccatgttgagggctattttgaagaaaaatttgaagatgtgggaagaatgtttgcctcatatggagtttgcatacaatcgggcaacacattctactaccaaggtaagttcttttcaggtagtgtatggtttcaaccctcgtgctccaattgatatgttgcctttacctactagtgagagggttcataatgatgctaaggcacgcgctgaatttattttgaaaatgcatgagtcaaccaagttcaacattgaaaagatgactgaaaagtatagaattgctggtagtaaaagtaggcaagaggttaagcttgaaccgggtgatttagtttggttgcacttgagaaatgatagatttccggaattgagaaagtctaagttgatgcctcgtgctgatggcccttttaaaattgttgagaagattaatgataatgcatataaacttgagttgcctcccgagtttggggttagtcccacgtttaacatttcagatttgaagccatacttgggagaagagtatgagcttgagtcgaggacgacatcaattcaagagggggaggatgatgcggacatcactacctcggatacacacaacaatcctccaatggtcattcaaggaccgataacaagagctcgtgcgcgacaattaaatttagaggtgagttcgttcctatgttcttctttgtatgaattcgagaatagattgcaacctaatgattatattgtgcttaggaacaatggaggggacaaagagacacttggagaaggacttagagtcatggaggaccatcggggacgtccaagtcaaggtggaggcccaaaccaagtcgacgtcgggtgcaattcggagtccaggaccagtctgcactaaaacgggcgcccaggtcgcatacgtgctcagattggggcgttctttatatggatggaaagctaagaaggtaacctttcaaatggttttgctcccacatccaaattctttccgagtcaacaggaattgaccgaacaatttgacgtccaaaatctgtcccagtgctgcgtcaccgtatttgggcctttggcccgtgtatcgtgttggaacccattagggttgcatcgagaggggtttgcacgaccctaaactctatatatcagtacccgccatcatgtttaggtttttgggttttgcttagattaatctgtcgagaacagtttcgccgctagttcggtttgtaagaccccaactcgtgagcttaatcattcatctgcaattttggttgtttttctatctcgttcttctttgtgttcttcgattggcaaacagggattagccttctcggtgtggtcattcgcgtttcgacacgggtgataaccagaggagacgtggtgctgcaattgcggggctcaagagcgtgcgcgttcaagaagccggatcgatttgtgtggcgactccgcccaaatcgttgtttatcagaaccttttggaagatcgggaaccctagtgcacatcatatacttactccagaactaacgagtatatatatatactgattatgtctttttattggtacgcgcagtatatactactgcaacgagcgaatgagtatatactgttctttcacggaatgagtatatactgattttttttttggaacgagtatatatactgacttttctcggagtggtatatacttatttcttctccaatcggtatgaacagctactcggagtggtatatacttatttcttctacaatcggtatgaactgctctttggtcagtgtatatatactacattcctcattgaaggagtatatactgcttcttttttttatcagtatatgcatttgttattatttgagtatatattgtatgcactacttgttctgtcagtatactgcatgtactaattgtcatgtttggtcggtatactgcatcgtcctcgctaaaggaggttatactgccttcttgtttgatcggtatatactatgtatactactttttttcactcagtatataaataagtatgtaccagtatttcttagataagtcgtatatttgctatccatggaagctggatgcatatgcttttcagttgaatagaataattaatatgcttttcacgtgcaaattcagatgtatgcctgaatcactggcaaagtatcggctgttgcattatgaataaacctaaattaatgaaataccctagaagggcactgaattctgaatggacattaccagaccaaagaaaaagatcaacgcagactttcggaaactaagaacaaaacataacgggatcacccctcgatgtggctcatcgaagaatctctgcatccccacagacagatctcggttaacatcgatgggatcacgctgaccgcacgccggagagaggtggacaagaatgtgtcttcctggattaacaccattagctaggaatcacggttcaatgccgacgacaatgctgtcgccgcacggccacacatgctgggctgttctgtcatcagcaccatctacgtccacgatacatgcatctcgcatttgcatgcaccaaacaaattcgatctgcatgcatgcattatcgatttgcaacgtagaaaaagcaaatcaagaaaatcggaagaaggaaggacttgcctgcagtatagtcgatgttccagttccggacgacgctcaacgtcgtcttgatcgtagcatgggcctgcatcgatgccgtcgccgcacggccacactgacttgcccgaagatcaacggcgtcgttgtctggtcatagctcttcggccagccagtcgcctgcggatagtcataccgaaggcattggtaatggaagacgccggcgtagacatcagcagatgccacgaccttcgaatagccgatgggtcgcgccgccgtcgccttcgaatcgctgatcgagatacctgcggatcgatctatcgattctgtttacaaccacccatgagattttaatacgagctattcaaaagggttccggttattacggaataattcagattatgaggatttttttcgtaactaaaaatcaaaacgggctcggtatctggatccgcttgctgacttggtcggtggtgttcgctgatggacggtggatggaaccgggagtacctactcctgggagtatagaatcattatatatatatatatatggggagactattctatacccccggtcgccgtcaagagcccaacccactaccccctctttttattgggctcaaaacccacctgctaccccagtcaaagcatggtcaaaggacggtcaaatcgctgccatgtcggtcaaacccgtgtgctaacttcctcccacatccacctatttgttgtccttgtctcgtacgaacggtgcagtaacatgacgaccactatgcagtaacactgtaccttacttgcagtaatactaataaaatatagttaaaatatagtcatgacggatctagttttgtagagctttttttttaaagcattacggtgcaaacggttcaaaaatataatatgtggtgtgagagatattattgtttaaagatgtgaattcaaaagatatcacttgcatttacattttactagttcaaagtgggtgataggtcctgtacctgtgtttggttgttaccacctcttattgcagtaatgctattaagaaattgcagtaacatgcagtgttactttaaaagttatagttgttactgcacacatacagtaacgccatgatggaatggtagtaacacacaataaaaagtagtaacaataatgatttagtattactacttatggagagataaatttcaaaataccaatcttcgagaagaaatagtagtaacacactcgattactgtaaaagcacataaactgttacaactctacaggacacaaagttccatagttgtaagaagctaattagaagacaaatatatatgttattacaaaactcataacaagttactatgttttagtagtaacattatcgtataagtatagtaacacgtcacgttactgcaaaacatataggatgttactgcacttttgatagtaacatcgtagtgaaattgtagtaaactagaaatcgaaaaaaaaatatatgagttaaaagtctacatgctaaccatatatttgttactgcacaaaagtgtaagtgttactg

SEQ ID NO: 38249 - DNA, 1491 bp, Oryza sativa
actccacctaagacttcttctccaaagcttctcttactgaaggggggaaagactgagcaagaatgagtacaaccacagtactcagcaagccacaccggagatgcataattaatgcaagggagtacaaggggataataatataggggttaagttttgcagtaaacagcatttaaaagtcacttagttgcccaaagccattttataaagacgatcctaaagctacacagtattactaatcaaggccgtgaacccacacgaacctgccttaacccaaggcctacgatgattcagaccgaactggcaacccgaccctcggtcccagctcgtcccaagccaacccatgccaaccattccacattttagttattaagcaggttttaagaatttaaaacactaacttgggtacattgctaggcttgcccataaccgagggcgcggctattcgaatagattatactctgatcagaggtgtacatctttacccacaagacacgtcttcctcacgtgtaaccacgtgccacataccaccacggcatacggacggaagacgcgacatagtttccaacccatcctagccatagacaagagtaccgacccaacccacctacggccggaacccccggacaggcaggcagaattgagcccctagcagcaggacaccagccctgtgccatgacatctcgactaccgggccgcagcccgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggtgctactaacaaaaccatgcaccccgagcccagcctaaaaccattttgagggttttgaatagagggggaggtgtgcattcaattccacaataatccaaccattccatagtgtccaagtgatatgaatattcccaaagtctagagttataaaaccacctaatgttgcctaattaatcagcgaagcatctacctaaattcatactagtggaaccatgaatagagtacccactagttggggttttatttattctagggtgaacaaggtaataataacaatagcaataataatgtcataacaaaggtaaataggcatggctaaataaagcagtgaaaacgcgggaatttaaataaagcgataatgcattaatttaaatcaaaataattttataaactgggattcaatatgctcaaggatgatgtgacttgccttgctaagagagaacggccttccgaaccttcggcgacgaccgcgaaccatgcttcgagaaccttcggaacgacagaagctacgcgaagcacacaagcaaagctaaaccctataaagaagcaataacaatacataaaaagaaagcacacggttctttaggttataacaaacattaggagacttgaa

SEQ ID NO: 38250 - DNA, 1265 bp, Oryza sativa
cctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggagtgtggttcgttcgacaaattcctacctctatatctatctctgaggtgtttgggttttgcaaaactccatagatatgcagaagagaaatgctatccccactccgaccaagacagaacttttaccaaaagtttattgtgatctttttgttcaaataacaattaaggtgaagcagggtcaggaacaacgaatctctttatgataaacagatccattttgcaagctcgttattacgggtagttcctacaaagaatcggactaatgacgtatacaatgcttgaattatcgacgtagatgctacatagtgggttctcatccttcagagactacgagtgtaataggagcatccgttgacaaaaggatcaccctaagatgatcatctcatggctattgggaacgaatcaaatcagatggttctatttctcaacctttctgacttgctcctacggaaccaaggtcgaaaggattgaaaaagtcagtcattcacaaccactgatgaaggattcctcgaaaagttaaggattagtagttctttttcgaaatcgatttcgaaaaagaatggattcggtcttatacatacgcgaggaaggcaatcaaaaaagaaagaagacaagttcttctttcttttatcacttaggagccgtgcgagatgaaagtctcatgcacggttttgcatgagagaaagaagcgaggaatcctcttttcgactctgactcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatgg

SEQ ID NO: 38251 - DNA, 829 bp, Oryza sativa
caagcatgacttgccttgctctgctgctggaggaacctcggcgactatttcgaagtacgccggagcgtcggaagagccggaatctaacgacatacaaggcaaacaatgcaaacaggctataagtctactgaaacagagaacaaaaccatttttaatggattctacacatttttcttgatttactgagacttgaaggggcttaaacggagctcggatgaattagttatgaatttcagaagattcactgtgtttattactataacaaaaaggccttaaataatttattgggcaataattcccagggctgacgtcatcaaggggggggcggcgccgacaggcgggtcccaccggtcggtggctcgcgagagagggggaagggcgccggcacacgggccccactcggcagtggctcaaggggggcggtccaatgtggaccgggatcacgcgggtggtccaccgccggtccacgggaccgacggcccagatcggccctgagccgatcgggcggtggcggtagaggcggccgccgagctcggctcggcatcaaagccggtcggccagccatggctagtggcgacggcacgcggccgacggcgacggcgaacggcggcacgggaggcggcggcggcggccgaaggcgacggcgcatgacttgaagcggcggcgcggcactaggagggagaggaaggggaaaagaggggagggatgcctcaccgcgagtggccggcgcggagggagacgatggctaacggcgatggcgagccacgggaagacggcggcgacgggcggacgagcttcgggatgccctaaggaagcaagagagagagat

SEQ ID NO: 38252 - DNA, 17544 bp, Oryza sativa
gggcggcctggctgggcctcggcctgcggccggcccagctgggagggggaaaaggagagaatgggccggcggcccattcgaaaagggaaggggaaaaagaaaaagaaaaagaaagaaaaggattttccctggaattaaaatattgcttgctcaattttaattggttaaaattatttctagggctctgaaaattccactaaaaaacttgttagcgaatttagacatgtagaactcaagaaaaattccacatgccagattcgattattatttgtattactttcttagggttttctcatgctttgcaccggcattttcttagggtcatttataaataaaattttaggcttgggaggagaacttcagggtgtgacaattatcacccgggaaaggctaatgtcgtagcagatgcccttagtaggaaaggctattgtaatgctatggaaggatgacagttgccattggaattgtgcaaggaatttgaaagattgaatctgggaattgtcagtagaggctttgttgcagctttagatgcgaagcctactctcattgatcaagtcagatgtcacgcccggaatttctatccaaaattccaaacgcttacatgtgtgttaaaccctcgtccaggaatcagccgaggcacacaataataaattgataatagagtacaaataaataactatttaatattcgcaaataataaattattacagaggtaaatagttcctctcaaagaataacatactacgcagcggaaaataaaactaaagcaaactacgaaacagctatggcaactccactccacaggcatcttaaccaagaacaagcttaatcctccaggacatcaccttcgctgagatactcctcctctgatgattgaatattgcaagaatgagcatatgacatactcaacaagccacacagcaaatatgcaagtgcacaggacaacaaaggatggcataatatagcttatttgcataaacagcatttaataaaaatttaagagaatagtaaaatagttgtataattaatcaatattaaataaacaccatacaacacacccgtgttgcataggcccaaccacatttgaacaacctaccccagttgaacaaattaaacctccaaaccaggaatataccattccaaaccaggagtcacattaattaccaccgttaccatttaatgtgtaatatgagactaatcacgaaaaacattgctcaactcacccataaccgcgggtacggctattcgaatagattaaactttgatcagaggtgtaccactgtacccacaagacacaatcccacaacatgttaccatgcgccttagtaccaccacggtacctcggaaaggaactgtgacattacccctcgcacaacacaactcaccacagtgcaccgttcctggatcataatctccccctcaaaaccaaaggcaatggactcccttgcgacccccacggacttttcgccacttcacagtctggcgcactataatgaatcatgctataccaaagaatatacccgttgcccacgctggcttgtggttggcacggtaaatgtttcacaacagtagctcgcgaaccggtccttaattgtcatgagcacaaccatcaaaaccatatgctcacaacccactttatccaggtttcaattatcaattaattaacatcacacgtttaaccatcgtgagctaccatttaatataaccatcattaataataacaatataatataatatagtatataattaatccctttagttagctaatgtgtctaagcatggctaagcaaacatacatatagcatttggctgaaccaatccaatatataaggttcatgctaatcaaattataacctataggaaaataaagtcatcgtaggccattaattaattgggaaaggttcaccacccgatgacattcgaaaacaatgcatagttgaaataaaataatagctttaaacgggttcaacatgctcaaagggttgtttgagatctgtgtgacttgccttgggcttccacaaacgcttcggaatattcctcaacagaaacgcactcctccggaacgtcggaaactaaagcaattaaacaaaaatcaacacaacagtacaaaaacaagcataaacagtacatgtggatatttttaacatgtagatcttgattttagaaaaatttagcaacttgaaccacttgaaacggatctacggttatttagttatgattttccgaagatttaatctattagaaaatcgggaaaaagaaaaaccgatgatgtcatgatgacatcatcaatggtggccggctcggatggcaagctcgccggagctagagcggccggctgcggatttggaaggcatgcacacgtcgagaacgacgagacgaccgcaacggtgctcaccaacacggctaacgacaaccgacgacggccggcgacgaggtgggtggcggcggcggctcggtcggcggtggcggcggagcaccggcggtcggcggcttcgagggacgggcggccgggcttctcctcgctcccgcgcacctaacagtggtggcggcgaccggcggcgacgacggaggcggcggcgcggcgcggatggagtcgtcggcggcgacggtgagctaaacggcggcggcgcggcggctacgaggcacgggaaagctcgggagatggggcaaacgaaagagggggactagggggtcctatatatagactttgattgaagagatcggactcctcccgcaagaaatcggcccgagaaaacaaaaactcggttttggagataaactcaaaaacgagtttgattcggataaaatactcaacggtttgctccgatttttgggggtaaagatagaggaggatgagaggataaaaacccctaaccaatcagaagaaaaagggccggattgggtgcggatttggagcgggaggcggcgtggcgcgccggcttgggctcggcttgcagccggcctgaggttagggaagggtccgacatgtggggcccacatgtcggtctcccgagtggaggggtggctggcgggctggctgggccggctggtccggcttggccgcgggtgagagagggagagttgggccaaaaacagcccaacaacttaaggaggggtttttggaactttttcaataaaataatttgtgaaatgttgtttcaattattaaaaatacttcccttgctcaaataattcccagaaaattctagaaatagaggaacaagcaaagtatttaataaaattttatctagctcatttttatgttgaaaattttcctagattattagggtttagcttgtaggcttttaatttaatttctaaaaatgacttaaacaatgtatttttaaattaggcgatttttagggcgtgacatcagagaagctcaaatcaatgatcccgatatccatgagatcaaaaagaatatgaaaagaggtaaagctatcggtttcttggaagatgagcaaggaactgtatggttgggtgagagaatctgtgtcccagacaacaaagatttgaaagatgcaattctaaaggaagcccatgatatgttatactccattcaccctggtagtactaagatgtaccaggatctcaaggaaagattttggtgggcaagtatgaagcgtgagatcgcagaatatgtagcggtatgtgacgtttgtcagcgagtcaaggcagaacatcagaaaacccgcaggtttgctgcagcctttgaagataccagaatggaagtgggaggaaatcggtatggatttcatcaccggtctacccagaacatcattgggccatgactctatttgggtgatagtcgacagacttaccaaagtggctcatttcatcccggtaaggaccacctattccggaagtcgtttagcggaattatatatggccaggattgtgtgtttgcatggtgttcctaagaagatcgtgtcagatagaggtagccaatttacttcaaaattctggaagaagctccaggaggagatgggttccaagctgaattttagtaccgcttatcatccgcagacagatgggcagaccgaaagggtaaatcagattttggaagacatgttgagagcttgtgttttagacttcggtggaagttgggataagaatttgccttacgcagaattctcgtacaacaacagttatcaagctagtctccagatggctccttacgaagcactgtatggtcggaagtgccgcactccgcttttgtgggatcaaacaggagaacgtcaggttttcgggacggatatcctgagggaagcagaagaaaaggttaaaatcattcaagaaagattgcgtgtggctcagtctcgtcacaagagttatgccgacaatcgccgcagagatctaagttttgaagaaggagattatgtgtaccttcgtgtcacgcctcttcgaggagttcatcgctttcacaccaaaggaaaattggcaccacgtttcgcgggaccttacaagattgtcagtagaagaggagaggtcgcttatcagttagaattacctcaatccttagcaggtgtccataatgtgtttcatgtgtcacagttgaaaaagtgtttaagggtacctaccgaagaagcaaatcttgaatagattgaagtccaagaggatctaacatatgttgagaaaccaatccgtattttggaaacaaatgagagaagaaccaggaatcgagttatctgtttctgtaaagttcaatggagtaatcactcggaagaagaatcaacttgggaacgagaagatgaattaaagccaactcatccgcatttgttcgccagttcttccgaatctcgaggacgagattccgtttaaggggtgtaggtttgtcacaccctaaaaatctccaaattataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaatttcatttaatgaataatttaaatggaaaaaggtttttaaaattcccttttggttttgggacgaaaccgctctctctctctctcccttggcccaagtcagcccaagccgagcgccgcccgcgcgcgcgcgtgcgaccgccgctgacaggtgggtccctgtcacgcccggaatttctatccaaaattccaaacacttacatgtgtgttaaaccctcgtccaggaatcagccgaggcacacaataacaagttgataatagaatacaaataaataactatttaatattcacaaataataaataattacagaggtggatagttcctctcaaagaataacattctacgcagcggaaattaaaactaaaacaaactacggaacagctatggcgattccactccacaggcatcttaaccaagaacaagcttaatcctccagatcatcaccttcgctgagatactcctcttctgatgattgaatattgcaagaataagcatatcacatactcaacaagccacacagcaaatatgcaagtgcacaggataacaaaggatggcataatatagctcatttgcataaacagcatttaataaatatttaagagaataataaaacagttggataattaatcaatattaaataaacaccatacaacacacccgtgttgcataggcccaacctcatatgaacaaccaaccccggttgaacaaaccaaacttccaaaccaggaatataccattccaaaccaggagtcaaattaattaacacatttaccattaatgaataatgtgagactattcacgaaaaacattgttcaactcacccataaccgcgggtacggctattcgaatagattaaactctgatcagaggtgtaccactgtacccacaagacacaatcccacaacatgttaccatgcgccttagtaccaccacggtatctcggaaaggaactgtgacaatacccctcgcacaacacaactcaccacaatgcaccgttcctggatcataatctccccctcaaaccagaggcaatggactccccatcgacccccacggacttctcgccgcttcacagtctggcgcactataatgaatcatgctgtacaaaagataaagtcgttgcccacgctggcttgtggttggcacggtaaatgtttcacaacagtagctcgcgaaccggtccttaattgtcatgagcacaaccatcagaaccatatgctcacaacccaccttaaccaggttttaattatcaattaattaatatcacacgattaaccatcgtgagctaccattaaatataaccataattaataataataatataatataatctatatttaacccctttaattagctaatgtttctaagcatggctaagcaaatatacatatagcatttagctgaaccaatccaatatataaggttcatgctaatcaaattataacgcataggaaaataaaatcatcttcggctattaattaattgggaaaggttcaccacccgatgacattcgaaaacaatgcatagttgaaataaaataatagctttaaacgggttcaacatgctcaaagggttgtttgggatctgtgtgacttgccttgagcttccgcaaacgcttcggaaccttcctcgaccgaaacgctctcctccggaacgttagaaactaaagcaaaaatactaaaatcaacaaaacaatacaaaaacaagcataaacagtacatgtggatatttttaacatgtagatcttgattttagaaaaatttagcaacttgaaccacctgaaacggatctatggatatttagatatgattttccgaagatttaatctattagaaaaagggaaaaagaaaaaaaacgatgatgacgtcatgatgacatcatcaatggccggaccaagatggcgacctcgccggagattggatggtcggctgcgaaattggagggcatgtacacgtagaggacgacgcgacgaacccaacggtactcaccctcgtgccaaacgacgaccgacgacggccggcgacgaaggggcgtcggcggcggctcgggatgaccggcgacggtgagctacggcggccggcggcgaagggggaggtgcggccgggcttccccacaccttggcgcaccaagtggcggcggcggcaagcggcggcgacggcggaggcggcggcgcggcgcggatggaggatggccggcgacggtggcggggtggagcacgtggcggcggcgctacgaggcacgggagatcgcgggagagggggcaaacgaaagaggaggactagggggtcctatttatagccttggattgaagagatcagactcctcccgcaagaaatcgctccgggaaaatctaaactcggtttttggggataaatccgaaacgaactcgattcgggcaaaatactcaacgatttgctccgattcttgaggggaaagatagaggaggatgagaggataaaaacccctcaaaaaaccggactaaaagtggagagattgaggcggaatcggagacgggagacggcgcggcgcgcccggctcgggctcggcctgaggtcggccggaggtggaagaccaccccgacaggtgggtcccacctgtcggcggctggggaggggagggcggctcggcgacgggttgggccggttttgggctggcttggccgcggggagagggaaaatgttgggccgaaaatggcccaatgactttaaggagggattttggaactttttaattaaaatattttgtgaaatgttgttccaaatattaaaatacttcccttgctcaaataattcccagaaaaatctagaaaatagaggaacaagcaaagtatttaataaaattttatctagcccatttttatgttgaaaatttacctagataattagagtttaacttgtaggcttttaaaataatttataaaaatgatttaaacaacgcatttttaaattagacgagttttaggcgtgacagtcccacccgtcagtcgtcgtcttcctcttgccgaaaccctagccgagctgcgccgccgccgccattccaaatccggccgcccctttccgtttccggtgaaattgattgaggggaaaggatccccgtgatccactctaccttttcccttttgaaaacatcgtctaaatcgctttggaaatcgccggatttgagttcgattcggatcgatctctctcctccgaaccctaaactttccttcccgtcgccggtcgccgtgggccttcgccgccgctccctagcccctataaattgacccccgagctcccctctacccgtcgccactctcgtcttagcccgccgccgtatgtagcgccgcctccgcgtgagaccttgagccgccgtcgccgccgtcgctccggtcgttgtcaccactcgggaaggccaccgtcgtgatcgccgtctcgttgctgtctccgtccgcaccttctccgtcaccgttgaccgccggaacgccgtcgccgtcgtcaagccgaaggtcgccgccgccttttcctcgtcgccgacgtcgtccgttgctcgtccgccgtcgctttggtcaccggtgagttcgcagcgatgcccgcatcgtttcggtgccctccattcgcgccgccgtgccatcgtttgccggcaagcatgtgtgcccaagccgctgccagtggtgacgtcgtcactgacgtcatcgtcgtcgtccctcgtggtctagccgtggaccgatggatctcggtcgtccattttggatggatcgatctcggccgtccgtttcatgaaccgccgccgtgcacccggtccaccgtaaacccgacccgctgatgcaataattcccttttccttttcaaaaataattaattattgcgtcataattcaattaaaatctacataaatgatttaaatcgatttaatctttgaaaattcataactaattcatcttagctcggatttagttggttcaagtctctaattttttctaaaattgagatctacatgttaaaaatatccacatatactgttcatgcttgtttatgtgctgttttggtgattttgttcttttctctttagattccgacgttccgggagagtccaattttgcaggagaagactttgaggatttccaaggccagcaaggcaagtcacacagatcccaaacaacccttcgagcatgttgatcccattgaaagctattgtttctattcaactattgcatttattttcgaatgtcattgggtggaattaacctattgtttattatggcccttttgttcttgattactttattctttgataccttgggttaatgtaatttgacaagttgagctttatatgatggttcagctagatgttagtcataattgcttagccatgcttagaaacattagcacactactgggataacttatgcttcactattatttaatgatggtttaataatagctcatgatggttaatcatgattggttaattaattaatttgccaactaaaacttgataatggtgggttgtgagcacatggttttgatggtcgtgctcacgacaattaagaaccggttcacgagtttcggttgtgaaacatttaccgtgccaaccacaagccagcgtgggcaacggctttactttctgtatagtacggttcattgtagagcaccagactgtgaagttgcggagataagcccacgggggtcgctggggagtccataccttgtttataagggggtgattatgatccgggaacggtgcactgctttgaattgtattatatagagggtattgtcacaatctcaattcgagtacttgtcaagtatcgcgacgcatggttgacatgatgttgaggttgtgtcttgtgggtacagtggtacacctctggccagagttcaaactattcgaatagccgtgcccgcggttatgggcgggtctaacaatgtctttcgtgattagtctcacacttctcaccatactaaatgatgctgttaataacttgatagctcctggtttggaatggttaattcctggtttggagatagaactgtgcagccgggattggttgttcagaatggttggcctatgcaacggggtatgttgtatagcgttggatcaatattgtttaattattatttaactgttttattaaattctgaaataattgttaaatgctatttaagcaattgagactatactatgccatgctttgttatcctgtgcacatgcataattattgcgtggcttgctgagtatgtcatatactcaccttgcaatctttcatcagaggaggagttctacagtgatgctgatggtgtggatgattaggcgtagccctagtcaagttgcctgtggagaggagtcgcctgcgctgtttcttttattttccgttgcttagaactttattgattgagaggaactatttacctctgtaatgacattttattcgcttattaattagagtaataattgtgctctattatcaatttgttattgtgtgcctcgactgattccaggacgagggtttacacacatgtaagcgtttgaaattttggatagaaattccgggcgtgacaacctatcatgcgtctctaatggcgttctataaagaatgcttatctttttgtcattaatatagtgatgatccttctgtcgtcatacagtctatgacgttcatcttcgtcactatcaagcccagaaattatgataagatgccatgtggcctgttaaggcccatgtagtcagggccggctcgggggggaggagggagcgggatggccgctctaggcccccacccacacaccttgtcaggtgtcacgccctaaaaatcgcctaaattaaaaatgcatattttaaatcatttttagaaattattttaaaagcctacaagttaaactctaataatctaggaaaattttcaacataaaaatgagctagataaaattttattaaatactttacttgttcctctattttctagaattttctagcaattatttgagtaaggtaagtatttttaataattggaacaacatttcacaaattattttaattaaaaagttcaaaaatcccttccctaagtcgttgggccgattccggcccaactcctctccctcccgcgcgcccgggccagcccaaagccgccgagccggcccaacccaacccgccagccgccccctccactcgggagaccgacatgtgggccccacatgtcggacccttccctaacctctagcagtcgcccggccgagcccagccatgccacccgagccgccccctttcccctccaaatccgcatcgaatccggcctccccgagtccgattgtttgtgggattttgatcctctcatcctcctctatctttaccccgaaaaatcggagctaatcgttgagtattttatccgaatcgaactcgttttcgagtttatctctaaaaccgagtttttgatttcccggattgatttcttgcgggaggagtccgatctcttcaatccaaggctataaataggatcccctagtcctcctctttcgtttgccccgtctcccaagccttcccgtgctccgtagctccgccgccaccgccgcctagctcgccaccgccgccggccaactccggtagcgccgcgccgccgccttcgttgtcgccgctgcttgcagccgccgccaataggtgcgccaaggtgaggggaagcccggccgcccgtcccccgtagccgccgaccaccggagcctactcgccaccgccgaccggagccgccgccgccgttcatctcgtcgccggccgtcgtcgttcgtcgtttggctcgagggtaagtaccgttgggttcgtctcgtcgtcctctacgtgtacatgtcctccatgttcgcagccgaccatccaatctccggcgaggtcgccatctcggtccggccaccattgatgatgtcatcatgacatcatcatctttttctttttcccgtttttctaatagattaaatcttcggaaaatcataactaaataaccgtagatccgtttcaggtggttcaagttgctaaatttttctaaaattgagatctacatgttaaaaatattcacatatactgtttattcttgtttctgtaaggttttgttgatttttgtttaattgctttagtttccgacgttccggaggagagtgtttccgttgaggaaggttccgaaacatttgtggaagcccaaggcaagtcacacagatcccaaacaaccctttgagcatgttgaacccgtttaaagctattattttatttcaactatgcattattttcgaatgtcatcgggtggtgaacctttcccaattaattaatggccgaagatgactttattttcttatgggttataacttgattagcatgaaccttatatattggattggttcagctaaatgctatatgtatgtttgcttagccatgcttagaaacattagctaattaaaggggttaaatatagattatattatattatattattaattatggttatattaaatggtagctcacgatggttaatcgtgtgatgttaattaattgataattaaaacctggttaaggtgggttgtgagcatgtggttttgatggtttgtcacatcctgattttcgtcttaggatttataaattatttaataaattattattagaatttatattaaatgttcgttaatttacaagtgaagttaattgtgggaaataaaatttcctaaatgtaaagcatggatggatttaatttttattaaattctccatggttaattatattctctggaattttctcggattttttggagctcaactcttaattttaatcatacaaagagcagttcagcaattatttaaatattaaattaatcattaaatgatctgattttaatattgttaaatactttgagtgtccaagtattttcaagatttttcttgaaatcatttgagcgttggaactatttttaacaattcaaagatcatctcattgattaatttattaaattggaagtcctttgttgctcccttccggcccagcccaaaaagtctaatctacctccctctcgctacagtgtcgtcttccagctccaggcagagcccgagctgccgtcctgtgcctgctgccgtcgcctcctcctccatcaaatccggtgcatccgttgatccccttctaaaattgattgcaaaaacggattcctctctatctcctctacctaatcccgaagaaacccccatcaaattcgttatatatctcacgaattttggccgtttatattcgggtgaactcagataaatcctaacttctttcaccaaatccatccgttcctgagccgatctcttcaatccaagcctataaatagcaccccctagtcgccctctttcgtttgacccatctcccgagctctctcgtcaaccgtagcgccgtcgccggtcaccggagagtcgccgctgccgacgaccgagtcgccaccgccgcacaagctcgccgccggccgtcatccgtcgtcgttcgtcacgttggtgagtatcgttgagatcgcgtcgtcgtcctctacgtgtagatgcccttggttagtccggccgaccaccctagctccggcgaggtcgccacccgtgccgtggctgccgtcgatgacgtcatcatgacgtcatcatctcctctttttcagtttttctttaatagattaaatagattaaaacttcggaaattcataactaaatcatcgtaactccgattcgagtggttcaagttgctaaattcatctaaaatcgagatctacatgttaaaaatatccacatatactgtttatgcttcttttttactgttttgtttattttgttctttcgctttagtttccgacgttccggaggagagcgttttcgttgaggaaggttcgtgagtgcgtcgaaagtgttcaacaagactaattgaagaccgattattgcaaggcaagtcacacagatcctaaacaaccctttgagcatgttgaacccgtttaaagctattattttatttcaactatgcattattttcgaatgtcatcgggtggtgaacctttcccaattatttaatggccgaagatgactttattttcctatgggttataatttgattagcatgaaccttatatattggattggttcagctaaatgctatatgtatgtttgcttagccatgcttagaaacattagctaactaaagggattaattataaattatattattattattaattatggttatgttaaatggtagttcacgatggttaatcgtgtgatgttaattaattgataattaaaacctagttaaggtgggttgtgagcatatggttttgatggttgtgctcatgacaattaaggaccggttcgcgagctactgttgtgaaacatttaccgtaccaaccacaagctagcgtgggcaacggctttaccttttgtatagcatgattcattgcggggcaccagactgtgaagcggcgagaagtccgtgggggtcgctggggagtccattgcctctggttttgagggggagattatgatctaggaatggtgcactgtagtgagttgtgttgtgcaaaaggtattgtcacagcctctattcgggtactttccagtatcgcgacgcatggtagacatgatgttgaggctgtgtcttgtgggtacagtggtacacctcttgccagagtaaaactattcgaatagccgtgcccgcggtcatgggcgagttgagcaatgtttttcgtgattagtctcacactactcgttaatgttaataatgtgataattaatttgactcctggtttggagtggataattcttggtttggaagttagatctgtacgaccggggttggttgttcaggtttggttgggcctgagcagcatgggtgtgctgttcagtgttgattaaaattgatgattaattactttactgttttacttctcttaaatctttgctaaatgctgctttcgcaaatgaaccctatattatgccatcctttggtatccttgtgcacttgcatatttgctgtgtggcttgcggagtatgtcatatgctcaccttgcaataatcaaccaaacctcagttgaagaaaaaggatccagaaggagaagacgtttggcttataccccagttgagctgcctgtgggagtggagctgaagccatcgctagatcgttaatttcgctactgttttcttttcttttgtaagtatgtaacgttaatattatgatggatttgtatattaaattgtcagtttgtgtacctcggctgattcctggacgagggttttatgcacaaataagttcggaaattactagtgaatttctgggcgtgacatggttgtgctcatgacaattaaggaccggttcgcgagctactgttgtgaaacatttaccgtaccaaccacaagccagcgtgggcaacggctttatcttttgtatagcatgattcattatagtgtgccagactgtgaagcggcgagaagttggtgggggtcgctggggagtccattgcctctggttttgagggggagattatgatccaggaacggtgcactatggtgagttgtgttgtgcgaggggtaatgtcacagttcctttccgaggtaccgtggtggtactaaggcgcgtggtgacatgttgtgggattgtgtcttgtgggtacagtggtacacctctgatcagagtaaaactattcgaatagccgtacccgcggttatgggtgagttgagcaatgtttttcgtgattagtcccatattattcattaatggtaattgtgataattaatttgactcctggtttagaatggtatattcctggtatggaggtttgatttgtacaaccggggttggttgttcaaatgaggttgggactatacaacatgggtgtgttgtatggtgttatttagttttgattaattactcaactgttttactattctcttaaatatttgttaaatgctgtttatgcaaatgagctatattatgccatcctttgttatcctgtgcacttgcatatttgctgtgtggcttgttgagtatgtcatatgctcattcttgcaatattcaatcatcagaagaggagtatctcagcgaaggtgatgatctggaggattaagtttgttctagttaagatgtctgtggagtggagtcgccatagctgttccgcagtttgttttagttttatttttccgctgcgtagaaagttattctttgagagaaactatctacctctgtaatgatttattatttgtgaatattaaatagttatttatttgtactctattatcaatttgttattgtgtgcctcggctgattcctggacgagggtttaacacacatgtaagcgttcggaattttggatagaaattccgggcgtgacatcaggtcccaaaattgaagattcggtaactgacatgtttaaactgtatcaagccctggatcagtagattgatacaggttcaacaatctgaatcttcatcgcatacatttgatcaaggctccaaaggtgatttctttacataaaataatagggtatttacaagattgtggctatctattactgtagaagctataggatgagccaactctaatgttttgctatagaattaaaccatctatctaatctataattgggaactaagttggaatgaaactaatttatatgtttaaactcatggttcggcaaaaactccaaattgattctcaaagagagggttaaagcaatggtgagtacaacatactcatcaagctattatatcaagtaatgaatgcatgaaatagtaatctctgagtagggtttaggacttaccctaaaccctatacaaaaaggtccatgggcattaggtgaattgcgtttaggtccataggcccacatggcatacaaagcaattttacaaaaagaaccttacaagatttaaatttctactaatgaaagtccttacgcctaatgaagtggctaaatagccggggcacacatgtcggtgacttggcggctagggaagcagaggcaataggagggcaacggcgaccaatggcgttcgcggcggcgtattggcttgatcatttttgggcgtctttctcctgggacgtaggcgacgtcggtggcgcaatggctcggccggagatggttcgagtcgacgggaatgacgaagtggggcgatggcggcgctatggacaccgggaatgccgacgagcatatcactaactgttcgatctatgccaaaatagaaacaaagaaaatggattgattaggtagagaaggaacttcacgttcccatggttggagtgcggtgaagctcaccagagaatacatgcgatggatgaaactccttcaggtgaaaagagtaagtggaagttcttggagattccgaggtagtttttggtggtttgcatagtggaacactgtgagaaatagatgaggttcacagtggcgagttggctagattaatgactactacagggacccttttagattccgtgcaggcggcaactcgttgcttctgggaaaatcggctcattttcacgtgcggtccttttaaaagga

SEQ ID NO: 38253 - DNA, 3081 bp, Oryza sativa
tccattgtcctctcctctcctcccgatggcggcagcggcggcggcgcgcggcgacagccgcggtgggcgtaggcgcgcgccggcttcctccacgttgtggcggtggagggcgtgggatccggcgggcggcggccgtccctgcacggatccaacggcggcggccatcaacgcaaaaatccagcggtggcggtcgtccccgcacggatacggcggccggccgccctccccccgcgtggcatccagctcccctcccctcctcttccttccctccctagatccggcggaggggaggggcgtcggcggcggtgcggccggaggggagcacagatccgaggcgagcggcgtggaggccgccgctgacgatgatgatgacgacgaggaggcggcagcggcaagcaggagcggcggcgccaccaccagattctagggtttcatttttaaagaaagtttatgttttttcgggtttttgttttcccgtgggggtgcgccacctgcacgcaaaaatcgtcattttcccagacccctaagtgcatgcgggccgtttaccggcacgcaaaaatcattttagccctgacacaaaaatcttggttgtagtagtgaatggtgaaagtgaaggtggaaagtgagagctaggtgtcaacacgaggggtagaaacgatttaaaggagttggcagtgatttgacgctgtgatcccacttgtacttcactcaacctagcatgagtggctgtctagtggccccttgtagatgtttcctatgagaagatgagaggtatggtgaagtttgggtgtaaattggactttaactccctctctctctctctttctttctctctttgaaaatataatttaggatcaaagagatgattcaccaaggttttttgctgtgtttggacgacaaatgggcccatatatagatctttcctagaaggcttggagtggtagagtggcattttgagtggaaattgaatttaaaccgttctctcaccttttgagaaataaaaaaaaattaaatgagagaagagcagatgatgtgttggctatggttgtatgatgagtgggccccacaaggacttggtcccacatttaagagagatgtagaaggagagaactagaagctctaaattttccatgtgttggcattatcacactaaactatattactctctttctctcatacatttaatttagaattaggggggtgggtggggggggggtgggggacagggagacggcaaggtagacaaggatttgatggttcaaggtgccaagttccaaagtttacgtaatttatggctcacatttcatgtggttacattttgaattagactaagccattgcaccagatggtaaagtatgtttaacattctgaccttgagattttgctagaggagttatggtttaattttggtgaaggtgcaaactaggctaattggtatgctgtttccagatttttagctgtgttgaaggatttatttgggttatcaattgatgtgataaattcaaactaaaattgctgggagcttagggtgttgtttagtatttatgagaattttggtgggatttattgttgcttcatttatttttaggaattttctttagacaaagcatgcatatgcaacctatttaaaatcctcttcctaccttttggctgaaaccatggctgaaaccaagccaactcctatccctctccacgcaggcccaaaggccagccgggtaaagtctatctcttttccctcccctccctaaaacgaagccaacaagtctagtttacatcggtctacgaaagagccccagtccacccctgcctctgccgatgtcgttggtgctgatagatgcgatgcccacacctcagggattcgcgcgccgtggtgtgcagccggtgaatcttctgccgcctcctgtccttccgttgtctgacgaggaatggttttaattctcctccgatttcccccattgctacataagttagtgattcattggtagatctgcttgtggttgaatgtacaaggatgcttggtagatctgactgatgttgaatgtgcaagaatgcaagaatgaatggagtgaactaaagcatatgtcctggtatgcatatttcaaagtactgcgcatatgtgtattataccatattgtattatgtacttatgctatgaaattatatgtggaatcctccactgcatattttctcttggttaattagtttaggaaaaattgcaaatatgatcttgtgagaatttgtaaagtacatagaaggccatttgttttgacaatgaagtatggtttgttgtttgttgatttagatctccgtaatactgcctaaatttaaatgtatgtttggtgaactgaaattagatatggttagtgctgtcataattttttaatgactatttgtccttgtgagtaaggttgccattcctcggctgtattgcctttagcgtggctatatgtctcccaagactaagaatacaaggaatgtgatagcagccgagaaattgaccatgtttcctcccccctccctttgctttcctagtaggattcggaatactctttggcatgacaatcttaattatctcccatagtctaaaactcacaaaaacatcagaaatccgctaagaataaattaagtaaagaacatgcacacacaaataataataatcatgttgcattaaattgctaaggtcagagaccaacagatgacacattggatagtgctatggccttattaaaagtagcaagagaaattaaatatgcttgtgagcgcacacatgcacgacgtacaaatagttgggaccaacagatggatcgactatagatcgctccatatggtcaacaatttattggagataaacattaacataacttggccataacttgaagcaaaacaacatattcttatgaaaggcattaagactggtagcaatgcgagtatgttgttttaggcttgtccttccatcttagcaagaactcccatttcgtccatcttagcaacaactgtgaaattaaaatatggaaatcacattagcgcattagttaattaattttgtagtggaagtagagcattaattgtcttcatgttgca

SEQ ID NO: 38254 - DNA, 1605 bp, Oryza sativa
  unsure (1)..(1605): unsure at all n locations
ggagagctaatgcttatgcttattgggtattttggtttgacactgcttcacgcccaaaaagaaggcactacgtctgagctaaacttggatatggaagtcttctttcgtttagggtgaagtaagaccaagctcatgagcttattatcctaagtcggaacaaattagttgatagtgataggatcccctttttgacgtccccatgccccccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtagga

SEQ ID NO: 38255 - DNA, 1129 bp, Oryza sativa
  unsure (1)..(1129): unsure at all n locations
attggttggatcgtaggggcgatgatttacttcacgggcgaggtctctggttcaagtccaggatggcccagctgcgccagggaaaagaatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggccttggttggaaagaaacgaagtatattgatttcttggatttctctctctttattacatggcccttgggggctatttatagccccgttacagattctcacttctagggtctagtttgtatgaggaatttacatagttgcccttatgaaaaggacgtttacagggttacataacgttaaagggggttaaggggccttga

SEQ ID NO: 38256 - DNA, 6382 bp, Oryza sativa
cagggttacataacgtcaagggggttcatgggcccttgatggccatcgggcgatcgccggccctatggcctctaagcttggtgggccgagaaggctacttcggccctcgcgggggcgaaccggtcctggcgaagtcgtccttctctgggctggatgccggggcgaaccggtcctggcgaagtcgtctttcttcggcatgcactcacccgacccttcgcctcgcatcatccttggctcgtggtcttcgccatgggtttcggcagattcggtcgaagggactcatgccatccgccaacagctatgaacccgtgttcaacaattcccacgttgagccgcttaaactcttgctgcaattcctcacacatgccctcgatgcatagagcagtgcagtaacttttcctgcttaatgcgtctgccaccacattggctttccccgggtggtagtgaatgctcatgtcatagtctttgattagttccaaccatcttcgttgtcggagatttagatccggttgggtgaagatgtatttcagactcttatgatccgtatatacttcacagcggttgccaatcagatagtgcctccagatcttcaaagcatgaaccactgctgccaattccagatcatgggttggataattcccttcgtgtggacgcgactatcgcgaggcatacgctaccactctgccttcctgcattagaacacacccaagcccgtggcgagatgcgtcgcaatagacctggaaatctttcatctggtcgggcagaatcagaactggggcggatactaatttctttttgagctcctcaaagctcttatcgcactcagctgtccatttaaacttttcatctttcttaagcaactgagtcatgggtcgagcgatcctggagaagttttcgatgaattggcggtaataacccgccagtctaagaaaacttcgaatctgcgacacggtcttcggtggggtccatttggtaactgactccacgttcgatggatcaactgccatgccctgagctataataacatggcctagaaatttgacttccgtcaaccagaagtctaacatggcccagaaatttgacttccgtcaaccagaagtcacacttgctgaacttggcgtataattggtgctccttcaacttctcgagtaccagacggagatgctgctcatgttcttcttcagactttgaatagataagtatgtcgtcgatgaaaaccaccacaaacttgtcgagaaattccatgaacactttgttcatcagattcatgaagaatgcgggtgcgttggtaagtccgaaagacataaccgtgcactcatgcagcccgtaccgggtggtgaaagccgtctttggaatatcttcttcccgaattcttaactggtgatagcctgatcgcaggtctatcttagagaacaccttagctcccttcagttggtcaaacaagtcatcgattcgtggtaaagggtatttattcttgattgtgacctcgttgagtgcgcgataatcgacgcacatcctcttcgtcttatcctttttctccacaaaaatgaccggagcaccccaaggtgaggtacttggtcgtatgtaccctttctgcagctgctcatcaacctgtttcttgacctcggctagttcattggctgccatcctatacggtctcttgtagattggggcggttcccggggccaaatcaatccggaattcaatctctctcttgggtggcatggtggtgaggtctttgggaaacacttctgggtactcgcagactatgggaatttcttccaatttcctcgaattcatcccctcggtgaccactggggtttccgcctcaatctgattcaaggagaccccttgctttggtgagactagtgatttatacactattgtttctcccttctcgttagtcaaggtgactgtgcgattcgcacaatcaatgactcccttaaacttggtcagccaatccatcccaagaatgacatctaggtctttggaatcaagaagaatgatgttggctagaaatggtgatctttgaatttctattgttatagaagggctgaattgtaccgaagtggagctattccctggggtatgaacccgcattggtgtgctaagttcctctcttattaacccatgcatcctgacaaacttctttgaaatgaacgaatgcgttgcaccagaatcaaaaagtactgttgcagggattgagttaacaggaaacgtacccagtacgacctctggtgctgcttgcgcctcctttgcagacgcgtggttgacacgagcctggacaaactttgacccggcacgcctaggcttcgggcatttgtcggcgaagtggccaagctcaccacagttgaagcaggaccctggctttgctccagtctccttggcttgcgcggacgggcctgactgtgctggtgccactggtgggtgtggagctgcaccgtggttaggctgacctccatggtggttctgactgccactggcgccctggtggaagttgctagacttgaacgtgcggtgctggcggacgatcatggtggtaggtccaccctgctgtccgagagtgaagcgcggtcgctgatggtttccttggttggaccggaactgtgccgcctttctcttcctgtccattttgttgcgctgatcctcctgacggattgccttgtcaaccaacctttcaaagtcggcatagtctccagatatcagctggttggttagctcatcatccaggcctgctaggaatttctcctgcttctcggcgtcggtgcagacatcctccggtgcatatcgcgcgaggcgattgaactcatggaggtactctgtcactgtcctgttgccctgatggagtgcccggaatcccctcttcttttgtgccacgaccccgtctggcacctgcgccttcctgaagctacgacagaactccgcccaagtgacttcagtgcctggcgggcgggtggccacgtgattgtcccaccaagctgacgcaggaccttgaagctggtgtgtggcgaaagcgaccttctcctgatcattgcactgcaggagattcagcttcttctctatggcatggagccagtcattcgcctccatggggttggtggtgctggagaaggtgggtggcctgacgcgtagaaactcgggcagcttggactgaggaggagggggaccaaactgctggtgctgctgttcggcgtgctgcagcatcctctggtgcatctgctggtgctgctgctgcatctgctgcatcatggctgccatcatctgagtctgatgtgccattacttgggccagcgtcagattctcgggaaatggtggcggaccattgccggaatcactgttggggtgcacaccatcagcgcgttcttcgccgttgctgccctcgcttgtcgtgcgggtgccattcctggtgtagaccatctggaggaagagcagacggggaaacggagaaaaacagttactcaggaactaagctttattatagaaatttaaactgcaattgttctgatctgaattaaaacactttaaacagcaagcaaaaatccttattaggacagccatatcataggcacatgatatcgactgtcgactgaccccaagcaagcaacctaaacacacaaactaacaagcagaagctaggcagtcgataagctaatggaaaaccagcctaatgctcggaacggctcctgcggtcggtggagtcgaaggcgtcctcctgctcgtcaccacgtccttctgagcgactcctggagcctggcagataagtctcgccgctgcccggctctgagccactggagctgctgctgctgtggtcgcggttgccactgggagtagctggcaaccaacctccatttccactggcggggcccctgacggctgatgcaggagcgaaggagagagcagatgcaggagctgacatgggaacaggagctggagctggcgctggagctgcaggaactgctggagctgcgggcggaactggaggtgctgcgggaactgctggagctgcgggagctgctgacggaggtgggttcctaggcgcaagctggacgcgcacgggtgccgttgtcgacttgcggggcgtagtgcggatccgaactcctcctggcgcgggaagacccttcaattgagcattctccctcttcagacgcgctatctcgtccttcagagcaatgatcctcacaagcttcccatcattcaaggccttggacgccttgtgcaggtccgagtgcatcctgtccatccccctcatcacagcgcacatgtgaccaaaggtggtgtcgttctcgccggctgtcggacggaaggaactgacatcactgccgctggctcgacgagggtggaaccggtacgccgtgtcgtggaagatgtagttgtggcgctcccgtagtctggccatcatcagatatgctgcctcctgacatgcgtgatctgctgtgcctccagacgcctcaaccaccattttagcgaggcaagtccccatgtagccatggacctccaagcggacacggtgaggaagctcgccactgagcggtggaacagtcgtgtactccggcgcgttggggtagcccaccaccagtgtcatgcgtgccaactctgccacgaaatcacccatgccttctccgcggtggttgggtgggtgctcggccatctagagaagacaaaggggtaggatcaatgcatgctcaaatccaatttaaataaaaataaaggactcaaataagagaatcgaataagagcgaaattttatgcatagattattttgcatgagagcgaataaataagacggacttacatagcgataaaataatggggaaattagatacatacttataataacaagaaaagcataaataccttacaacccatattcctgagctaagacctaatgcatttcgcccatcaaatcccaactaacggtcaaaaacatctcaaataattttactaaaaccctagacctacttgtcttaacaaatctcacttaaacgagcaacaagatttgtcccttgaaccacaagaacagatccccaaattttcccggaacaattccaattgcaaagaacatatgcaatgaaaaggattcagagggcccttaggtttccatttggcttgtcctacggtcaaggtcggctctgataccaacttgtcacgcccagaaattcccgaatagaattccaagcagaatgtgcattaaaacccccgtccaggaccggccggggcacacaaacgacaatgttgacatacagatccacgtcttacaaacattataaaagtcttacataaatgcagcggaaaaagaaagataacaggagctaatccttgactggaactgcagcgagaacaccactccacaggcatccttgacggcacggacgaagcctactcctcggagaacccgccatcagacacatactcacactctggggttgggggaaaataaagcaagactgagtactatccactgtactcagcaagtcataccggaatgggggtatgatgcagggattcaacaagggatagctatacaggttcatttgcataatactggcatttataaatagaagtcgaatgcgaaaatagttgtaataattaaacgatattaatcatccactatccaacgttacaccacgttgcaacaggcccaaccatccacctataccatccaatttcattagactaaactaagatgagtctaatcacggtgagtctggttgaccgcccataaccgcgggcacggctattcgaatagttttactctgatcagaggtgtacaactgtacccacaagacatagccccacgacacgtttccatgcgccgacatgccaccacgacatatcggaaagagactgtgacatgacccttcgcataacccctttctagccaagcacaccacaccccaggtttcacccctgtccccagcgggcgacgggcagtcccctctcgtgcctaggtgaatccggaagcgacagaggccgtcgcagggcccgcccctctccatcacgctcacccttgcctggatgcgtcagctagagaaaagctacactacaagcccagccgttgcccacgctggcttgtggtaagtacgaggagttcttccagggtttcccgcgaaccggtccttaattgccatgggcgcgacaagcaaaaccatgcacccacagcccaccatgtgattcattttaattaaccaacaccagagcggtgggactaatccaacattatcatataaacctacagtctatattttaaatgagttttccccattgtgtgctagttgaactatgcatggctaagcaattcctagtccaaagtctattcatgtcataacccaagctaacaaaggagcaaggtaccaaaatagcatgggtgcaccaataggtaaac

SEQ ID NO: 38257 - DNA, 9154 bp, Oryza sativa
  unsure (1)..(9154): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtttcttcgcgtgaggccacctgttttctctagcaccactaatcctgtcgaagctagtgattggttgcacgccatagagaagaagttggatctgctccagtgcagagaccaggagaaggtctcttttgcgtcacaccagctgcatggccctgcttcggaatggtgggatcactcctgccttaacaggactactgctgaacctatctcttggcttgagttcaccgctgctttgcgcaagacgcatataccatcgggagtggtgtccctcaagaagaaggagttcaggtcgctcacacagggttctcgcacagtcacggagtatctgcacgagtttaatcatctggctcgttatgctccagaggatgtgcgcaccgatgaggagcgccaggagaagttcttggaaggacttaatgatgagctttcttacccactcatgactggagattatcacgatttccagaagttagtggataaggctattcgtcaggaggacaattataatcgcatggagcagaagaaacaccggattgctcacttcaaggcacagcagggaaatagtcagaggccgcgtattgcttcgggacccctgtccatgccacagggaggttcttcgtctgttgttcgtccgcagcgacaattctttaacaacaacgcgggcaacaacaaccgcaagccagctccatgtccggtggcaactccgtcgcagcaatagcctgccaagagggagcaaggcagcaagcccggtgtgtgcttcaactgtggagacccaggacattatgctgacaagtgtccgaagccctgccgcgcgaaggtcgtccctgcccagaacaactcctccgcaccagcagccaaggctcgtgtcaaccatgttgctgctgcagaagctcaaggtgctccagatgtgattttgggtacgttccctgttaactcagttcctgcaacagtgcttttcgattctggtgctacacattcgtttttatctatgagttttgcggaaaatcatgggatggaggtagaggagcttagacgtcctttgatggttagtactccgagtaaccaagcactctcctcacaacgtagcccctctgtcagaatagagatccgaggtgtacctttcctggccaaccttattctgttagaatctaaagatcttgatgtcatcctagggatggactggctagccagatataaaggtgtgatagattgtgccaatagaaaagtaactctcaccagcaatgatggtcaagttgtaactgttcatgcattgccctctgaacctcgaaggtcaagtctaaaccaaataactttggaagagattcctatagaccgggagtaccctgatgtgttccctgatgatttacctggtatgccgcctaaaagggatatagagttcagaatagatctggtgccaggaacaactccgatccataagcgaccatatagaatggcagccaacgaattggcagaagtcaagaggcaagtagatgatttgcttcagaaaggatacatcagaccgagttcatctccatggggagctcctgttatctttgtagaaaagaaagaccatacccagaggatgtgtgtggactatcgtgcacttaacgatgtgactatcaagaataagtatccactgcctagtattgatgatttgtttgatcaacttaaaggtgccaccgttttctccaagatagatcttcgatcagggtatcaccagttaaggattaaggaggaagatatacctaagacagcttttactactcggtatgggctatttgaatgtacagttatgtcttttggacttaccaatgcccctgctttcttcatgaacttgatgaacaaggtgttcatggaatacctggataagttcgtggttgtctttattgatgacattctcatatattcctaaactaaagaagagcatgaagaacatcttcgtcttgcattagagaagctgcgagaacatcagttgtatgccaagtttagcaaatgtgaattctggttgtctgaagtaaagttccttggtcacgtcatctcagcaggaggagttgccgttgatcctagtaatatggaatctgtaaccaactcgaaacaaccgaagacagttacagagattcgcagtttcctaggtctcgcaggatattaccggaggttcatagagaatttttccaagattgccaagcccatgacacgactgcttcagaaggatgtgaagtacaagcggttagaagaatgtgagcagagttttcaagagttgaaaagtcacttaatatcagctcccattttgattttgcctgatccaaagaagggtttccaagtgtactacgatgcatccaagcttgggctaggttgtgttctgatgcaagatggaaaggtggttgcctatgcatctcgtcagttacgtccgcattagaagaactaccctactcatgatcttgagttagctgcagtggttcatgcgtcgaagatttggcgtcactatcttttcgggactcgaacagaggtgtatacggatcacaaaagtttgaagtatatctttacccagccggatctgaacatgaggcagcggagatggttggaattgattaaggattatgacctgggaattcattattgtcactcccagaaattcccgaatagaattccaagcagaatgtgcattaaaacccccgtccaggaccggccggggtacacaaacgacaatgttgacatacagatccacgtcttacaaacattataaaagtcttacataaatgcagcggaaaaagaaagataacaggagctaatccttgactggaactgcagcgggaacaccactccacaggcatccttgacggcacggacgaagcctactcctcggagaacccgccatcggacacatactcacactctggggttggtggaaaataaagtaagactgagtactatccactgtacttagcaagtcataccggaatgggggtatgatgcagggattcaacaagggatagctatacaggttcatttgcataatactggcatttataaatagaagtcaaatgcgaaaatagttgtaataattaagcaatattaatcatccactgtccaacgttacaccacgttgcaacaggcccaaccatccacctataccatccaatttcattagactaaactaagatgagtctaatcacggtgagtctggttgaccgcccataaccgcgggcacggctattcgaatagttttactctgatcagaggtgtacaactgtacccacaagacatagccccacgacacgtttccatgcgccgacatgccaccacgacatatcggaaagagactgtgacatgacccttcgcataacccctctctagccaagcacaccacaccccaggtttcacccccgtccccagcaggcgacgggcagtcgcctctcgtgcctaggtgaatccggaagcgacagaggccgtcgcagggcccgccccactccatcaagctcacccttgcctggatgcgtcagctagagaaaagctacactacaagcccagccgttgcccacgctggcttgtggtaagtacgaggagttcttccagggtttcccgcgaaccggtccttaattgccatgggcgcgactagcaaaaccatgcaaccatagcccaccatgtgattcattttaattaaccaacaccagagcggtgggattaatccaacattatcatataaacctacagtctatattttaaatgagttttccccattgtgtgctagttgaactaagcatggctaagcaattcctagtccaaagtctattcatgtcataacccaagctaacaaaggagcaaggtaccaaaatagcatggctgtaacaataggtaaacatcccatagtgttattgcaaaacaaatgcactatttgaaggaaaacaatagaacatttgcaatgtaggatcaacatgatcaagtgacaagcatgacttgccttgctctgctgctggaggaacctcggcgactatttcgaagtatgccggagcgtcggaagagccggaatctaacaacatacaaggcaaacaatgcaaacaagctataagtctactgaaacagagaacaaaaccatttttaatggattctacacatttttcttgatttactgagacttgaaggggcttaaacggagctcggatgaattagttatgaattttagaagattcactgtgtttattactataacaaaaagtccttaaataatttattgggcaataattcccagggctgacgtcaccaagggggggcggcgccgacaggtgggtcccaccggtcggtggctcgggagagagggggaagggcgccggcacacgggccccactcggcagtggctcaagggggggcggtccaccgtggaccgggaccacgcgggtggtccaccgccggtccacgggaccgacggcccagatcggccccgagccgatcgggcggtgccggtagaggcggccgccgagctcggctcggcatcaaagccggccggccagccatggctagtggcgacggcacgcggccgacggcgacggcgaacggcggcatgggaggtggcggcggcggccgaaggcgacggcgcatgacttgaagcggcggcacggcactaggtgggagaggaaggggaaaagaggggagggatgcctcaccgcgagtggccggcgcggagggagacgacggcgagctacgggaagacggcggcgacaggcggacgagcttcgggatgccctaaggaaggaagagagagagattagagggagggagttgaaccacggcggccggcatccatggccaaaggcagcggtagaggtagagctcaccggagcgcgaggggatgcggattccggcgacgaatctcgacggggaaggggcggacgaggtggagttcggcctcgcgaacccgacggcgatggcggcgcggtgcggcggcgaccctagcggcggcttgcggcggccggagtagcgggagcggcgacggcgagtggttgcacggcgcgagggcgatggagagctcgggagagaggggcggcaaaaggaaaaacgaggaggagggctcggggatggattttataggggcgggaagatcaggaacggcccgagcacgcccgatttcgccggcgacgtgggaggtgggaggtggagagagagagagagtggcgggattcaaaaaacgaatcccgcccatctcggtagagggcgcgggtgggagagagaggggtgggcgcggggaaggcgggggcacgcgcggcgtggccgaagtggcccggaggaggcggggcggcggtttcggcggcggcggtgacgtggaggggcggccggaggttggggaaggacccgacaggtgggccccacctgtcggcgaccctgggagaggagggaggcggggcggcctggctaggcctcggcctgcggccgacccagctgggaggggggaaaaggagagaatgggccggcggcccattcgaaaagggaaggggataaagaaaaagaaaaaggaagaaaaggattttccctggaattaaaatattgcttgctcaattttaattggttaaaattatttctagggctctgaaaattccactaaaaatcttgttagcgaatttagacatgtagaactcaagaaaaattccacatgccagattcgattattttttgtattacattcttagggttttctcttgctttgcacctgcattttcttagggtcatttataaataaaattttaggcttgggaggagaacttcagggtgtgacaaacctaccccccttaaacagaatctcggccccgagatttggaggagctggcgaagaggtgtggatgggcgacttttaactcgtcttccctttcccaggttgcttcctcctcagaatggtgactccactgaactcggcaaaacctggtgaccttgtttctggttcttctttcgctggtatcaagtatatgaaccggcttttccacatatgtcaggtcctcctggatatcaatatgctccgaatcagcctgttcttcgggtactcttaagcacttttttaattgggacacgtggaacacgtcatggatgccgatcatattggatggaagttctaactgataagcaacttccccccttcgttccaagattttgtagggtcccacgaaacgtggtgctaacttgcctttggtttgaaaacggtgcactccccggagcggagtaacccgaagatacacataatcccctgcttcaaaagtgagctcccttcggcggttatccgcgtagctcttctgtcgagactgggcaattctcaacctttccctgatggttctgactttctcttctgcttccgttaatacctctgtcccgaacaattgccgctcgcctgtctgatcccagaagagaggtgtgcggcacttccggccgtataaagcttcgaacggtgccatctgtagactagcttggtagctgttgttgtacgagaattccgcatatggcaaacttttgtcccaagctccaccaaagtcaagagcgcaagctctgaacatatcttccaaaatttgattgactcgctcagtctgaccatctgtctgcggatggtaggcggtgctgaaatttaaacgggtccccaattcttcctgcagtttctgccaaaattttgaggcgaactgactccctcggtcagattcttgggtaccccatgcaaacacatgatccttgccaggtacaactctgccaatctctttcccgtataggtggtatgcactggtataaagtgagctaccttggtgagtcgattcatgactacccagattgaatcgtgacccgatgatgtccggggcagtcctgttataaagtccattccaattttctcccatttccattccgggatttgaagaggtttatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaatacgacctttaccacaacggtgccgtccatggatcaaattatttcgtggattggatttcacttgcctatctatggttcccttgcgtgtgctcgggatagg

SEQ ID NO: 38258 - DNA, 422 bp, Oryza sativa
atagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaa

SEQ ID NO: 38259 - DNA, 1110 bp, Oryza sativa
aactggtgctccccacggtgaagtactgggtctgatatatccttcctgaagcaaatcatccacctgtctctttacctctgctaactcattagctgccattctgtatggtctcttatggatagggttggttccaggtactaagtctatccagaactctatgtctctcttaggtggcatacctggcaaatcctcagggaacacatctggatagtctcgtactattgggatctcttgcaaagcaacttgatttaatgtcaaaccgtgagatttaggggatgacacaaagaaagacactgtttgcccattgctacttgttaaagtcacattacggttagcacaatctataactcctatgtgatgggttagccagtccatccctaagataacatcaagatcattggattctagaaagataagtgaggatgggaaaggtatttcttctatttctatagtaacggaaggacagtactgcgttgaggatacttgattgcctagggtattaactagtaaaggtctcccaagactaataacttccatcccatgattgcccgcaaaacttttagacaaaaaggaatgtgtagcaccggaatcaaaaaacacagttgcgggtatagagttaataggaaacgtacccaaaaccacatcaggtgcattctgggcttctgcggctgcaacatgattaacacgagccttcggtgctggagcattggagttgttctgaacaggtgcattcttcacacgccgaggcattggacacttatcagcataatgtcctggatcaccacaattgaagcacacccctggcttgcttccctgttccttcctgacaggatgattctgagttggagctgctacatgacgagtgaccatattacgattatcgttgctgtgattactagtgttgttgttgtagaactggcgttgagggcgagcaactgaagaggatcctccctgtgggtatggtgcagcttgaggtcccaaagcaatgcgcggcctctggctactacgctttttctgttccatcctattatacttgtcttcttggcgaatcgccttgtccaccaactactggaaatcccggtaatccatagccatcaatgcaaaagacaa

SEQ ID NO: 38260 - DNA, 9615 bp, Oryza sativa
taagcaagcaaactaacacagcgaactacggcaacggtctaactagacaactactctcgccttgcgtcggaacgaagagatggatcttcctcctctggagtagctggctctctttcttttgggtcttcctcttcttcctcatcacttaagacatggatgacaggttcagcatgatcaggcacagcgtctcccaccacacgagtcttcgaagctaactggagacgaggtggtagactggttctcttccttgcggtgaggcgaagcttgggtgctggcggtggtgcttctcccttaagctcagctagttccttctgcagacggtacaccttgctctccaacttacaaatcctgccacggttccagttttccctatcatgagctgctttctctcgctccacgcctactgcatccatggcgctaagcatatacacggcgtgcatcacagtggcgctaccttcaccttcgggacagttgtaagttctatagtcttgaccatgtggcttgtgtgggtgatactggaaagctgatgactctaactcctcatcaaagcgatgacgtagctctccaatggccaccaaggctgtttcctgacaaacatggctgtacttttttccctcagcttcaaactttatcgacggaaggtcttcacgatcactagtcaacgtcacgcgaacacgacacttctcctcgttggggtcatggggaatctggcgatactcgggggcaacctcgtaacctacttcaaatgccatcattctcagctccctgacgaatcctagcacctcgatcaagtttttcggcggatgggcatctaaagcaacatggaaagaaggaattaatgcatatttttaagttagctgcacaaactagacttaattaaattggacccaaagaaaaagaaaataaaagaaaaggaacaaacatgactcaattttttttctttttggaacataaatcaaccttgaacagagacaaataactttacacaaatgaataaattaaaactaaaatatttaggatctaccaggagcacggtacagtgtcaccattaacagggatgagtagtactgatgccatcttgattgaatcgataccataatagatgtacagtgccgactaaccaatgaaattcagaaaattaaactatttaataccctgaacagtaaagttttttttctttcaaaataaaagaacaaatttctgttttggtaaagtagaatttaataaattttgtacataaccttgcatgtgctgccaacttaattaatttataagagaatagagaagggcagttctattttccaaaataattagaaggcaacttaaggtttaccatttggcttgtcctaaggtcaaggtggctctgataccaacttgtcacgtccggaatttctatccaaaattccaaacgcttacatgtgcgttaaaccctcgtctaggaatcagccgaggcacataataacaaattgataatagagtactatcaaataactaattaatatgcgcaaagtaaattattacagaggtggatagttcctctcaaagaataaagttctacgccgcggaaaaaaagcaaaagactaaacatctatggcgactccacttcacaagcaactcgacctgaacaaagcctaatcctcctgatcatcaccttcactgaagcactcctcctctaaagaatgaatattgcaagaatgagcatatgacatactcaacaagccacacagcaaatatgcaaatgcacaggataacaaaggatggcataattaagctcattcgcataaacaacatttaataaacatttgagagaatagcaaaacagttaagtaattaagcaatattaaataaacactatacaacacacccatgttgcataggcccaaccttatctgaacaaccaacccctggttgtacaaatcaaacctccaaaccaggaatataccattccaaaccaggagtcaatttagttatcatagtattttcatttatggtggtacgaaaaacattgttagacccacccataaccgcgggcacggctattcgaatagttttactctgatcagagatgtaccactgtacccacaagacacaactccacatgtcaccatgcgcctcagtaccaccacggtaccttggaaacgaactgtgacaatacctctcacacaacacaactcaccacagtgcaccgttcctggatcataatctccccctcataaccagaggcaatggactccccagcgacccccacggacttctcgccgcttcacagtctggcaccccataatgaatcatgctatacaaaaggtaaagccgttgcccacgctggcttgtggttggcacggtaaatgtttcacaacagtagctcgtgaaccggtccttaattgttgtaagcacgaccatcaaaaccatatactcacaacccacctttaatcaggtttatgtatcaattaattatcataacacaattaactatcgtgagctaccactaaatataaccataactaatatcgtaatatgattaaccccattaatgagctaatgtttctaagcatggctaagcaattatacctatatagcacttagctggagcaaaccaatatataaggtcaaagctattcaatttattacccataggaaaataaagtcattgtcggccattaattaactgggaaaggctcaccacccgacgacattcgaaaataatgcataagttgaaataaaatattagctttaaacgggttcaacatgctcaaagggttgtttcggatctgtgtgacttgccttgagcttcttcaaacacttctgaaccttcctcaacgtaaacgctctcctccggaacatcggaaactaaagcaaataaacaaaatcaacaaaacagtacaaaaacaagaataaacagtacatgtggatatttttaacatgtagatcttgattttagatgaatttagcaacttgaaccactcgaatacgagttacgatgatttagttatgaatttccgaagtttaatcgattttcaactaataaaaaggatttatgacgtcatcgatgacatcatcgccggccatggcacggctccacgcgaccaccggcgatagagagctcggttgggctatccgaggacacctacgtgaagaggacgacgacgcgaactcaccggtgcaagaaactatgacggacgacgacgtacggcgaccggcgacgaggaccaacggcggcgcggctcagctcgacgacggcggcggcgttccagcggcttgcgacgacggcgaaggggcggccaaggtactcctccaccgtgcgaacccggcggcggcgacggacagcgacggcgacgacgctagcagccgcgcgacgtcactggagagtcgccggcgacggcggcggcttgagctacgcagcggcggcgctacgagcaacggtgagacgcgggacttggggcaaacggaagaggacgactaggggatgctttatataggcttggattagagagatcggactccaaccgagaggaatcgagctgggaaaaactagggttagtttggagagataaactcaaaacgaattcgatttggtttattcgggcaaaattgacctccgaaactctaggggaaagggagaggataaggaggagatgatttccccttaagcaatcagactcggggacgaccggttgaggaggaatcggaggagaggcggcggcgctcgggctcggctcggcccggcccgaggtacgggatgaccccgacatgtgggccccacatgtcgacgactagaggagacgaggggcggctcggcttggattggcacggcgtgggctgcacggccacgtgcgagggagaaggatgttgggctggaaacggccaaacggcctaggggaggattttaaagactttttcaattaaaataattcgtgaaatgatgtttcatttattaaaaatacttcccttgctcaaataattcccagaaaaatctagaaaatagataaacaagcaaagtatttaataaaattttatctagttcaattttatgttgaaatttttcctagattataggagtttagcttgtaggtttttaaaataatttctaaaaatgcattaaaaactgaattattaaattaggcgattttcagggtgtgacattgatatagtttaaacatgtaggttacccaatctttaattttgggacccgacaaggtgtgtgggtgggggcccctgcgatttgggagcctagagcggctgtaccgctccccccccaagcttgccctgaatacatgggccttgaaaggccacatggcatcttatgacgatttctgggcttgatggcgacgaaaatggacgtcatagattagtaacaaaaagataagctttctttatagaatgccattagagatgcatgataggtaacgaatgatattcgtcacacgaatgtcacagagttcacaacatagtgaatcatctatatatgggcctatttgtcgtccaaatacctgcaaacaaccttggtgaatcatctctttgatcctaaattatattttcaaagagacaaagaaacagagagagggagttaaagtccaatttacacccaaacttcaccatacctctcatcttctcctaggaaacatcaacatggggccactagacagccactcatacttggttgagtgaagtacaagtgggatcacaggctcaaaccactgccaactcctttaaatcgtttctacccctcatgttgacaactagctctcactttccacctttactttcaccattcactactacaaccaagatttttgtgtgagggctaaaacgatttttgcgtgcgggtaggcggcctgcacgcacctaggggtctgggaacatgacgatttttgtgtgcgggtggcgcaacccacgggaacacaaaaatccgaaaaaacataattttttttaaaaaaacgaaaccctagaatccggcggtaggctttcgcccgccgcccgcctgccatagtgcagcctgcctcccgccggcctccgcgccacccgccgtcagatccgcactcccctccggccgcacagccgccgacgcccctcccctccgccagatctaggcacgaaaggaaggggaggggaggggagctggatctcgcgcggggacggccgccaccggatccgtgcgtggacggccgccaccgctggattcttgcgttgacggccgccactgctggatctgcgtagggacggccgccgcccgctaggtcccacgccctccaccgccgccacgtggaggaggccggcgcgcgcttactcccaccgccgccgcaccgctgctgtcaccgcgcgctgacggcgctgccgccgttggaaggagaggagaggaggggagagtggagagagaggagaggagatgcgtgagagagagaggactgaggagaagctctacgtggaaattttaaagtggaaaaagggatagaggggaggggagaggagagaaagaggaaaattttaaagttggtgagaggggaaagaggaattagtatttttgcatgcggctctctcaataggtccgcatgggaagatcggctcattttcgcatacagtccatttaagaggaccgcatggaaaaatagatttttccatgccgtcctcttaattgaaccgcacgcgaaaatgagccgattttcctagaagcaacgagttaccgcccgcacgaaatataaaagggtccctgtccaggaaaatcgtttctatattagtgattcgagaagttccttctctacctgatcgatccattttctttgtttccgttttggcatagattgaatacttggtggtgcactcgtcggcgttcccggtgtccagagcaccgccatcgccccacatcgtcgttccaatcgactcaaaccatctccggccgaatcattgagccaccgacgtcgccaaggtcctagcagaaagacacccaaatatgatcatgccaatacgccgccgcaaacgccgtcggtcgccattgcccttttgttgcctctgcttctccagccgttgagtcaccgtaagtgagcccgggtgtttagccacttcattaggcgctaaggactttaattagtagaaatttaaattttgtaaggttctttttttaaaattgctttgtatgccatgtgggcatatggttctaaacgcaattcacctaatacccagtgacctttttgtatatggtttagggtaagccctaaaccctactcagaaattactatttcatggatttattacttgatataatagcttgatgagtatatcgtactcacccttgctttaaccccctctttcagaatcaatttggagtttttgccgaagccaggagtttaatcatataaattggtttcattccaacttagttcccaagtatagattatatagatggtttaattctatagcaaaacattagagttggctcatcctatggcttctacggtaatagttagccacaatcttgtaaataccctattattttatgtaaagaaatctccattggagccttaatcaaatgtatgcgatgaagattcagattgttgaacatgtatcaatctactgatccaggggttcatatagtttaaacatttaggttaccgaatctttaattttgggacccgacaagctgtgtgggtgggggcccctgcgatttgggagcctagtgcggctgtaccgctcccccccccctaagctggccctgactacacgggccgtaaaaggccacatggcatcttatgatgatttctgggcttaatggcgacgaaaatggacgtcatagactctatgacgacagaaggatcgtcactagattagtaacaaaaagataagctttctttatagaatgccattagtgacgcataataggtaacgaatgatattcgtcacacgaatatcacagatttcacaacatgacttgaaattcaatttttatgacgtaaatgagcgtcacctataataagatctattgtagtgatggcttgtttggctattagagagacagtttgagacatacaacacacagagctaattgatcggcgatccacttgggtttctggtgatcatatgcaacatggactaagctacttggatttgttcaaatgatctgcttcttggatgctgtccggccacgtcgacatgcatgcgaattttgtggatgagtcagaggctgcattcacggagctgatttaattaattaacttgttgccagctagtacctaattaattaagcatgtgtgaatttactattaactactttggtagtgttaatttatccttagttttttttattccaaactactagcatgcatgcctttgtcagagagagaaaccgatggaatatgccttgttacaaaagtattgtgcatgctgtgtggattcgtactgtctgcatgagtttttatattttccggggtagagaagataaaagaattcaacttgccaactaggttttttttagagtctggcacatcgtcgaccatgctgcttccctttatcggacctatatacgttaggatcaaatgtgctcaacgtggtctggaccatgctgcttgatgtggtcggatgtaggtgcagtaggaataatccttttcataatagtgaaactaaagaatttcacttgccaactagtttttttagagtctgtacagaaatgaaactttttgaaaagtgctccagatgaccaagttcaattcaccaaccgtaatcgcgtgtcggatttacatgaaaaatacgagactgacaaaaatgatatctttcggttctaaattaatactcccggccatttgagaggagcaatatgtacatatgcatgcatcacacctcagcgttttcgtcttttttttccttgcagttttaagaatgctcataattagggcatgcaagttgatccattagtatattcgcaatatttgatgatttttttcattttaaaaattgttgacgatattagcttaattttggtatggaaaatatcggttaatttattcccaatttttatctcaagcgagaaaatgaaccatgagagttgaggtgctaattaaccacaggcaaatattcattttaatttgttgtgtatatatatatatatatacacgagcatacatgtgaagatggaaatatgtgaaaaatataatagtgctagtagatttgtctaaaacacttccacaatacaatgatcatgacactcgatcaggtctcaaagttaaattttagggattgtgtcaatatcaaaattatcaatgaataattggccagagggccgggattagcaagggtctactactgtcctgccatttcattaattaattagattaagtccccgattccttgcatccctaattggcctacgagaacggacaaaaatcgcaagatgagaggattgtggtaggtaatcttctccaactgtgcctctcaatcggccataacatattagccagaaggataaataaacatcaatctgccttcacagttttgatcatctcatgagacacatatatataaaccacccataagcaagagtctccaaggtgaattaattaactatgttgatacacatatacttaattggtataagagcattagtagcggtagttaattagtataaaagcatcaatcaaatggagactgttagctagctaggagaccgggcaagcaaagcaaagcattgatcttgatgaatcctccagagagattatttgcatattgtccagttccccctgacctattatacacatgcaagtgctctatgtacttgtgcggtgcaacgacgagcaagagtgcgtacatttatagtagaactgagggggtgcgccttatatacaccggacgagcatgagtgtgtacgtttgtagtgatgtctccaattttagtttctgtcgtagtgaaatattcgacgtttgacacctcgaaccatagaaaaactggagctgtgaaatgttttcttcttttttatgcgtggagcactgaaatattgacagttttgttttttctataaaaaaaagaagaagagttgacgacttgatgggcaggctctcctcgatggagggagatgagcttaaaaagtcgcaataaatggacccatgtagtggaaatgcggagtggagtggagcagtaataaaatttaaaacgccacgcgcagggcatctcgaccacgactggactctccttgagatcttcgaacagtgtgtgcttgctagctgaactgcagcagtggaacggtaataaaatttaaaacggatgtgcagtgttcacagaggatgagtgtgctatatatgtgttctctgcttgtgaatagatatggcgatctctgcatgtgaatagatatggcgagtactattactgggtatacatagttaggatagatgttagtttgttctgtttgtttggagatggatttgggagcaaatgtacatggttagggcgcaaatgttagtttgttttgctgtggaggggagtgggttttgatagaagtagacccatgaattttgctattccaaaattcctcaactagctatatgtctagctccacaaatctgtgatgcctatatctcactagtcttgctatgtgctatgtcatgtacccgtgggtaaatagctaatttatgatttttg

SEQ ID NO: 38261 - DNA, 1271 bp, Oryza sativa
caactccctccgtaggtgctgccgccgcccgtccgcccctcctcatcgccgggttgtcgccgccaccttcatcctccgctccggccgccatactcgccggtgaggatcccctctcctccctcttcccctctctcttgtttgcgccgcctctcttcatgcgctcgccgtcgccttcggtcgacgccgccgtcctatacaccgtccgccgtcgcttcccgcgccgccgattgccgtcgccggcgaccgtgcgcgtcgccgccggttgccatggccgccggtcggctttgaagccgagccgagccaggccggcacctccctcccctcccctttgagccaccgcctggtggggtccacccgccgggtaccaccctcggccccgtggacttggtccacggtggaccgacctcccccttgagccgctgacccgtgggtcccgcatgtcggcgccgcccccttttggatgacgtcagtcctgggacttattgcgcaataaatacatcaaggcttctcttttatagtaataaacacagtttatcttctaaaattcataagtaattcatccgagctccgtttaagtccattcaagtctcagtaaatcaagaaaaatgcgaagaatccattaaaaatggtttggtttcctgtttcagtagtcttatagcatgttttgcttgtgtgctttgtttgtcgcgtagattttggccgtttcgtcgatccgcggtttctcgaagacgttgctgaggtctcattagtgcgagagcaaggcaagtcatgcaatacgttgatcatattgtacccaatttaccaatatctcgcatttctattaaatgttgcattcttttacaatatcacgtgggatgggtcctactactcagccatatattgatttccttatgccattggcaacttgggttttaaaatgactagatgttgatttaggaaatgcttacccatgcttagttctactagtacacaaaaggggaatcacattaaagcattgactttgattattggcaatagctttggattggtgccaccgcaatggtgttagttaattaaaatacactgaatggtgggctgtgggtgcacggttttgctggtcgcaccgtggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcagccggggtgtccggttgtcca

SEQ ID NO: 38262 - DNA, 4458 bp, Oryza sativa
cgctgctgaagtcaagcttcccggtttagctcgctgttatcttttccgctgatatatacatacaacggaggtagccatttgcaccatatccataatatacaagtaggtagccattcgcaccttatccataccaggacgatccatttgcaccttatccatatcatcacataatgcttctgcctataaatagcagcagcaccttacattcaagaatcacctctcaacacaaaactaagaaacatagcaagataaccagggaaggtagcatcagcaacaggaggcaatggagggaaagaggactaccacttcgatggtgatcatgtgcctggtcatcttgagcctcactgtcgactccgccaccgcggcacagtgcggctgctgcatatcctcttaggcaaaagcatgttgtttcggttgtactgctgctggtggctccgactcagtctacaagaacacttgttgtttcccatgtattctggccgattctggtaaattcactaatgtcactctatttaatgcatttcttacatgtagatacagactttgtagcatatcgtggactaatacatatgtgtggccttccatgcattttcctcaatgtgctttgttgatttcacttccaatctcacgacttcaggcatgtatcttgcaacacgaagacatcttatgctctacttccactacaaaattaactaatgcgctaatgggattttcatattttaatttcatagttgttgctaagatggacgaaatgggagttcttgctaagatggacgaaatgggagttcttgctaagatggaaggacaagcctaaaacaacatgcttgcattgctaccagtcttaatgcctatcataagaatatgttgttttgcttcaagttatggccaagttatgttaatgttatcttcaataaattgttgaccatatggggcgatctatagtggatccatctgttggtctcaactctatgtatgtcgtgcatgtgtgcgctcacaagcatatttaatttctcttgctgcttttaataaggccatagcactgtccattgtgtcatccgatggtctctgaccttagcaatttattacgacatgattaatattatttgtgtatgcatgttctttacttaatttattcttagcggatttctgatgtttttgtgagttttagactatgggacataattaagattgtcatgccaaaaattattgcaaaacctagtaggaaagcaaaagaggcgggggggggggaggaaacatgatcaatttctcggctactatcacattcctcgttttctcaggtttgggagacatatagccacactaaaggcagtaaacctgaggaatgacaaccttactcacaaggacaaatagtcgttaaaaaacaatgacatcactaaccatatctatttcagttcaccaaacatacatttaaatttaggcagtattacggagaactaaattaacaaacaacaaaccatacttcattgtcaaaacaaattgccttctatgtacttcacaaattctcacaagatcatatttgcaatttttcctaaactaattaaccaagagcaaatatgcagtggagcattccacatatatttcacattataagtacataatacagtatggtataatacacatatgcatactaggggcctacggcaaaagaggcaaagatcaatgtgcatgctaacttgtgtataatacacatatgcacagtactttgaaataagcataccaggacatatgcattagttcacaccattcattcttgcattcttgcactttcaacaacaaccagatctaccaagcattcttgcacattaaaccacaagtagatctaccaatgaatcaccaacttaggtagcaatgggggtaatcgggggggaaaaccttacctcgtcagacgacggaaggacaggagatggcggaagattcatcggctgctcaccatggcgcgcggatccctgaggtgtgggcatcacatctatcagcaccaacgacatcggcgggtgggggggggaggaactggggctctttcatagaccgatgtaaactagacttattggcttctatttagggagaggaaggaaaagagatagactttacctggcatggcttgggcctgcacggagagggatagtagttggcttggtttcagccaaaagatatgaagagaattttaaattgttttttcaatttaaataatgaccgaaattatgttagtattattaaaattatttctttagctcggaaaatttcaagaaaatttaagagagcataattaattattgagaagttaataaaactattccaagtcatattttacaaggtaaaattttatttcacatatcaacttgtaacatacaaggaatttcaccatggaaaaattttgtggaaaatttaaaacattttgaattcaaaagtttttggtgaacatagaagcatactagagcatataactccctaaaataaaataaaacacataatttttctggccaaatcaaaactaagtccaaaagtaaaagtttacaaatcttgtggtaaaaaattttgaaacaaaaattttgctttgaccataaactagaaacctaatcttctcggttttgcattttcaacctaactaaaaaaatatatttaagttaaatatcaaacaaattgaaaggtaggtatcaaaatacgcaaacctaaattgagataaaaagaacttgcttgtatctgcatattattcttttaagattgtttttggatattcttggtacatctcataataggttgcatatgcatgctttgtctaaagagaaaattcctaaaaataaatgaggcaacaataaatcccaccaaaattctcataaatactaaacaataccctaagctcccagaaattttagttataataatttatcacatcaattggtaacccaaataaatccttgaactcagctaaaaaatctggaaacagcataccaattagcctactttgcaccttcaccaaaattaaaccataactcatcttgcaaaatctctaggtcaaaatgttaagcatactttactctatcatctggtgcaatggcttagtctaattcgaaatgtaacctcataaaatgagagccataagttaggtaaacagtattctggactgtggtcaatagattaactagtcaactttactaaattaccatggtaaaagcaaaagtaattaaactttggaacttggcaccttgaaccatcaaatccttgtctaccttgctgtctccctgtcaccccccctcccccggccttaattctaaattaaatggatgagagaaagagagtaatatagtttagtgtgatagtgccaacacatggaaaatttagagcttctagttctctccttctacatctctcttaaatgtgggaccaagtccttatggggcccactcatcatacaaccctagccaacacatcatctgctcttctctcatttaaatcttcttttatttctcaaaaggtgagagaagggtttaaattgaatttccacccaaaatgccactctaccactccaagccttctaggaaacatctatatatgggcctatttgttttccaaatacctacaaacaaccttggtgaatcatctctttgatcctaaattatattttcaaagagacaatgaaagagagagagagggagttaaagtccaatttacacccaaacttcaccatacctctcatcttctcctaggaaacatctacatgaggccactagacagccactcatacttggttgagtgaagtacaagtaggatcacagcctcaaaccactgccaactcctttaaatcgtttctacccctcatgttgacaactagctctcactttgcaccttcacttttaccattcactactacaaccaagatttttgtgtgagggctaaaatgatttttgggcgcgggtaggcggcccacacgcacctaggggtctgggaaaatgatgatttttgcgtgcgggtggcgcatccccacgggaaaacaaaaatccgaaataacataattttttttaaaaaaacgaaacccaagaatccggcagtgggcttccgcccgacggccatagtgccgcctgcctcccgccggcctccgcgccacccgccggcagatccgcgcttccctcccgccgcaatgccgccgacgcccctcccctctgccggatctagggagggaaggaaggggagaggaggggagctggatcccgcgtggggagatggcggccggctgccggatccgtgcggggacggccgccaccgctggattcttgcattgacggccaccaccgttggatccgtgtagggactgccgccgcccgccggatccaacgccctccaccgccgccacgtggagcaggcctgcgcgctcctactcccaccgccgtcgcaccgctgctgtcgccacacgccaccaccgctaccgccgtcgggaggagagga

SEQ ID NO: 38263 - DNA, 559 bp, Oryza sativa
ctagccatgccctctgaaacacagatacattacagagatatgctagtcacagatacatcacccccccaattaacatcccagatccatcttaaacatcacagatccccaacaacacatatatgcagttcaaatgccacaattttgcacagcaaattcacaccccttgaaagccacaatttcggtcgttgctcatagaaccgcatatatacttaccaaatggattaaagccataatgtactcgacctccacaacctgtcaataagggaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagataaaggcgcacacttcgcctctgatagcggggggggggggggggg

SEQ ID NO: 38264 - DNA, 582 bp, Oryza sativa
tttgggatctatgtgactttccttgacctttttcaaccccttctgaaccttcctcaacgtaaacgctctcctccggaatgtcggaaactaaagcaaatgaacaaaatcaacaaaacagtacaaaaacaagcataaacagtacatttggatatttttgacatgtagatctcgattttagatgaatttagcaacttgaaccactcgaatccgagttacgatgatttagttatgaatttccgaagtttaatcgattttcaactaatacagaaaattattacgaattaaataaaggattgatgacgtcacgatgacatcatcgccgaccatggcactggacgacgcgaccaccagcgatagagggctcggccgggctatccgaggacacctacgcgaagaggacgacgacgcgaactcaccggtgcaagaaataacgaagtacggcgtccggtgacgaggaccaatggcagctcggctcggctcgatgtcgacggtggcgctccggcggtctttggcggttgcgaaggggcggacggggtgctcctccaccgtgcgaacccggtggtggcgacggacggcgatggc

SEQ ID NO: 38265 - DNA, 363 bp, Oryza sativa
atatatatatatatatatatatatatatgtattccatatatatatatgtgcgtaatatatatagcgtaagactattgtacatatagaataactattctataccccctccctctcaagggccacacccacctccccctcctttgcaaggcccaaaaaccacctcccacctcggtcaaacgctggtcaaagccccctcccgcctatcaaagctcagtcaaacccacctactaactcccctcaccacccacctcttcttaactctcgtctcgcaaaactgagcagtaacgcgacagtcaccgtgtagtaacactgtgtgttacgtggagtaacaacactcaaatatagctgaaatatagccatgat

SEQ ID NO: 38266 - DNA, 527 bp, Oryza sativa
tccactgcagacctctctgccgctcaccctctctgccgaccttcccgacgccggcctgcaccaccgccgccgcactcactctctcgaccgccgccatccatctccaccgccatctccaccgtcgccgtctcgacctctccgccgccatctccgccgccctctctgccgccatctgccaccctctacaccgccctctccatctccgcctcgacctctccaccgccctcctggccaccgccctctccactggtgccgcctcactcactctctcgaccgccgccgggacctcctcttagtcgccacgccaggaccatcatcgccgccaccgggatctcctctccgccacctcctcctctcgactgggacctccacagtgcgccggccgggactcgtagtcgccgtgcgccgcctcctctgctcgtcgtctcctctccaggtacccctctctctctgatgccgatgaatggaatggtggagttaatggatgaatgaatgatgcaatggaatggatgagattttgttcaatg

SEQ ID NO: 38267 - DNA, 622 bp, Oryza sativa
gggtacacagagacggtccacgggtcgacggaagcggatcccgtgtgtcaaccgaggcgagtgaccgacaaacggactccactagacaccacacgggttgcacacgtggaaatcacgcggctaccgagcgggcacactaacacggtcaccacacgcacaagcgaacgactaccgacaccggtacacgggtaccggggtcgacaaccgcacaacgggtacggcgcgacaccaaaaggacgaggacggggaagcgagaggacggatccttaccaccacgcgacgaggcgtgggaacgacaacgacgaacgggcgcggcggagacagctcggggatgacggaggcgaacggcgagggaacgacttcggcggcgatccttggacaaggcttgacgacgcggagtcgaggacgaagacgaggacggggctgccgcggcttgcttggcggacgcggacgacggacgagaacggctcgacggagggacgaacgccacgacgaccgggaacgacgagaggacgacgatgatgaccaccggggccggtgaggaggcgacgagggcagccagcagcggctgcacggagaagaggacggcgctgaacacgccgctgcgatgacgatgacggtg

SEQ ID NO: 38268 - DNA, 966 bp, Oryza sativa
agggggatttattttctttagtttttcttttagtaaactttgttaattgtttttgttgcttaataattatttccggagctctgaaaattcaagtaaaatttgagggctccttttaaaccaaggagaatttaacaaaaattctccggaccacattcgaatttttctgatacgtattttagtgtttgccaatttcttttcgaattttaattaattctattattccttttagaaaataatttttaattttgggatgaatttatcaggatgtgacacttgccccataagtaaaccgagccaattcatctctctctctccatgttactgcacctttttttcttactatacatattcttgcagtaacgttatcaagtaatcgcggtaacacactatgttactatgaaacttataatcgttactacatcttgtagtaacggcgttacatgattgcagtaacgcatagcagatcagcagtaatacttatgatatagtatcgtggagagccaaatttttaaaaaaccaatctttgaagggtaatatctctcacatcatgtactacttttaaaaaccatttgcaccatgatgttagaaaaaaagtgcttatcaaaagtagatccgtcatgattatattatgactacatttcaatattgttactgcaagtaagacatgatgttactgcacgatgaacatcgcgttactacgttgttctgagacgagagctgataagagtggaggtggtggggaaagtgaagggcgggtttgaccgagatggggagctttgaccgaggtgtggggtgggttttgccccctggaggtaggggggtatagaatagttattctatacccgggtgtagaatagtttttctctctctctctctctctctctctctctatatatatatatatatatatatatatatatatatatatatatatatatatatatatatatatatatatatatatat

SEQ ID NO: 38269 - DNA, 9467 bp, Oryza sativa
gtgtggttgctccacgtaaaacacagtgttatacacggtatccgtcgcgttactgcacagttttgtgagacgagagctaagaagaggtgggtggtgaggggagttaataggtgggtgtgtctgagctttgatagacgggagggggctttgaccagtgtgtgtctgaggtgggaggtggtttttgggccttaaaaaagagggggaggtgggtgtggcccttcagagagagggggtatagaatagttattctatatatacaatagtcttacgctatatatatttcgcgcatatatatatatggaatacatatatatatatatatatatatatatatatatatatatatatatatatatatatatatatatatatatatatatatatatatatatatgcatatgcatatgtataaatacatatattacacatgtataatttaaagcacttaacattttatgtgcatatatattaccaaaatatatatttacactaaagtaaatgtgtacatctataaacatatacatgcatgtatagacaattcatttgctcactagctagctacgactttgacgccggcattatgtcaaaagaagaaggaccgacgttatgaattgtcgatccgttgtagtagaattcaccctcgggattaaggacttcttcgttgatgaatctcatcagttgttcttgaacagccgtgatataatccttgtgtgggagattgtccctcatgtgaatacactatcattcgaaaaataatgacatatgaatatatgaaattaataaacagcaaatcgatacgcaatgaaattttgaatggtttatatatacgtataccgagctctcgtgtggtgtagatttgggttgataggaagtgggcatactcgcatacgtagtagccgcacaggttagttcccaggtcatgctttgcacactatatgagaaaggacaagagatttaatatacacttatattaactgtaactagtaatcatatataattagcatatgcatgatttaaaattgttaaaaattctaattatcatatgtaaataccacatgcatgatttaaaattgttaaaaattctaataatcatatataactagcatatgcaaaatttaaaattgttaaaaattctaataatcatatgtaaataccacatgcatgatttaaaattgttaaaaattctaataatcatatgtaaataccacatgcatgatttaaaattgttaaaaattctaataatcatatgtaaataccacatgaatgatttaaaattgttaaaaattctaataatcatatataataagcatatgcatgatttaaaacttttaaaaattctaattatcatatataactagcatatacatgatttaaaattttaaaaattctaataatcatacataattaacatatgccgtacaacaattgatttatatggatattcaatacatccaaaatattttacattgtgtacacaacaattacggcaatacatcggcggtgacggttgaccgcacgtacttcctcctcactattgttccttccttgtgttcgctacgtgagtaaagggtgtcttcgtttgataggaggatgctagggtcaaccgtcaccgtgaaagggggttgcccatcaaactgatcataatcctcgtcagtcttgtcctcaactccgatgatttttcttttgctagggagaaccacgtggcacttcggctcatcaggccctttgcccttctttcctttgctagacatgtccttcacataaaaaacttgcattacatcattggcaaggacaaaaggttcgtccgagtatcgaaccttgttaaggtcaaccgttgtcatcccactgtcatcaatcgttacgcctccaccaatcaacctaactcattggcaccggaacagaggaaccttgagaggtccatagacaagttcccatatgtcctcgatagcaccgtaatacgtgcaagttgtaccatcgtgtcccatggcatcgatacgagcagcactgttctggttcgtgctctttatgttttggtctctcgtgtagaatgtgtacccattgatctcatatccttggaatgtcgctatcgagccagatggtcccctcgccaggtaggcaagttgttggctaatcgtctcgttacccatgagatgttgtcgcagccacacgggcaatttatcaatgtgatgccgtgtaatccatgcatcggacttaccgatgtttctggcgggaactagagccaagtgctcctcgatgtaaggagccaccaatgaagattattgcagaaccgtgaaatgggctttacggaataaattgttgtataccgtcattactgcgttccttctgagagtcccctttccccgtagtttcccttcatggcgtgattcaggcaccccgattgggcgaaggtcttcgataaattctacgcagagttcaatgacctcctctgttccataccccttggcgatgcttgcctctagacgagcacggttacgaacatacttcttcaaaacgctcatgtacctctcgaaaggaaacatgttgtgtagttacacaggcccgagaataccgatctttttgacaaggtgacaaagcagatgcgtcattatattgaaaaatgaaggtggaaatatcaactcaaagctgacaagacattgcaccacatcattttgaagggcttccaatctatccggatcgatgaccttctgcgaaattgcgttcatgaaagcacattgctttgttattgttgcccggacattgtctggaaggataccctgaattataactggtagcagttgtgtcatccacacgtgtgacagtcatgagactttaggtttgtgaacttcttctccttcgtgtttattattcgctttatattcgtggaggacgtacaagaattctgaatagggtaactcccaaaatatagagttctttttccacatcaccacgtgaccatgttcgctatcaataggctggctgctaggcccctttccaaacactactttaagagctttcaccatagcaaacactattttctcactgcgatgtttaggcttcgtacggtggtccgccttatgttcaaagtgcttgcctttcttccgtacagggtggtttgcagcaaggaatcgacgatgacccatgtacacaaccttcctacagtgcttaagatatgtactttctgtttcatccatacagtgagtgcaagtcttgtaccccttgttagactgcccggataggttgctaattgtaggccagtcgttgatggttacgaatagcagcgctagtaggttaaactcctcctgtttgtcctcgtcccacacggggacaccttatttcttccacaacagtttcagatcttcgaccagtggtcttaggtacacatcgatgtcattatcaagtggcttggggccttgaataataatcggcatcattctgtacttcctcttcatgcattgccaaaattttggcaggatttcttatgtattaaccagatttggcaacaactaaacgtagatattttttggtaactttggcaaaaaatgatatggttgaaaatggcatcaaagtgaacaggccctaattaacttgttgacagctactccctccattccaaaatataaagtataaccacccttaactcaaagaccaagaaaaaattattatcatcttgtagtttgaatcatcctaataaatataatgcatgcatccaataggattagataacatgagagtaaaggatttaaaaaagtaataacttaatgaagaagatgtcatagttaattgcatgcttgcatgcatgccttatattatggaatagagggagtagtacctaattaagcatgtgtgttaatttattattaactagtaatctgcccgtgctaacgctacggcgacattcagaaatacaaattaagatcgatgaatatagttattatgttgttaattaaattgccacatgcataaaataacatagttattatcctggttcaaatggagtcattagtgacaacaaaccatggtaaaagcaaaagtaattaaactttggaacttggcaccttgaagcatcaaatccttgtctaccttgttgtctccctgtcacccccctcttaattctaaattaaatgaatgagagaaagagattaatatagtttagtgtgatagtgccaacagatggaaaatttagagcttctagttctctccttctacatctctcttaaatgtgggaccaagtccttatggggcccactcatcatacaaccatagccaacacatcatctgctcttctctcatttaaatcttcttttatttttcaaaaggtgagagaaaggtttaaattgaatttccacccaaaatgccactctaccactccaagccttctaggaaacatctatatatgggcctatttgtcgtccaaatacctgcaaacaaccttggtgaatcatctcattatcctaaattatattttcaaagagagaaagaaagagagagagggagctaaagtccaatttacacccaaacttcaccatacctctcatcttctcataggaaacatctacatggggccaatagatagccactcatacttggttgagtgaagtacaagtgggatcacagcctcaaaccactgccaactcctttaattcgtctctacccctcatgttgacaactagctctcactttccacctacttttaccattcactactacaagcaagatttttgtaacgatttttgcgagcgggtaggcggcctgcacgcacctaggggtctgggaaaataatgatttttgcgtgcgggtggcgcacccccacgggaaaacaaaaattcgaaataacatatttttttaaaaaaacgaaaccctagaatccggcggtgggcttccgcccgacggccatagtgccacctgcctcccgccggcctccccgccacccgccatcggatccaagctcccctccggccacaacgccgccgtcgcccctcccctccgccggatctagggagggaaggaaggggagaggaggggagctggatcccacgtggggagaaggaggctggctgccggatccgtgcggggacggctgccaccgcaggattcttgcgttgacggccacagccgctggatccgtgtagggactaccgccgcccgccgaatccacgccctccaccgccgccacatggaggaggccggcgcgctcctactcccaccgccaccgcgccgctgctgtcgccgcgcgccgccgccgctgccaccgtcgggaggagaggagaggagagtggagagaggagaggagaggcgtgagagagaaaggactgagaggagaagctctgcgtggaaattttaaagtggaaaaagggatagaggggaggggagaggagagaaagaggggaaattttaaagtgggttagagaggaaagagggagttagtattttttgcatgcggctctcttaataggtccgcacgggaaaatcggcttattttcgcgtgctgtccatttaagaggaccgcacggaaaaatcgatttttcccagaagaaatgagttaccgcacggaaaaattgatttttccgtgccgtcctctttaatggaccgcacgcgaaaatgagctggttttcccagaagcaacgagataccgcccgcacggaatctaaaaggtccctgtccaggaaaatcgtttctgtagtagtgattcatgaagttccttctctgcttgatcgatccattttctttgtttcttttttggcatagatcgaacacttgctggtgcgctcgtcggtgttcccggtgtccagagtgccaccatcgccccactttgccattccagtcgactcgaatcatctccagctgtaccattgcgccactgacgtcgccttggtcccaggagaacgacgcccacatatgatcaagccaatacgccgccacgaacgctgtcggtcgccgttgctctcctgctgcctctgcttctcttgccgccgagtcaccgacatgtgggcccggctgtttagccacttcattaggtgctaaggactttaattagttgaaattgaaatcttgtaaggttctttttgtaaaattgctttgtttgccatgtgggcttatggacctaaaagcaattcccctaatgcccggggacctttttgtatagggtttagggcttaccctaaaacatgaaattactatttcatgcattcattatgtcgcgaccgagaaaattaccttttcccgaacgctagtgtattaatccccgtcccaggaaaagccggggtacaccaaacaaacatgatacaaaaggcacatctttattatgtcgataatatttacattattacaaaggcacttgaggcctgacaaacaaaaataaacagcagcggactagcgggcctacggctccatcttcacaggcgctcaactggggtataagccaggactccacctaagacttcttctccaaagcttctcctactgaaggggggaaagatagagcaagaatgagtataaccaccgtactcagcaagtcacaccgggagatgcatgattaatgcaagggagtacaaggagataataataggggtttagttttgtagtaaatagcatttaaaagtcatttagttgcccaaagctattttataaagatgatcctagagctacacagtattattaatcaaggccgtggacccacacgaacctgccttaacccaaggcctacgatgattcagaccgaactggcaacccgaccctgggtcccagctcatcccaagccaacccaggccaaccattccacattttagttgttaagcaggttttaagaattaaaaacactaactttggtacattgctaggcttgcccataatcgagggcgcggctattcgaataggttttactctgatcagaggtgtacatctttacccacaagacacgtcttcctcacgtgcaaccacgtgccacatgccaccacggcatatggacggaagacatgacatagtttccaacccatcctagccatagacaagagtaccgacccaaccccacctacggccggaacctccgggacaggtcggtaggactgagcccctagcagcagggcaccaaccctgtgccatgacatctcgactaccgggccacagctcgtgtagccttcatttgtcctagagatgtccatcgagccccgacttcatccatctccatccgtgtacttttgtttataaccagactgagccacaaactaagccttacccactagacatgtggaagtacggtagtgctttgcaacagaggcccgagcttaatccttatattggccggggtgctacttcccacaactggcatgcacccaaaccccaccagaaaacaggttttaggggttttgaaagaggaagagaggggtatgtccaattccaccataagccaaccattccatagtatccaagagatatgaatattcacaaagtctaaagttataaaaaccacctaatgttgtcctattaatcagcgaagcatctacctaaattcatactagtggaaccatgaatagagtacccactagttggggttttgtttattctagggtgaaataggtaataataacaatagcaataataatgtcttaacaaaggtaaatataaatggctaaataaaacagtgataaagcggtaatgcattaatttaaatcaaaataattttataaactgggattcaatatgctcaaggatgatgtgacttgccttgctcagagagaacggccttccgaaccttcggcgacacccgcgaaccacgcttctggaacctccggaacgatagaagctacgcgaagcacacaagcaaagctacaagcctataaagaagaaataacaatacataaaaagaaagcacacggttctttaggttataacaaacattaggagacttgaacgggtcgatttagagttcgtatgaccaagacatggtcatccgaagtttaatgctgttacatggagatttacggattattataattaggctttgcaactataaaacatgtggaagcgctagcctggaaaagacaggaaggctgcgctgttgacatgcggaccccacatgtcaacctaagggaccacagtagaccgagtacacagagacggtccacgggtcgacggaagcggaccccgtgtgccaaccgaggcgagtggccgacaaacggactccactagacaccacgcgggctgcacacgtggaaaccacgcggctaccgagcgggcacacaaacacggtcaccacacgcacccacgaacgattaccgacaccggtacacaggcaccggggtcgacaaccgcacaacgggcacgggcgacaccgaaaggacgaggacggggcagcgaaaggagagagatccttaccaccacgcgacgaggcgtgggaacgacaacgacaaacgggcgcggcggagacagctcggggacgacggaggcgaacggcgagggaacgacttcggcagcgatccttggacgaaggcgagacgcggccggcacaaggcttgacgacgcggagccgaggacgaagacgatgacggggctgctgcacacttgacgaaacgcgggcggcgaacgcgatcggcttgacggagggacgaacgccacgacgaggaggaaggaggaagacgacgaccgacggggaggcgatgagggcagccggcagcagctgcacggaggtgaggacggcgtgggacacgccgcagcgatgcccacgatggtggcagcgcagccagacgacaagccgggcgatcgacgggacgtcgacgacgagaacgaacggagacgacgacgatggaccgaggaggggtttggacaaaggggaggcgaggccgagggcgaccttgccgttgcgatgccggacgtggttgtggcgcagcaagccgacgagccggggaggaggaaggggcggccaaagggacgccggcgacgaagaggatggaaaggccggcgcgggcgacggcggtctccagacgaatcaaagagcaggccggggtggaggtcgacgcggcgacgccgaaggaggagacggcgcggccggcccgcacctgagcggcgcggcaggggcggctggaggtggtacagtggcggcaacggcactggacgacggcgggaacgcgcctccggtggtcaccgcgcgaaacggagggcaggccggtggagaggaggcggctgcgacgctggaggaggcgacggcacggccggacggcgctcgggcgaggagggagaggcggctggaggcggccggcgcgggggaaagagaagggcgacggcggggaggggtgatacgaccacggggaggctcgggatgaggctaaaacgatagaacggaggatggggattccattttataggagaggagagggagccggccacgggggaggtcggaacggaggcgggaatggcgaccggcggccatggaaagcggccggggtagacgcgtccgttcccgacgattgagggcg

SEQ ID NO: 38270 - DNA, 5056 bp, Oryza sativa
tggctcggctcggcctggcttgggcgcggcttgggccgagcggccggcccaggaggagtggagggaggggaggcccgggagagagaggggaggggagggagctgggctgggagggggagagaagaggtgggccgggaggaggaggagaggcctgggagaggagggaaagagagggaggagagggagactttgggctgggcttggcccaaaggaggaaggaggatttatttttagtttttctttttagtaaactttgataattgtttttgttgcttaataattatttccggtgctctgaaaattgaagtaaaatttgagggctctttttagaccacggagaatttaacaaaaattctccggaccacattcgaatttttcttgtacgtattttagtgattgccaatttcttttcgaattttaattaattctattattccttttagaaaatgatttttaatttcgggatgaatttatcaggacgtgacacattacttgatataatagcttgatgattatattgttctcacccttgtttttgccgaagccaggagtttaatcatataaattagtttcattccaacttagttcccaagtgtagattagatagatggtttaattctatagcaaaatattagagttggctcatcctattgcttctacagtaatagttagccaaaatcttgtaaatacccaattattttatgtaaacaaatcttcattggagccttaatcaaatgtatgcgatgaagattcagattgatgaacctgtatcaatctactgattcaggggatgattatcacgcccggaatttctatccaaaattccaaacgcttacatgtgcgttaaaccctcgtccaggaatcagccgaggcacacaataacaaattgataatagagtactatcaaataactaattaatatgcgcagaataaattattacagaggtggatagttcctctcaaagaacaaagttctacgcagcggaaaaaaaaacaaaagactaaaccaggaatataccattccaaaccaggagtcaatttagtcatcacagtattttcattaataatgagtaatgtgagactaatcacgaaaaacattgttagacccacccataaccgcgggcacggctattcgaatagttttactctgattagagatgtaccactgtacccacaagacacaactctacaacatgtcaccatgcacctcagtaccaccacggtaccttggaaaagaactgtgacaatacctctcatacaacacaactcaccacagtgcaccgttcgtggatcataatctccccctcataaccagaggcaacgaactccccagcgacccccacggacttctcgctgcttcacagtctggcaccccgtaatgaatcatgctatacaaaaggtaaagccgttgctcacgctggcttgtggttggcacggtaaatgtttcacaacagtagctcgtcaaccagtccttaattgttatgagcacgaccatcaaaaccatgtactcacaacccacctttcatcaggtttatgtatcaattaattatcataacacgattaaccatcgtaagctaccactaaatataaccataagtaatatcgtaatatgattaaccccattgatgagctaatgtttctaagcatggctaagcaattatacctatatagcacttagctgaaccaaaccaatatataaggtccaagctattcaatttattacccataggaaaataaagtcattgtcggccattaaataactgggaaaggctcaccacccgacgacattcgaaaataatgcataagttgaaataaaacattagctttaaacatgttcaacatgctaaaagcgctgtttgggatctgtgtgacttgccttgagcttcttcaaacacttctgaaccttcctcagcgtaaacgctctcctcgggaatgtcggaaactaaagcaaataaaccaaatcaacaaacagtacaaaaacaagcataaacagtacatgtggatatttttaacatgtagatcttgattttagatgaatttagcaacttgaaccacttgaatttgagttacgatgatttagttatgaatttccgaagtttaatcgatttttaactaatagaaaaaactaataaaaaggatttatgacatcatcgatgacaacatcgctggccatggcacggctccacgcgaccactagcgatagagagctcggttgggctatccaaggacacctacgcgaagaggacgacgacacgaactcaccggtgcaagaaactacgccggacaacgacgtacggcgaccggcgatgaggacaaacggcggcgcggctcgactcgacgacggcggcggcgttccagcggcttgcgacgacggcgaaggggcagccgaggtactcctccaccgtgcaaacccggcggcggcgacggacagcgacggcggcgacgctagcggtggcgcggcgcgactggagagtcgccggcgacggcggcgccgctacgaacaacggcgggactcgggacttggggcaaacggaagaggacgactaggggatgctttatataggcttggattagagagatcggactccaaccgagaggaatcgagccgggaaaaactagggttagttaggagagataaactcaaaacgaattcgatttggtttatctgggcaaaattgatctccgaaactctaggggaaagggagaggataaggaggagatgatttcccctcaagcaaccggactcgggggcgaccggttgaggttgaatcggaggagagacggcggtgctcgggctcggctcggcccggccggaggtaggggatgaccctgacatgtgggccccatatgtcggcggctagaggagaggagggacggctaggcttggattgggccggcgtggctgcacggccgcgcgcgagggacagggatgttgggccggaaacagcctaggggaggattttaaagactttttcaattaaaataattcgtgaaatgatgtttcatttattaaaaatacttcccttgctcaaataattcccagaaaaatctagaaaatagataagcaagcaaagtatttaataaaattttatctagctcaattttgtgttgaaatttttcctagattattagagtttaacttgtaggtttttaaaataatttctaaaaatgcattaaaaattgaattattaaattaggcgattttcagggcgtgacaaacctaccccccttaaacggaatctcgtcctcgagattcagaagaactggcaaaaagatgaggatgagctgacttcaattcatcctcccgctcccaagtggcttcttcttctgaatgattgctccactaaaacttacagaaccgtatgacgcgattctgggtgtttctctcactcacctccaaaattctgactggcttctcaacataagttaaatcttcttgaatctctaaacgctcaggatctgcttcctcggtaggtacactcaaacatttcttcaactgcgacacatgggaaacgatcatgtattccctccattgacagaggcaactctacttgataagctacttcacctctccgactcacaatcttaaaaggtcccacaaaacgcggtgccaatttctctttggtctgaaaacgatgaactccccgcagcggcgtaacccgtaggtatacataatccccttcttcgaaagtcaaatccctacgacgattgtctgcatagctcttttgacgcgactgagcaactcgcaacctttcttggataatcttcactttttcttctgcctctcgcaatacatctgtcccaaaaacttgacgctcaccagtttgatcccaaaggagcggtgtacggcacttacgaccatacaatgctttgtatggagccatttgaagactagcttgataactgttgttatacgagaattcagcatacgacagattcttatcccaacttccaccgacatctagaacacaggctctcaacatgtcttctagaatttaatttactctttttgtctgaccgtcagtttgagggtgataggcagcactgaaattcaaacgagtacccatcccttcttgtaagttctgccaaaacttcgaagtaaactgactacctctgtctaacactattttcttgggaacgccatgtaaacatacaactcttgccatatatagctctgcgagcttatttcccatgtaggttgttttgacgggtatgaaatgagcaactttagtacgcctgtcaaccactacccaaatagaatcatgtcctaccgatgttctgggtagaccggtgataaaatccattcctatttcctcccatttccactctggaatcttcaacggttgcagcagaccggctggcttctgatgctccgccttgactcgctgacacacatcgcatagagccacatattctgctatctctcgtcgcatgctggcccactagaattgttgcttcaggtcttgatacatcttagtgctcccgggatgaatggaatacaaagtttcatgggcttctttcatgatagtatcctttagctccttattatcgggcacgcaatttctttctcctagccacacagttccttgctcatcctctatatagccgatggctttacctcttctcatgttctttttgatttcttggatatcaggatcattcatttgagcctctctaacttgatcaaaaagagtaggctgagcttctaaagcggcaacaaaacctttgttgactattcccaagttcaacttttcaaattcctcacataactcccaaggtaggtgtcgaccttctaacatcttacaagtagcttttcttgttgagagcatctgctacaacatttgctttacctggatgataatccttgatcaactctaacccccgtcgttgacgcatgttcaaatcaggttgagtgaaaatgtacttcaaacttttgtgatccgtatacatctccgtacggttaccaaaaaggtaatgacgccaaatcttcaatgcatgaactcagatgccaactttaggtcatgtgttggatagttattctcgtgggggcgtaact

SEQ ID NO: 38271 - DNA, 626 bp, Oryza sativa
tccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcatt

SEQ ID NO: 38272 - DNA, 678 bp, Oryza sativa
ataggcaacacttgcttcggtccgaatagaatatcggacctaaccgaggaagtcctacccacgccgatgcaagcgaagatgacggaacttacttctcgccagaggtctcggactaaaccgatgcagcccatgctcgaaattaagaactcgacaggagtaaattagggtggcgatatgttgaaagttgtattgatctagagatagattagaagaaccctagatgtacatatttataacatatttataacctcgagccaatatgaatccccatcataaatgactcatgtttcctaaagataaaacacaagtcctaatcagacactaaccaaactttttaaagataaaaagaaaaaaaatactaaaccctgcataattaatagataaattaagctgccatgccatggtcttcacgactccttcttgaacttggtctcttctggacagactttccatcggttgattgtgttctttccctaaccaaatccactaaagaatcttaccatattttggcattaacacctagccatccttttttttacacctcaatcttagccatttacccatttccctttctcaatcccatgtctcataatccttttgccaaaatatgcctatatgcatctctctatgatctcttatcacgttgttgtgcctctttccccatctttacaaactcgc

SEQ ID NO: 38273 - DNA, 481 bp, Oryza sativa
ctttacttgcctattccgttaggaatatgggttgtatcttgtaatacggacacctccccatatataaggaggggtccgagtgcctcttggggtataacttttcctctagatcatacgatcaataacacactcggcggatcaatccccggacaggagtaggatattacttatcattgagagggcctgaacctctctgatcccaagattaccaccagccaagcctctctgcacggcacaagccaagccttagcgttgctgcctcgggatccaatcgcaggagcagggatcatgcaaaatgctctgttcactcgccagctaatgaacatagagatcgccgcgctgagcagcctcactctccgcgtcgccggcaacccatcgatcttcgtgatacactcaatcaacgccatgcagaaagaggccaccaaccacactgttcaccaaatcgacatcacgacgacgaagttggcgttgtagcttttac

SEQ ID NO: 38274 - DNA, 598 bp, Oryza sativa
cggttaaaccttatccccgaaccggcgaaccttaaccaatccgccgccaaatcctctcgggtcgagccgatctcctccagctttggctataaatagaacccccaagacctcctctttcgtttccaacccctagctcgagctcccgttccctagccgtctctccccgcagccgccttctctctccgccgccggcagccgctccagccgtccctagcatccggtgtagccgtcgcctccggtcgccgtcatcaccaccgggttcgcaaggaggagaagaagcccggccactagttccttttcgccgtaacccgctggaagcccctcgacggcgtgaatccgatctactccacctccggccgagcctcgccgtcgactccgtggtttctggacgtcgtcgtcgctttcttcggcatcgcagagccaaggtgaagcccgtccactggttttcctccgctaaagattgccggaacgccgctgtcatcgtcgaccagtacctcaccgcccttcggagttcgtcgccggctgtctcccgtcgtcggtcgtcgtcgtgccgcccctcagtgagttctcctcgtcgtgctctttcttccggtgcctt

SEQ ID NO: 38275 - DNA, 1297 bp, Oryza sativa
aagctgcagaggcaggtgaagctgacttatctagagagcaatggcccgctgcgggttgaaggatgagagggtgcgtggtggggaacaagaacgatgacgagatgaagccgctcttgagcgtgacgcttcaacacgcttaggccaggtcccgctcacggagttcgctccgactcatacacgataccagcgccttcctggacggcatcgccaccgcggacgcgcagtactcgcatatgtccctggacatgcatccgttgggaagagagagaggaggaagatgggttggctgctgtcatttggggtccacgtggaacccatgcagtggcggagccaggattttaaagttgggtattcccgtctaagcgttgagccgttggccgcttctacccctcgcggctgccggccacccaaccggcctgactgcctgagcttggcggagtggcgggcgccacccgctgcccgccgcggcaatagcctccccctccgtggtagcgcggtccagttctcgccgccagttgccgcctcgccgcgccgccgcctagggtttggaaatggggagcggcgcgagggagccgagccagggagggatgggtcatggagggagagcgagagggggccgtctggaagagtggtggctaagtggtggctaagtggatcaactgatgtctgatgggtcatataggctggttgggctgtgtttggatcgaagaattgaggatttaggtgcactaatatatgtacatgtgtatagggctatgtttggatcgaataattgaggatttaggtgcactaatatgtgtacatatgtatatattagaaatatacttgtttttcgataaaaaagttgggtattcccgggaatacccgggaatcatggtagctccgcccatgaacccatgctactaactcagttgttacgtcaaccaaaatcaggagagatattgcctaaggatccaatatgatttggttttgcaagattagtaatgtgttatatatgttactcccttcgtttcacaatataagtcattttagcatttcccacattcatattgatgctaatgaatctagatttactccctccgtttcacaatgtaagttattctagcatttcctagatttatattgatgctaatgaatctagacatatatatctatctagattcattagtattaatatgaatgtggaaaatactaaaatgacttacattgtgaaacggaggaagaattttcggttaacgatgattctaaaactaaacacttttccataaaaagagggacccccagtgaacatttttct

SEQ ID NO: 38276 - DNA, 4807 bp, Oryza sativa
  unsure (1)..(4807): unsure at all n locations
nnnnnnnnnnnnnnnnnnnnnnnnnnnnnnnnnnnnnnnnnnnnnnnnnnnnnnnnaataatcgaggatttaggtgcactaatatgtgtacatatgtatatattagaaatatacttgtttttcgataaaaaagttgggtattcccgggaatacccgggaatcatggtagctccgcccatgaacccatgctactaactcagttgttacgtcaaccaaaatcaggagagatattgcctaaggatccaatatgatttggttttgcaagattagtaatgtgttatatatgttactcccttcgtttcacaatataagtcattttagcatttcccacattcatattgatgctaatgaatctagatttactccctccgtttcacaatgtaagttattctagcatttcctagatttatattgatgctaatgaatctagacatatatatctatctagattcattagtattaatatgaatgtggaaaatactaaaatgacttacattgtgaaacggaggaagaatttcggtttagcgatgattctaaaactaaacacttttccataagacgagggaccccgagtgaacattttccttagccgctcgcagggtccagctggggcgcgggagcgcgagacgcaagcccgcaacgctggcgtgctcgcgtgaactgggtcccgcaccgatttattgggtcgacgcacaaattggcatcgttttagctggcttcgttgtagatcctataataacgatacatcattaattcgatcatcccttggatgcggcctgcggcttacattaaatctcgatccaaagaagcaaagatgatgacagacagaaattaattaagctagaaatctcctcgatcgatcacacacacacacacaattaaggtacatacatacatgcactgctgcaactgcaactgcagggtcggtgcgtggctactacaagtgtacacatggtacgttggttggcaccatctcgatcgtgtcgttgtgctcacttgccggggacgaagttggtggcgtatgcccaggcgttgttggcgacggggtcggcgacgtggtcgaagaggttctcgatggggcccttgccggtgacgatggcctggacgaagaagccgaacatggagaacatggcgaggcggccgttcttgagctccttcaccttgagctcggcgaaggtgtcagggtcgtcggcgaggccgagcgggtcgaaggcgccgcctgggtacaccttgtcgaggccctcgccgagcgggccgccgccgacgcggtagccctcgacgaatcccatgagcaccacctggaccgcccagatggcgaggatgctctgcgcgtgcaccaggttggggttccccaggtagtcgagccccccctcggagaagatctgcgcgccggccttgaaccacaccgcctccccgaacttcaccccgttcttggacaggatctccgggaagacgcagcccagcgcccccagcatcgcccaccgcgagtggatcacctccagctccctgttcctcgcgaacgtctccgggtcggccgatagccccgccgtgtcccacccgtagtctcccgggaactctccggtcaggtacgatggcgtctgctccgagaacgggcccaggtacttgggacggtcaggtccatacctgcacatatatatacttgtatgttagcaattgcagtgtacatatatacagtacttatgtttgtatatacatgcatgtacgctacgtaccagatgctctggggcgcgctcttgacggtgcggcgcatggtgatgcggccaccggagtcgccgacgcggcggacgagctcatcccggcgaggggcggtgccgagaaagctggtggtctggtgcagcgccgacgcggccatcgttctaacgagggcgatgcggcggcggttgggttggttttttgtggtgtgtggtggagatgggcggcgcggaaggggagatctttatacggcgtacgagtggcggagcggtggactggtgaacgcgcggcgcgccacgtccgcgccacacaattggccgccgcgcccccgcgactggatatgggtatggcgcggaatctcctccccgtccactccaccaatccgctgatgccacctggacggaaagatctcgtctcctgcatccaacactatctgcacccaccaaccaactcacctagctagaagtagcttgctgctgaagtgctgatggtctaccggaaacaaaaaattgtacagctagctcagcatataaaaattaacttgttcatcagtgaattcacttggaaaaagttacttgttctttttgcaacacgatgaatcagactatcgccatagccaaagggtggcatttcttgcattcaaaatgatatgttaattacttcgtaggactaccttgccactaactatggtttgatgtgggcccactagtgacaaattggtgactgaaagacatgatgaaaactctttcaattaagacataatacatttttattaatggacgctagaaataacaaattgttacaaatacggtcttttctttttggaattaatatttttcatgtaatttatcatgttgtcaaacatgctatattttaagtcatatatattgagagaatttgctccatgtcactgagtttatcatagtttaacgatttgctatttgctattgacattatctttttttcataatataccagtgagtatatcaattgttctaaaatatgtcattaggctgattttttcttcaaaattaccaaaaatatccttacaaatgtacaaggttaacaataggtttatccatttagaagtttccaaaaaattatgaaacatttgtgtagtatctttacacaatataaaagtttctgtataggttttaaaatttctacattctgtttttcaaatataattcatccattatatgctatacataatactttcaaattgttgtttttaatgcaaataatatttcatatccaacacaaaatatttttaactacttttctaaaaacatgaaacttgtgcgcaaacttccaagttgtgtaaggaggctaaataaaaaatgatatattttttaaacttccaatgggataaatcaattcttaacattgtatgtgtataatagtgttttttttttctaaaaaaaaggcttagctcaatgacatattgtggaacaatgtcacatcacatttttcgtgttttctaatttgcttgatttgaaaattttacattcatatttattcgcctaaaatagcttaataaaaatttcataaatgaaaagggtttaatttgactaaataaattattaattatgccacacttttattttatcatttgttgattggagttatttgatttttatttgccttttggaagtggagctaaattcctaaaatctcataaaattgctaatccagaaaatttccccaacattcttaaaatgtccaaaattccaaatccttcaaatttagacttttctaaaaaaagttcctgttcttttctttttcctctctttctcctttttctttctttcttcgtcccgttgcctgctgtttatctgtcacgatatctcctcctatccctcgatctgtttctgctcatgggccagcatccaatgcccttcctatcccgtgaaggaataagttcactttgactcccttaaaagtgacctgaatctaattcatcaacctaaactacaaaaccggatatctcgaccaccgaactattgaaaccggtgcaatttgattccctaggcggttttattgacgtggcgcctatgtggcagtattgcccgggtcttctttacacgtggcgttaacgtggcgcttaagtggcattagaattaaaaaagtacgtgggaccaatttgtcaattacacaaaaaaaattgcgggacccactgacaggtagggcccacatgtcagtttatcccttcacccatctctctctgtctctcatttcgagcttgacacggcaaggctatcggcgccggcgccggctgcctcaatggcgtccactagagcaccctcgctgagctccgtcccgctgccatcatcaccagtcgcagtcccttgcgagcaagaaaaggagattggggagagagagagagagagagagagagagagtccctcaccgttgatggggtggctgagaaggcaatgggcgcgtgccgaagtggcggtggtggtggacggtggccggcgtatgggcgggcactggagcagcaccaggcgagggccacgatggcggcggcgggcttgagggcgggcgttggagtggcggcgacgacaggctggcgagggccgaacaactctccatggccacccctcttgtggacctcggtgtccgcgctgctcgatgccgccgccgctccaggtctaggggtgcccaccaccaccgttggtcgatcgcctcgccctttcgttcccctcagattcacttgccgtggtggcgccatatcgaagatggaagaggaggcgacgctgctagagaaacggagaagcctggatgccttgcgtcgccacctagctcttttcccctaccggctactgctcaccgccgctgccgagggaagtaaaggtgggagaaagagataaataagggagagaggaggaggacgaggggcggcatctctggagccacgccggttgcatttggggcagtgccgccactaccaatcgctctcgttggccgccaccgaaggggagagaaagagaaagaaagagagaagggaggaagaagggaggaagcagaaagagaggatgacatgtggggcccatatgtcagtggaccccacaaaatttatgtgtgtgaatga

SEQ ID NO: 38277 - DNA, 10937 bp, Oryza sativa
tcccattttcgtcccttgaccgcaaaaccgggtacgacccgtcccccaacttacgaaaatcaggcaaacaaggtccctccgcggttttggctgatgtggcgcctacgtggcttgtttgaccaggtctctgtccgacgtggcattgacgtggcgcttacgtggaaattcaactcgaaaaataaataaaccttatgggacccacatgtcagtttcacacagaaattataaaaaaggtggggcccacgtgggcctcacatgtcattctctcccctttccctccaccggccttcgccgcccgcgcccgccggcggttaccgacgacgcgactccatccgccgccgcagcccagcgaccggcggcgtcgcctgcctccctgacctgccacggccacgagttagtgcaagcgcacccgccgtcccgccgctcccgccggtaaggaggttcccctgttgccatgctgtatcgaagagaaccagcaatgcttcctccctgctccccgtgccggccattgcgacggtctcctcttcttccctcttgctgcctcctctctcctggtccttattcttcacgatctccgtgtccttcatggcattcgtgatctctgcagctggcgtctccactcgctgtacatcctccacgcagaccacgccgcattcttggccacctgatacgtcggcgcgtttcgccggactcgctgcctctcctttgccgtcaacgggagccttgtcgccatgcacggtaacggtgttgccaccgccaccgccgccgtcatccgccgtgacgacctccaagttcttgagttccttccgagcccataggagtagctcatacgcatatacatcgggtatagacggccgcatgcatatgcgtcttcgtacgagcatatatatgcatgcatggagacgaccagctatagcttctagctagcttcttattggtttgccgccaacaacatgcagacgtatatattagccaagcatgtgtatatggcttagcacactcacatgtatatatgccattacatgcatgactcatgcatgagtcatatttaattcattagcttgcttagcacattagcgttgttagctagctaatttacctgcttcctgcaaccagccactaacacaaagtatgcgagcgtggcggaggagcggcggcgggcgagcgcagcagtgggcaaagcagcggagggcgagcgcggccgcgggcagagcagcggagggcgagctaggcgaagaggaagacagtggatgggatggggagctcccccgtgctcgccggccaccaccgccgtgccccagcgggtgccccacggcgccggcgacgaaggcctcgaggccgtcgatcgcgtcgtgagcttgccgggcagggactcgatgaggaggacgaggtcgtcggccctgccgaggacgcgctcggtggccgggaagagcaccgccgcgatgtcctggatgacgaggagctgcttgtccgtgaaggccagcgtggggcccaccagatgtccctaaagacggtgtgaaactgacatgtggggctcacgtggaccccaccttttttataatttctgtgtgaaactgacatgtgggtcccacaaggtttatttatttttttgggttgaattgccacgtaaacgccacgtcaatgccacgtgggacggagacctagtcaaacaagccacgtaggcgccatgtcagccaaaaccgccttcaaaaccaccgagggacctcgtttgtccggttttcaaaagttgggggactggttttgtggtcaagggacgaaaatcagactgggcgacaaatagaggaacccaaagtgaacttattccacagtattttcttcatttgggccagagactagtggacctttttcttgacttgtctgggccaaagcccatgcctgacttgacttcatggtgtaaggggccgatttttgtggatgcttattctaaacagaataatttgtcttttggagttaaatatgaaaccaaagcatcaaatatggatcattatcagcaaaataatcatttgagaattttgcaattttctcatgattagtaaggtgaccaacatctgtggctactctattcctaaaattaggagcgcctctttgcactaaaatggctattatttggtagagatatttccatcagaaaaatattactcccttaataatactcgttatttcagataagaacatgttttaaaaaggaaactttaacaattattttctatataaaaatatcaacaaatttataattttattatattagtttctaagattaatctatgcctataacctacggttcatatttatgaagtcttgttcggttaacaatcaaactagtgggtttgaaaaagattgaggagcataattccacgttataataggtgtggaataaatcattttaaaatatctcttaactcttttatgagagggattaactgaacaaggtgcaataaagcaaatattttgaaaattattcatagttcaaaactaaaaatatactccctccgtttcgaaatgtttgacgccgttgacttttttaaacatgtttgactgttcgtcttattcaaaaaatttaagtaattattaattcttttcctattatttgattcattgttaaatatatttttatgtaggcatataattttacatatttcaaaaaaaaaattgaataagacgaacggtcaaatatacttaaaaaaatcaacggtgtcaaacatttcaaaacggagggagtataatatgtgactataaaaatggtcaccatatccggattgggcttaaacccgatggcggccgcgggggaggggggcacggcttgcttcccatcgagggcgccgagctcgctgccctgtacgaccacgcagcggcgatgaccggcagagatggcggttgattcttcagtggcgcggctggccgaactgggttggtgctcattggggccagcttgggttcgttaggtgatacgtcccacgtcagcaacaacagtcccggactcggactgggttggtgctcggtggccggactgggtggtgatggaggaggggttataacggtattgcggctgagggaggtgacacgatcgggggcaagagttgagggaggcaatgtagacttattcctgaagatgaagtctaggcccataggggaatcggctttaaaggccagaggagccgaccagtccagcagtctccactccaatccccaccacgccgccatccatggccagcggttgggatagaccccggcgagcggcgagaacggtgaccacccgctttccctcgtcctccaaacttgctgttgtactatgaatcggattcggagatcgatcgagttgcattgagtgtcggatcggaggagttggctatagaaaatcggaggagttttgttctagcggggagggaggcgacgacggcggaggaagaggggatggacgtacaaggcaagcgcaaggcggatggaaaaccatcttttagtgtcaggttttctctaataggcactgatgatgggggacactgatgtgttattttgtcgtagtgttaataagcacctccaaaacaacaaagtccaccggccaggcctgtaggccctatctagcttctcctgcgttcccatacactactagaaaactcattttcggcgtcgtaggggatctatttttgcaggcgggtatgttattcggagccaaaaccccgccgacaaaaaaagtacccggggtagagggggcggtccgcctgaaaagatgcccctatatagtcttcttcctccccgagccctgttcattctccccgaagtttctctctcctaaagtgacttaaatataggggggaggttttgaacttcaaatcttcgggggatttttctacggtgcttagatctactcatttccacactaggtatgtaattttttaagcttttagaccttaatttgtgatggatttatgcatgcaaaattgtgaaggaagagctccatgttttttaattttatttcttttgatatgttgatgttagatgtatgtgtaatacttgatgcctcttgttgtagtggtttaatgtggtaacataaattctcatttttttatttttgttatcacatccacctcttagttctagatctagatctagatcttgtcatatatagagagagaataaaatttttaatgtctatttattcggtgcaatcaaaaaatagttatagtattttgtaatatgccgatgatatgattttgttagcttttcctaatgtactaatttggcatgtctgtgtaaaaaaaattgaaataaactttgtttttttattaatttacaattaaccttttgttaattagttttgaatagcgataagttttttcaataaaccctacaaatttggtattaattgtgcaaatattttatgtgcatttttttagagatatggaaagttaggaatggatgtatcattggccgaggtttttgtctccatatagaaatgaagtgtctaaatttattggtattgccaaggcacacgctgagaagtataatatgaggaagataatttgtccatgtgctgactgtaagaataaaatagcctgggacttcgatgatgcttttaaagtgaaggagcacttagtaactcgtggatttatggacaagtacgaaatatggacacgtcatggcgaagaacaagtggacgggcctgaaaatgtagatccgatacaagttgaagacatggtgcatgacgatggttttgttgaggacaaaatcgacctagaggaaatgttacgtcatgcagaacccgaggtgctgatggggtcagctagaggtttaaataactttgaagctttacaggaagctaaggaagttttgtacgatgagtcgaagggctgtgacagtgagttcacaacactacggtcagttcttgaacttatgaggttaaaggcgagacatggatggtctaataccagtttcgacagtctgttagaacttctgcagaaaatgctcccgaggtctaactcactaccatccattcacttggtgtggaaaagattcatgcgtgcgtaaatcactgcatagtgtacaggaaagagtacgcttctttagatgaatgtccaacatgcggtgctagccggtacaaatcgaatagcaatactggcctagaaccgtctgacacaactgagggaagacaaagaaaaatctcgcagcttgtgatgtagtaccttcctgtcaaagaccgtattaaacgggtatactctaacccatgagatgcggaactaatgcgctggcacgaagaagggcgcaagaaggatgggatgattcgacacccggcagatgctcgttagtggataaactttgatgctcagtatagagagtttgctaaagacccacggaacattagatttgccatgagtactgatggagttaatccttttggagatataagcagctcacatagtacttggccagtgcttctcaccatgtataatcttcctacctggctttgttaaaagcgaaaatacgtactactctgtatcctcatacagggacctcgtcagcctggtattgatattgacgtatttcttgaactattattagaagatatggctgatttatggaaagagggattgaaagtgtgggacgagtacttaagggaatacttcacagtgaaggccatcatgttcgtgaccattaacgattatccagcaatgttttcagtttcaggtcaaattaaaggtaaaacaggatttatgatctgcttgaatggaacgtactataggtatctcccgggttccaacaagcttgtgtacatgcggcaccggcggttcctatgcacaaatcacaagtaccgcaagatgaaggcggagttcgatggcactgaagagactgatcctacaccaaaaccaacatcgggagaaaaggtgtgtgcaatgatagagaaaattgtttgcgagtttggaaaagtgactaagaaaccatcaaaggggacaaagcgcaagaaacccgagaagaatacgaaacaaggggatagtaagaagcaagatgatagttcgaagccagatgataaactccctcccccattcaagaagcattccatattttttaagtacctcccatactgaaaagatctggaggttcggcatgccatagacgtcatgtatctagagaagaatgtatttgaaaacatagttggaacattgtcggacatgctgaacaagactaaagatggtctgcaatcaaggatggacctagtcgagatggaaatcagggaagagttacaccctcaagaaggagaaaagaatggcaaagtatatcttccaccagtctgtttcacactgacacctgaggagagaagtcattttgcaactcactccgtgatgtcagagtgcccataggtttctcatcaaacatcagtcgactagtttcaatgaaagatttatcggtatctggttataattcacatgattgtcatgtcttgctcaccgtgtttcttgcaatggcaataagggccataaaaccggagcatttaaaggttgctatcacaaggttgtgctacttttgcaacgcagtgtcatagaaggtcattagtcttgaagagttacgaaatcttcgtacattcgcacatgagacacagtgccaacttgagatgtgtttccctccgtcactttttgatacgatggagcacctcatttttcacatagtgccgcagatgggtgcgcttggcccattgtacctccatcaaatgtggtcatacgagcgttacatgacagttttgaagggttacgtccgaaatcgtgcacatccagagggatcaatggttgagggttatagtactgaagaggttgtccagtgctgtatcgattacctcaaagatggatatgcaattggagtacctgtgccccgacacgagggtagattgagtggcaggggaacgataggaaagaagagattcgtcacctatgatcacaaatcattccaagaagctcacttcagcgtgcttcatcagtttgctatcgttgagccgtacatcgatcaacatatcgaactaatacgagctaacaataagggtcacaccaccgagtggataatgaaagaacacaagcgtctcttcatagattggttgcgagacctagacttacctgagggacaaactactgatgaaataactatgaagcggttggcttgtggtccatcaactacagtaaattcttggcagggatatgacattaatggatactcgtttagtacaagagcccgagataataagatctgtacgcaaaacagcggtgtccgtgtggaggcaattgatgaagccgaggaaaaacaatcatacttcgggtttattgaagaaatatgggaaatcgactatgggcacacagtgcaattccccatatttaagtgccagtgggtaaaatacccaaacggggtcaatgttgataagttcggtcttactattgttgacctggcgagtgtgggtcacaaggatgacccttgggtactcgccaatcgcgtggcacaagtgttttacgtgaaagacccatcaaatttgaagaaagatatagtgctacccgggaaacaaaagatattgggagtggatggggttgaagatgtcgaagattacaatcaatacgatagtatgccactttatagtcagtttgtacagaagattaagaatgtcgagacatctactcagaagatcgtgaagccttacatgcgcacggacggtgtgggaaaaaaatgttaaagggtaaagattgttgagtcgcatgtaagcatctaagaaattagtagttatgtaatggtggtatgtaaggtgatgtgtgatcatatcgcaaattgatgaacaattgcacgcaacattttgcatattagtttgtattaattttatgtgcaattaccatttgtaaggtaacatttatagttttttattttttaaaattttttaaaagaggtttaaaaatttagtagcattttgttatgttcactaaccattgtttgaaaacttattttaaaaagtttgaaacatttaagtaatatttacatttgaaaagtagtaatactaaggtttatctatttgtatgtacaattaccatttttattacaactattgtagacattttcaaatcatagaaatgattttaaaataattatgaaatagaaagggtcagttctgcaaaaatctgtccgcctgcgaagattattatgccgagtagggtctacatcttcgcaggccgaccgatagtaaaaatgatcttcacaggtggaccgcccgcttgcgaagatcgtttccctatataagggcaagcccgccgcaccaaaatttctaagttcaaacggcaaccctagaaattttggcgctgtaaggtgccaaattttttcgccaccgcacgcctccgccgtcctccgccgccgcctgcttgtgaccttcaccctccgaccatcgtcctcctctgccgacgaccgtcgtcctccacgcgccgccggccttcgagctcgcgccggccgcgcgctctacccctgtcacgcccggaaattcactagtgatttccgaacttatttgtgcataaaatcctcgtccagaaatcagccgaggtacacaaactgacaatttaatatacaaatccatcataataataacgttacatacttacaaaagaaaagaaaacagcagcggaataacggtctagcgatggcttcagctccactcccacagacagctcaactggggtataagccaaacgtcttctctttctggatcctttttctgcaactgaggttgattgattattgcaagaatgagcatatgacatacttaacaagccacacagcaaatatgcaagtgcacaaggataccaaaggatggcataatatagtctcatttgcgaaagcagcatttagtaaagatttaagagtagtgaaacagtagagtaattaatcaaaaattttaatcaacactgaacagcacacccatgctgctcaggctcaaccatcctgaacaaccatacccggctgtacagatctaagctaaacaaattattaccagttattgcatcaataattatttgtgagaggtgtgagactaattacgaaaaacattgctcaacccgcccatgaccgcgggcacggctattcgaatagttttactctggccagagatgtaccgctgtacccacaagacacgattccacacatgttgccatgccccgaagtaccaccacagcactgcaaagggggaaatcgtgacaataccctttgcacaatacaactcaccacagtgcaccattcctggatcataatcaccccctctataaatataactagaggcatggactccccagcgatccccacggacttctcgccgcttctcagtctggcaccccataatgaaccatgttatataaaaggtaaagccgttgcccacgctggcttgtggttagcacggttaatgtttcacaacagtagctcgtgaaccggtccttaattatcatgagcacgaccttcaaaaccatgtgctcacaacccaccttaatccagttttaattatctaatattaacataacacgattaaccatcgtgagctaccattaaatataaccataattaataatataatatgattcatcccattatatagcatttagctgaaccaaaccaatatataaggttctagctaatcaaattataacccataggaaaataaagttatcttcggccattaattaattgggaaagactcaccacccgatgacattcgaaaataatgcataagttgaaataaaacattagttttaaacgggttcaacatgctcaaagggttgtttgggatctgtgtgacttgccttgagcttccgcaaaggcttccgaaccttcctcaacgaaaacgctctcctccggaacgtcggaaactaaagcaaatgaacgaaatcaacaaaacagcacaaaaacaagcataaacagtacatgtggatatttttaacaggtagatctcgattttagatgaatttagcaacttgaaccactcgaatccgagttacgatgatttagttatgaatttccgaagttaatcgatttgcatctaataaagaaaactaaaaaaagggaatatgacgtcatcgctgacatcatcgccggccatggcactgctccacacgaccaccggcaatagagagctcggccgggctaacggaggacgtctacgcgtagaggacgacgacgcgaactcaccggtgcaagaaactacgacggacgacgatgaacggcggccggcggcgaggtcctaaggcggcgcggctcgggtcaacgtcgacggcggcgctccggcggtcttcggcggctgcgaaggggcggccgggatgctcctcctccgttcgcacccaacggcggcgaaaagaggcgtcggcgacggcgctggcggcggcgcgacgcggctgcacgacggtcggcggcggcggcgactaagacgatgcggcggcggcgctacgagcgacgagggaactcgggagttggggcaaacgaaagaggacgccaaggggatgctatttataggcttggattgaagagatcggactccaaccgcgagaaatcaagccgggaaaaactagggttagtttggagagataaactcaaaacgaattcgatgtggtttatccgggcaaaattgatctccgaaatcttaggggaaaggaagaggataaggaggagatgattttccctcaagcaatcggactcaagggcgaccgattgaggcggatttggcggagagaggcggcggctcgggcttggcagccggccggctggaggaagaagaaggtactgtagcgaggggatgtaaaacagacttctcctgggcttccttttttcttgcttgggccggctgagagagagggacatcaaacagacttgcgcagagaagaggggaggcgctggatcgggctaagggagagagaggtgggccaaattaa

SEQ ID NO: 38278 - DNA, 470 bp, Oryza sativa
  unsure (1)..(470): unsure at all n locations
nnnnnnnnnnnnnnnnnnnnnnnnnnnnnnnnnnnnnnnnnnnnnnnnnnnnnnnnnnnnnnnnntcgacaggagcgacgcgaggctcgcgccgggcggcggcaggttggtgttcgccgcgctctggctcgtcgtgcgcgcgtcacgccgccccatcggcaccgtccagttcgggcccccgagctgcacgcgccccgccattaatgccagcattacatgggtgcagaaaaacacgaggcagatactgaccaggttgacggcgtcgcgcgcggcgagcgtgatgatgtcggcgcaggagacggtggccttgcaggaggcctcgagctgcgccttgatggcgtcgatgacctcgtacccgcgcaccgagttggcgttcggcccggcgttcttctccccggtgaagttcgccgtgtcgtcgagcaagatggaggcgtcgcacccctgcacacacgcacgcggccattaaactc

SEQ ID NO: 38279 - DNA, 891 bp, Oryza sativa
cactactatcagcatttgcttcttcctttgcacatatttgtgcatcagctgtaactgaaaacagcaacaagatgagaacttcagaagtatgcttaacttgacatatctgattttacatgattaggtatgcatttgaattaacatgcaagaaaatataacaaagaaaagaaacatgaatgtttgtatgcaataccagcaacacttggtaaaactgtaggattagtggtagctggagtcttgggtttagctgatgcacgtccccacatcgtagcaagtgatccaccattactgggcagcgccttcccattctgagccttgtttttgtttccctgcagagcaattgatggttctttgacaacaggagcattggtggctttatccaagaccgaggaaatatccttctcagccttattacttgttcctttctttggactggatgatccaggtagaccttgctgttgacccttagcagattgttcttttggagcactactagttttcaacggtgcagctgcagcaacactatttataggctttggcggaaatgaactcacaagcttcccattagcagttcgcttgacaaaagaattcaaaacaccacaaaacctgcagaagagaagatactgaattcataattctgatgagggaaataagtggcaaacattgggatacttgtaaattttttttttttgcaccatatagttcttatttatatttttgctgtttaatataagtatattacatccctccctcccactctgacccattctgtactgctcctatctaattatgtcttctcttgattttgggggctaagcaaggtgactaagaagaacaatacctattatctctcaaacaattttcttcatcaaatggccggttaaaaagctc

SEQ ID NO: 38280 - DNA, 2653 bp, Oryza sativa
  unsure (1)..(2653): unsure at all n locations
aaactatactatgataaacctgaggcaagacattaccttcaagtttatggcctgaagtgagttttacacaataatttgtggggttcttctttaaccatccagacacactgtaaatcactttaagatcagccccatgtttgttgacgaactcctgaagcaacctaaaaagaattagtaactagttagttgtggttaggatgtttcatttatccaatgattaagggaaatatccataaaagggaaacctttacctctttgaatcattggatgatactgagaagttcctgctgagccatttgtatgaaatctgtcaaaaacatacataccaattgttgaaacactgtctgccaggcaaataaatccaacaactccaatggatcaaccactaaacaagtaacaaaaatattaagagaaaggacaggcaactggttcatcctatggccatgtggagctgcagtatcacacttggttaatcattatgtgaataaacacatgatatacagcaatctaattggatactccaccatcacatctatgtcgtgtttcccaagctacacaaactaccagcttcaaaattgttgaatttgacaaagaggctgaggcaaatcttaatcctccaccaaatgattggagtaaatctaagtttgtcatggaaaaatggaaacacttttactccctacatacacatgaataggcaccgagccatcaacaaagaaaagcagacgtgtcaactcagaacagtaaatccaccgcgaactggcacatttgttgcttgtttctttttgcttttctaagcttaccgcaaaatatgaacattgatagccaaaacaaaacccagcaaccctaagtttcacctcaaacgaaacgcaaaccctaactggcaagaacagtaagacaagtcgcacgagaaaccgagaaatcgtctcgccccccccccccccccttcccccaaatatttccttctttcgaatgccttgaaccgagaaacagataaagcttgtttggtaacacgagagaaggggaccagtttatacgaaggaattgatgatgagattaagatgggaatttgatttttaatcccaatatcttgtttagtagaggtgatggaaattgatagggagtttagttggagattaaaacggatggctgagatttgtttagacaaaataaaggagaaattctctcctaattacctgccactacccaagtattgaaaatgagggagttccttccttaattcctcatcccaatcttaccaaaattctcatgtctcccaaccaaaccaaacacttaataacctcatccctctgaactaccaatccctcctaaaaactccctccaaccaaacgggccgtaacgcggtagagcctcgcaagagcaagacaacgcgaaatcagacgatagagtcgtactaatcaggatggggattatttccgctatcactcaccacacggagcggatcggcgaagagggcgtggatctggggaatcaggtcgagcagggccgggtccgcggcggcggccgccatgagggtggtgcttggcgagagctccttctcccgtttccagaagattctagagccctcgcgcctcgctagggtttggggaattggggggaggagaagaattggggaattggggaattggcgggaatcgcttggggggataatgaccaagcggcggttttcccgcctccctcctttttcctctaggcggcagcccgagagaccgggacgcaggggtaggccccacctgctctagatacatccatgtcactgacagtgggacccacgctggagcggtccggttaacccgatgggccacatatggcgcgcacatcacactcaggttctggcctgttccggcccaaaacgcattgccgtcccaacgtaagtcgtatgaccgttccggcccatcatatatcaacattcctattttaggaggaaaaagttgaatttaacttggctttctcagatagacctgattcgtatctctcaacactaaaaccggatatatggatccctctaactattaaaatcatatataatgactccctcgattgattggggagtgattttggctaacgtgacattcatgttgcagtccagtcactaggagaattaaaagtagacatgaaacccacatgtaagtaacaagaaaagcaattgtgaagccaatatgtcagcgcctactcatatcctttcccatctttcttttctctttcttcccccggacccaccccaagctttgaggttgctagccaatgtgccggtggccgacgagcccctcagagcgggcagcgagggtgacggaccagtttagtggaggctggcccagtgcaacgcgaggtggtcaacaagagagcggagtccgcgcaagggtcgatcttgtcccgggcgacatcgtccaccttttcctagtggcggtagaaggggcaacctaggagctccaccgccctcacagtcggatgtccggtccactctccgctcgcaacggtgacagtcgtggtaggggttaggggaccgatccttatggctgtggtaggggctaggtgacggatcacagcggcggttgcgcatgcgggtttgcaacgaggannnnnnnnnnnnnnnnnnnnnnnnnnnnnnnnnnnnnnnnnnnnnnnnnnnnnnnnn

SEQ ID NO: 38281 - DNA, 2367 bp, Oryza sativa
  unsure (1)..(2367): unsure at all n locations
cgaattcgagctcggtacccccgttggtttgtgaatcttccacgggccacatgattgatagtcggagcaaagtcggggagacatcgaaaacacaagccactttggtccttgttgattggtcagttaaccccgtcccacacgataatactccattagtaagcttcctatagccatatccatcaatgtgactcattgccggcctgaacactctgtcaaggaaaacaaacaaggaattagaactcacagatgacagataaagcaatgctgcagattgcagtactttaatcttcaaaatacaagcatgaaaatctagctgcaccctattgtctgtaccaggcatggccatggctcctgtaagcttcctcctcatcttcttcctcaccaccgctggtctcaccctccaaacctgctgtttcgacagcccaggacactccgcgaacctgtccaccatctggacctgcacttccccaacaaccgatgttctcgtcgctaaccctctactcagccggcccgtaccagacaatcacaaccttcattttgctgcaggcttctacaattaccccctggttaacacctacatctttggagtctacactgttactgacgccggtgaatttgcagacatgacctcttggcgcccagaacccgtggcagatgtatggtcggccaacagggaccagttgatccggcagaactccaccctaagcttcacggctgaggggaacctggttcttcagcatccggatggcagccttgtctggtctaccaacacttccggccagtctgttgcaggaatgaccctcacagagtccggcaacctggtgctgtataatcacaacaacttaccggtctggcagtcattcgaccacccaacggattccttgctccctggacagagattggtgcaaggaatgagattgaagcctaacgcattggcagtaaatctgattgccagcgacctgtattatttaactgttcattcgaatgggctctatgcatttgcaggatctagcaactcccagccctactatgagttcacagtgtcaactggaaacaagtcacagaatcctccagcgtatttaactctggcgaacaggagcttggacatatttgttccatcctcttcatctgcaaatctggaacacttgtcccttcaatcaccggctctgtctctccagtacattagatttgaatctgatgggcaactcacgttgtatgaatggcaagcagaccaaaatggtagatggctatatgtgcaagacgttttcccatttcagtactgtgattacccaactgtctgcggggagtatgggatctgcttgaatggactgtgctcctgtccaactgcaactgaaagtcacattcgatacttcagaccggtcgatgacaggagaccacatcttggctgcacactggagaccccgatcttctgccagtttgtacaagatcaccaactcatatctctacctaatgtttcatacttatactacgatagctccagagtttcagaactaactgatgaggagagctgtgagcaagcatgcttgaccacttgctcttgcaaggctgccttgttttggtatgttgataataaatcagctggagactgtaccttggtatcacaagtcctctcacttaagacaagttatccaggatacgattctttagcattcctgaaggtccagatcacaccttcacctcacctggaaaaacatagattagtacctttggttcctgtgcttgtaggagttgcttctttctttgtcatgctcaccattgtcttggtagttgtccaaatacgggcgtcagcaagacaaagatggcgaagacgagtttgctgagctacctggcatgccaacaaggtttagttttcagatgttaaaacttgcaaccaaggatttcagcaacaaactaggtgaaggaggatttggttcagttttcagtggacagttaggtgaggagaagattgcagtgaagtgtttggatcaagcaagtcaaggaaaaagggaattctttgcagaagtcgagacaattggaagaattcatcacatcaatttggtcaggttgattggcttctgtctagagaaatcacacaggctcctagtgtatgagtttatgcccaagggatcactagaccaatggatctactacaaagacagcaatgatactcttgactggcgcacacggcgcaatatcatcaccgacattgctagggcccttgcttatcttcatgaggagtgcacacataagattgctcatttggatatcaaaccacaaaatatcctcttagatgataacttcaatgccaaannnnnnnnnnnnnnnnnnnnnnnnnnnnnnnnnnnnnnnnnnnnnnnnnnnnnnnnn

SEQ ID NO: 38282 - DNA, 5218 bp, Oryza sativa
ggcgaattcgagctcggtaccctgtaaattatatccactgtgcccccaggttaattgacaaacctcatgttttaagtacgagttataaacgttcacatctcaggctagaaattagcagcaatgtgtagggggagcgcacatggaggaaggagaacaagatattagagattaattatccttgctgatctttattcatacgcacagcaatacttaaattgaccgactaattaacaagtcctacaacttatttctactgcagttaaatcaactattgtaatcctaagccaactaacttgcgaccaatgtggtggcctgcactggctatgtataggtgtgctcaactcaactgcatattcgtgaaaagataggatggctaatatgtcatataatcataggttttcttcctcacagtaaagagaacgaggcacagatgacttcttcaacattacctcttccagaatttcggtatagtatttcactaatcttgtgctaaacattttaatttcttgctgttacttagatcaaaacattcttgaaatagatgttccctatttttcgccattccaagagatattttgatctgatatctactccctccattccacattataagacgttttggcctctacatccttcgtctagattcactaacatctttattaatttggatgcatatataaagcacaaacatagatctatgcatgcatatgttcataacccaaaacgtcttagaatgtgaaacagaggaaatatgtactaattgtataattcattagatggatcataccatcatgatctaaatccaatctgtgttcaatgtcatgtgccacctttaattccaaaatttgaatataaaaattagaaaagtgtagctgaggcatatttttattttactttatttaaactgctgtaactctaaatattaccaacatattgtgattaatattttaatgtttataataatagcccatgctatgcaggggttaaagactagttcttaacatcagatgtggaaacatatttattctagtctacatcgatatctgttactcaatttaatgttttgaaaacaatctgtattttatctgttccactagttctgtttcttgactaagaatattcaaagtcaatgctgagataaaccaacatgtgatatggacaaggaactgaaatgtacctggctctcattgctttcctctgtcctctttaaagacgttgcctttagaccaatacttctatcatacggtcacacgactgtcgacagcaatacacctgggttagtgcaatggtcatctgaccttagatagttgtacaattttgaaagaagaaaaacacaagtccttataaaaaaaagaatcagcagcatccagagaattgcagtcctcttcttagttcttatacgctaattggggggttaaggaaaaaaaggagtgggatttgcgtgcacatggttgttgctgtgtacgagaatggctcttccaggccgcctcctcctcctctttctcactgccgcacatgcagccctgcaaacatgcggtggtgaccaaacccctggccccgttgcaaatgtatccagggtctggagcagcaatacctctagagacgtgctcctctgctctgtcccaggcaatggcaacgagaaactgtccttcgctgccggcttctactgctcctccccttgcgacgccatcctcttcgccgtctacatcacctcaggctccggcgatatccctgtggtcgtgtggtctgccaaccgtgaccttgcggcacaccagaacgccaccctgagcttcaccgccagtggtgatttggttcttgcaaatgcagatggcagcgttgtctggtccaccggcacctcagggcagtttgtcattggaatgaccatcaccaactctggcaacctggtgctatttaatgatgcctacatgccggtgtggcagtcgttcgaaaatccaacagattctttgctccctgggcagatgctaccggagggaatgatgttaaggcccaacagctctgccaccaactggactacaagcagccagttatatttcactgttcggtctgatgggctctatgcgtttgccggatctgaccaacctcaaccatactatcggtttgagttttattcgtcatatctggttaaaaatgaaagcatcacacagtatcagtacaaaccaacctttgtgactctggtgaatgggagcctatcaatccctggatctgatccactggagaccaaattgccacctgcacactcacttcagtacttgaggtttgagtcagatgggcatctcaggctatatgaatgggaagagttcaaacaacgctgggtgatagcaaaggacatctttgagttaaactactgtcaatacccaactgtttgtggggagtacggcatctgcttaagtgagggctgctccactgagggcatggactgctcgactacggagtgctcctgtcccaataccacatacttcaagccaattgacaacatgagacctactcttggttgtgcggtggaaactgagatttcctgccaagctatgcaagatcaccaactcgtagcaattcctaatgttacatacttccatctctggggcgatagccgtggtgcaccaatgaccgatgaagagagttgcaagaaagactgcttgagcaactgctcctgtaaagctgccttgtttagtttgtatctcaaccaaactcaggctttgctctatccggatctatctctttctatgtcatatctgaatacgtgttacttgctaccagaagtcctttcactgcaagcatatcttgatccaggctactactcaaaagatccggtaaacgctaggtcaacattgtacgtcaaggtgcagagtacacccctgccccctccatcaaaaaaaaaaaacacttttggttatgcaatgggagcaaccgccgctgcactagtgacactcaccattatctcaatggtcatcaggaagaggtgtaatcgacaaagagctgatgaaagcgattttgcagacctgcctggaacaataacgaggttcccttcaagatgctgaaagcagcaaccaatgatttcagtagcaagcttggggaaggaggatttggttcagtttttctaggaaaattaggcaatgagatggttgcagtaaaactgctggatcgagcaggtcaaggaaagaaggacttcttagcagaagttcagacaattggcaacattcatcacatcaatctggtaaagctgataggtttttgtgtggagagatcacacaggctcctggtttatgagtatatgcctagaggatcactagacaagtggatttattacttgcatagcaatgctccactagattggggcacgcggaagaggataatcaccaatgtcgccaggggtctgtcttatcttcatgacgagtgtaggcagagaattgttcatttggacattaaaccacataacattctcttagatgacagcttcaatgcgaaagttgctgactttggtctatcaaagctgatcgagagggatataagcaaagttgtgacaagaatgaaagggacacctggatacatggcacctgaatggctgacttcacaaatcacagagaaggttgatgtatatagctttggtgttgtggtcatggaaatcatcagtggaagaaagaacattgactactctcagtcagaggagaatgttcagctcattactttactgcaagagaaggcaaagaaaggccagcttgaagatctggttgacaagaatagtgatgaaatgcacttacacaaggaggaagtgattgaggtgatgaagcttgccatgtggtgtttgcagagcgatagcagtagaagaccatccatgtccgtggtggtgaagaccatggaaggagaaagggcggtagatgacaatttgggttataacttctttgatttgagccctgcaatatctgttccagttgagcagctcaacagttcattgcaccctgaagcatcaattttatctgcccctaggtgaaatcataggtaaaaaaaggtccagtgttcaacagtagtgttgtttctaattatcctatgatgaagtttgatttagttcgtgattgtcatgtatgtttcagcaatgtagctttaaaatgtctttgtctaagttaaaatctgaaataacatgcatatatgcattatatatactgagattttaaaatggcccttgaaaaacagcgatgtactgaacatatggccactcagttttaataaattgtacatggggcttaaggccctgatattattatggttattatagttattgttgttattactgttattgttgttattcttgttattaaatatttgattagtttgagtatttcattgcatcagacaatcaggttgatgccacatatagccaacagtgctgatttatgagctaatttgttttttatctgttgccattcagggtgtgaggaatattttgaaatatgtcttcacagatgatatttgtttgagatttttcccctgttagtattcagggtagttggcaaatatcatgtcaacagatgattattgccctcccttctgacacaagatcattctcttcctctatactccctccattccataatataaggcacgaccacttttttttagagacttagatgttccataatataaggcatgcatgcaagtatgcaattaattataacatcttctctattaaattattactttttaaaattcttcactctcatgttatctaatcctattggacgcatgcattatatttattaggatgatccaaagttccaaactacaagatgataataattatttcttggtctttgggttaagggtggttgtgccttatattttggaatggagggagtatatgttatatatttgagtgatgagtgcatgcagacattatttatgtttgtacagtacattttgcatgctacctgtgtcattagtatcatcaggagagaagtacctcagaacccatatgacgccttggggagattgtaatggcttcactggtgctcagatcatctcatggagatgtccacgaggagaagctcgtaggaggcgttgaatccctatccgtaaggctggctccatgaagatattcccaactagaaggggggaaatttcagaatagattagaaccacgaagagcaagagaatttcaagggaggttggatacctcactaatgtctcctcgagagatcggcaagct

SEQ ID NO: 38283 - DNA, 2162 bp, Oryza sativa
  unsure (1)..(2162): unsure at all n locations
nnnnnnnnnnnnnnnnnnnnnnnnnnnnnnnnnnnnnnnnnnnnnnnnnnnnnnnnnagttcttaatgttcgtatggtgtaaattgggaaattgtaccataataagcctaaggcaacacattatcttcaagtttatggcctgaagtgagttttacacctgtggaattgtttttttaatcatccagatacactgtaaatcactttaagatcagccccatgtttgttaagtgttaacgaactcctgaagcaacctgaaaagaattagtgactagttaggtgtggtcatgtaacactacgccaccgcgaaactcgccgccgacgagagagagagatatttagacgagatcggagttggggacgaagagaaacagagctgaggcagaggagagacagagtttggagagagatagattcgatttcttttgccaggttggccacagccattctctctctcgagtatttatctcctgattacatgggccgttggcccaaacgatttaaggcacgcaggccgcattctatttgataaagtctagcccaaaacacacacactatcattcacagttaaacctctttctcagtgtcaccattgccggtcatgacagtgccgcccgcaggagtttcagcttgtccccaagctggagcatctggaaagcgagtcttcacaacatgataatcctcccaagtagcatgatctgctggtaatgaagaccatttcagcaacacctggacatgagctgcattgcagcgcttcactagtcgacgctccaaaatcgcctcaggaacaatgtcagcagcattaagaacccctggggatggcaaagaagtataaacaggagtatgatctggcacctgagctatgagttgagaaacatgaaacactggatgcacagtgttgctggcaggtagatccaaacgataagccgccactccaatgcgctccaaaacagtaaaagggccaaagaacttataagccaacttaggatatggtctattaactactgaggactgagcataaggctgtaacttcaagaaaacagcatcacccatagcaaaaacacggtcagaacgacctttatcagccttgttcttcatacgcagctgggctcgagttaactgctgctgtaaaaattcagacaagtgctgcctttcagtctgaacatccaccacatcaggcagagtagccaatgtcagatcaggaacttgagaataatgaggatccaccccaaaaagagccttatgaggagaacagcaaagagatgtatgataatttgtattgtaccaaaattctgccaaatgaatccaatggctccacttcttagagttagcctgagtcatgcatcgtaaatacatttccaaacactgattgacacgctctgtttggccatctgtttacgggtgatatgctgtgctcatctgtaattgagtgtcccaagtagcaaaaagagttgtccaaaacttgctagtaaagagacgatcacgatcagacacaatagaacgagggatgccatgagttttaaatacagttttgtccaccagatgagccacttgtgatgcagtgaatggatgacgcaaaggaatgaaattcgcatacttagtaaaacaatccaccaccaccaaaattgcattataaccatcagagcgcggtaagccttcaataaaatccatggagatgtcctgccaggcctcttttggaattgggagaggagctaatagtccaggaagccgacagtgttcatgtttgtcctgttggcaaacctgacattgcttcacaaaattttcaacatccaacttgagaccaggccaagcaaataatttcttaattcgatgataagtagcagcaatcccagaatggccaccaagtgcagaagcatgaaaagcttgaatcaacttagtatgcagtcctgcattggatccaatccaaatcttattctggaatctaataatcccttgtgtcaatgaatacccttgagaattaggagaatgcacagccaactcagctagtagctgctgagcttgaggatccactgtataagaattgatcacctcctgaatccagatcggttggaccacagaaagagcacaaaattgagaggaggaaggcattctagataaagcatcagcaacaatattatcaacccctctcttgtattgaaaagaat

SEQ ID NO: 38284 - DNA, 2048 bp, Oryza sativa
aacaggacccaaagttttgctataataagcaatagggtgaccctgctgacttaaaacaacaccaagaccataagcacatgcatcagtctccaaagtaaaaggaagctgaaaattgggcaaagctaacactggagtgttactcatagttgtcttcaactgatcaaaagcaagctgagcagcatcagtccaaagaaaggcattcttcttcaacaagagtgtcaatggtcgtgttatgatactataaccctgaacaaattttctgtaatagcctgtcagtcccaaaaatcccctcaattcagtaacagaagtaggcacaggccaagccagcattgctgctgtcttctcaggatcagtactaactcctttgtcagaaatgatatgtcctaagtattctagttgagtgcaagcaaaagagcatttagacctcttaagcaaacaactggtgctgcctcaaaataacaaaaacttgctaaagatgatgcaaatgactatcaaggtcagggctataaactaagatatcatccataaacaccaacacaaacttcctgataaatggtgcaaagactgagttcataaggcactgaaaggtggagggtgcattcgtgagaccaaatggcataaccctaaactgaaattgcccatgatgtgtcttaaaggctgtcttggcttcatcagtttccaccattcgaatttgatgatacccagctttcaagtccagtttagagaagaatttagtgcctgagagctcatccaataattcatcaacaaccagcataggaaacttacttttaatggtgagagcatttaatcttctgtaatccacacaaaaacgccaacaaccatcctttttcttgacaagtaaaacaggtgatgcatagggactcatactaggtgtaattaaaccagcatcaatcatttcgttcacctgtttctcaatctcgtctttttgtaatggataatagcgataaggtctgcagttgacaggaatagcatcaggtactagagaaatagcatgatcaaaaaccctgtgtgggggaagacacttaggatcgtgaaagacatcgtcaaagtcagttaacaattgttgcactgaagaaggaatcacatgctggacatcatcctgggaatgttccaacaaagcagcagtccatatttcacaacccttatgccatttcaaaagttgtggcagagtgacagcagcaatttcagaagggactgcagcatcttgtactccttgaagagaaatccaagacccttgatactgaaacttgagtgttttattagcccaatgacaagacatttccccccattgctcaagccagtccctacctaagatggcatcgtgaccccccaaagtgaccaccctcatgtcataagtaaatgtgtgcccctgaatccaccaagaaaaaccaggaaccacatactgacaaggtaagcaatcaccattagcaactttcaccagagtagaaggaattggttttagaggtaaacccagcatctgtgcaaagttgtaatcaataaagctgtgagagctgccagaatccaccaaaagtaacaagactttactgtgaaccaatgctctcaaatgaatagcagtaggaaggtgagctcctgtcaatgcattcagagaaatatgacagtcctcctcatcatcagattgttctgcagcaataacaacatccaatatgtcatcagtgagcacctcttccaactgcatagctttgatttggccctcaacagcacaacgatgttcaaggagatatttgtcaccacacttaaaacaaagaccctgagcacggcgatagcctatcaacttgctaagccttccatagatcctctttatctactcgacctggagcagtatcagaactgatatcactcttgtactgaggaagtttcacaaatttccctttgagagctttggtagctctactagccaagacagattcctgcataagagcaatagcagatgcttgctgtacagtgtcaggcaattgaacaacaacagcagctcgaatttcttcagtaagaccattcataaaacgagt

SEQ ID NO: 38285 - DNA, 1446 bp, Oryza sativa
cgggcgccgtggcgaatcaggaagaatccaacgcacggggacgcccacaacctggttctgataccactgtaacactatgccaccgcgaaactcgccgccgacgagagagagagatttagacgagatcggagttggggacgaagagaaacagagctgaggcagaggagagatagagtttggagagagatagattcgatttcttttgccaggttggccacagccattctctctcttgagtatttatctcctgattacatgggccattggcccaaacgatttaaggcacgcaggccgcattatatttgataaagtctagcccaaaacacacacactatcattcacagtaaacctctttctcagtgtcaccattgccggtcatgacaggtcaggatgtttcatccaatgatcaaaggaaatatccataaaaagggaacctttacctcttggaatcattggatgatacagagaagttcttgctgagccatttatatgaaatctgtcaaaaacacacatatcgattgttgaaacagtctgccaaggtaaacaaatccaacaactcaaacaatttcaatgaatcaaccactaaacaagtaacaagaatattacgagaaaggacaggcaagtggttcatcctatggtcatgtggagctgcagtatcacactcgtttaatcattatgtaaataaactcatgacatacaacaatctgattggaaactccaccatcccaagctgaacaaacttggccagttcctgttgaatttgacaaccaaaggctgatgcaatgttaatcctcccacaaaagattggaataaatctaagtttgtcatggaaaactggaaacattgttactccatatacatgatatcatgaatgggcaccgaaccatcaccaaagatatcaaatcccccatgaactggcacatttgtttcctgtttctttttttgtttttctaagcttaacgcaatatgaacattaatgtccaaaacaaaacttatcaaccctaaggtacacctcgaacaaaacacaaccctaacccatgcgcgccccaagtaccaaaatgagccggcaagaacaagaattcgaagcgcacgagaaaccaagaaatcatctcgaccccaaccttaatccctaatgcggtagagcctcgcattccgttgtgactcaccacttagagcggatcagcgaagagggagtggatttgggggatcaggtcgagcagcgcctagtccgcggtggccgccatggggggtggtgcttggcgcgagctcctgctcccgttttcagaaggttccagatccctcgcaccttgctagggtttggggcaattgggggaggaggcaaggaatttgggcgcgggaatcgcgcggttggagggccaatgaccagcaccaattttcccgcctccctactcctaccctagcactagtaatatgccctgctaaacg

SEQ ID NO: 38286 - DNA, 3358 bp, Oryza sativa
gactttgaggtattaaacctctcagctcttgcttggtcctcaaacatgttacgtagtcccgtgattattggatgagcatccaatgcctcatattgcctttgaagctcatgggacatagtagcaagcatgagacagcttatatcaaggtattccttgcatcgcctttcatgctccctacgttgagcagcaggagcattgttgggcaagtcagctggaaaaggctgtgtaagcacaaactctttgtgctcttgcctgagaacaattctcaggttgcgataccaatccatgatgtttgttctagtcaacttctctttctcaagaatataccgcaagttaaaattggatggtgcaggaactgctatgatgtacaatagaaatatatgtatgcaaaatcagcaccatgtttacatttaacctttcattaaacaatttaacaaaagatactcccactatgtattgtgaaacaaaattccctctagtaacatagtgagtcaagatcctcattttattagtgtctattgagctttggcatcacagctagacaactatcaaaataggtaagcaacaccttgctaatcacatcatatgtgactcttgtgctgttggggtgacatctccatatccaacccaacctatgccccaaggttcaaaactgttttgataaccttgtcaagtaaaccaataatctccgcatatagatgtccgacatctatcctattttatcatgataaaaagtgacactttgctatggcaaacccatcacttatgatcacaaccgtaataagtgcaattattagaagagcataaattatacttaattttttttgagggaatatatcctaccatgtcatatcaaatatataacaacaataaagtaagatagatataaaaaccccaagcgaaatctaaggggcaacgcacacggcgccctgaaaaggtcacggggtacatagatctcatctacgattcgccatgtgaaaaccttaacggcgtaaacaaattatgccgaaaccgagtcaatctcattggctcgtttttctcattggcgtgcggttccagtggacatcggactatccgatgaacacaatcgcgctcgtccttggtgagtactagacattccagtaaagtcaccaacacacataccgattgatctcatcaacccatgcggctatcggttcatctcatgttccgatcacctaagaactcatatacaacataatagatctcatctactacatccgcatatcaattatatgcaatgatctagatcatcaactatacaaggcggctctgataccactgttggaatacgcgtaggctacgatagcataaatcaaaattttctacctcgtaaaccaggaaccatgcaagtattagatcatagatcgttatcactcgacgcgctgtcaagcggaagaagacgctgagaagtcgaaggaactctcgcgaagtagcgcgcgtcgatgtagaggaaatagtcgatcgcaccggctcgaccttctcctcctcgtgcgttctgctcgccgtactcccacgccgatcagcactgcaaaccagcggcacctctaccggtatccacacgtacagggatggaacgccacgcgcagatgtgctagcacccgcgcgcggctagggttttgctcggggagggaagtgacggctagggtttctcacgtgatacaatgcctccgccagtcacacccctcacgaatatataggatccatcactcgggcctccaaggcccgtaggactcctattcggatccctatccgaattaagctcatattgcatttatatccaatccccttattccggcccattaagcgtgcgaccctgtaggttcatatatactcggctataacccgaaaactccttttcggtcgacgcgtcaacagcggcccctagcagaacgtattgactcaccgggcatacataaaaatcatatcggctgaacctctagtgtatacttgtatgaacccctttgcctcacgatattgattaagctcaaggctagatatgtgccattctctaatagctcaatcattcacttgaacctattgatagattatataacttatgattgactcctcaatcacctttggcatggccatgcactaccataaactacaacatcaaggggcccagagatatctcttcataggaggggcaaatcccatcttgattattcatatcccaatacatgtttcatagcatacccgaaaactacttttataactacccaattacggagtagcgtttagtagtccctaagtaagctactacacatgttgagaaccatgataatgtcaggtctaaggattcaacaccaacactcaatgagatcactgatgacacaacacatatggctcttgcagtgtctcatgttgggtatatccaacaacatgttcactaacatgtgtccacattattaatttgatatctctatagcataatccaagagacatgatcatcaattaatacatgtgttgatcatataaacatatttgttccacatatgatatttgatcagggatcctttagaaatagtaacaaacaacataaagagtctcatgaaagaatcacatattcattaaccaataaggagttatctatttcaaggaacaatgtcggataaatatgtaaacatagtatgtgatacaatcatctctatgattacctctagggcatatcattaacaataccacagggtgaggcggcagccatgggacactcatagcagctatattccttattttcacctactcaagcagcaccagcaaaaaaaatcctcacctcggccagccgcagcacctccacacaccagcaagcaacaacaccggccagctgcaacaccacacaccaacaagcttttcaagcagcaaggaaaaatcaacagcaagcagccgcgccttttctacaccttcttctccccacacgccatcgctgccttgcttcctcactagagcagttgcctccaccgtcaacacacttgcttcctcgccgggatctccacccctttacctcgtgctgagccgccacgcgcttgccccgagcaccgcctcggcagccggggccttctccgccgtgggctcctcctccgcgggcttcttcgccgccgggctcggatcaaccctagcaccgtcttccgtagtgtctccatcaatgccctcgtccgcatgggcgccgctgccgtaggccaccgccggctagggttcagccctcgctagctctgatagtcgcctacgatagagctcgtcggggcggccagcgggagaggaggcagcgcgcgccggccgacgagagggagggagagaagcggtggtgcgcgggcggaggcggccggcatgagggcgggag

SEQ ID NO: 38287 - DNA, 10551 bp, Oryza sativa
  unsure (1)..(10551): unsure at all n locations
ttagttgtcaaaatttggaaggcaaaatgtggttttttgagccaagtaaaattcttggagttgaactatcctatcagatcacaattgcgtgattaaaatggaagtccttttacttgatattgatcaataggttttaagatgaatctttgatggccggcttagtcacctgttgctttctccattttctatattttatttttaatgtaaagctttatacaatataagatagtttctcgcaagcactcttggttggtgcataagcctaatgtttttgtcatatatggaatggattggtcttatctattatatctttaataacaaattttaagatataagctttttgtgacttctggtatttttgtaatcaccaccgcattgttcaatacaagacagcctactattcattttattgccatatcttgatttattaatccttgtttttgtactaccaagtgcaattggtactgtatgctgttttacccccaggttgcttcgtacattgctgtagtatgtgaaggtgtggaaaatgagcttcttggaaaccaaatttcattaatagacctcacttaggatcagggaagaggagctgtcaagtgcctagattatttttcttacaagatatatactgtagtaatcacataaaactgttgatggtcttaaattccattgtggatgactgattgcctgaagtattcaagtttcataggtacaactaatattcaagttttatctgtgctaatcccactgtcgatatcgttcaaccgccgttgtctgcactctgcactctgcagcactgtgactgccgtcgtttgcaggtctccagcacaagaattactatgctgttaacatgtacagactgtaaaattatgttaatttgagtttcataaaccttttcttttggtatcaggcaacagttgaagatgccactaatctgtatggatggcccccttgcattgacactctactatgtgtctgtaattttgcttctgttgcttatgaccccaacagaatttgatgattcagatttgatgtacaccaataaagaatgtaagcaaatataagagaagagaaacgatgatgttcttagtgacagattaaaggcgggcttgatcctcttgatagtgagagctacttccttgtttttccttatttatggtgagcatacttttcaaactagtattaaacagtatgtttatttagaaaacttcctatatcgaagtttctcttaaaaatcaaagtttatgatagttaatacttaattatatgcattaatcactaatcatgttttacgtgtagctcataagcttgacccatccatccattcgaacggagcttaactatacttttcaaactattgtttagaaaacttcctatatcgaaatttctattgaaaatcaaataaatttgtcttgtttatgatagttaatacataatcaattatacattaatcatttgtcttgttttacatgtactctttccattcgtaatataagagattttaggtggatgtgacatatctaataccacaaatctggacagttttcttaacaagattcaagattcgtagtactaggatgtgtcacatccatccaaaatcccttacggcctgtttggtaagagcagggaaggggaatttatatttttgggatggagggagtagctgataagctagacccatccatcaattcgaacgcagcctaaccaggcaaaaggattttagagtgttcctattggatgatttccatcacctgaaaataacatattatttcagatccattttttgaattgtttgcattcggataatttgatatattatttcagttaaaacacttctaaacaattccagcgagaaaatataatcttatgaatcgtgcaccaatgaatcaccaggaaaattattggaattacaaaattgcgccgtagcgtaagcacggacatattacaactagttttgattaggaaaagacaaattaaaaatcaggtgaaagctactcccagtgacggatttacctccagggcaggccggacgactgctctggcttcaccgccttcatgtcgccgagccgcttagcattagcgattaacaccgccgattcagcaattcccgggcggatcgtgggtgcaaggcagcaacgcaagctcgtgcaggcgtgcagctgtcaggttgtccttgcaggcagcagctcaaaagcatgcatgcttatggctgacctaattaccttgcttaatcacacctatctatcaatctattatatactaaaaatccattaaacttcctacaaacgctcttagatcaccatgtggcactctataaaccctcctaagttgccacgtagcaaagaaacatctaacccttgattttcatttaaattggtggacctattcttttcaaccattagattagatgtaaaaaataataattcccccatcctaatccacctaggtccactctattcctgcggatgtaagctcctacatcaccacgtggtaccctataaaccctcctaagctgccacatggcaaagaaatatctaacccttgattttcatttaaattggtgaacctattcttttcaaccattaaattagatgtaaaaaaaaataatccacacatcctaatccacctgtgcccactctattcctacggatgtaagtacacgtacgtactccgtatgctcctattcccattattctcttttcattctgttatctttttctctcctattttccttctttcaatagaaagcaaaatttatgtaaaaacatttaggcaactatagtatttaaatcataaaagtaactaaataatacatatatgttttgatcacagtagttaaaaaaggcacatagatattggtgttatgggtgcggaaagtgataaaaccagcacctatagaccatttcccacctctacaggatgaaaacacaagaaaaccggtacggcacctttaatagactataagtgttgattaattaacaaaccgataccttcaatctattatatactaaatatatttatttgtcagtgttatggataccacatacctaatagtagttgactaaatctcggcaggacccaccacataccatgtcttatacggaaacaacctttggatataggagaagttccggataaggaaaaacaactagagttctatatggaaatgataaggactactcggattgtatttatattggtttccctagttctacttggacaagtggacacctatgggtataaatacaaggccccctaggaggagaggggacacagaacaatagatcaagacacaagatcaacatacaagccaacatgagtcaagacaagacgccggatatcgacttcagatataagcatggctagtcccctacggtgtctacggatactgtcaggagagacatagcgctgtctttgatctcgccagatgcggattcaaggaggaaggctaccctgttgtcgactacgagtcagcacttcagaccgccaaatcgacaacagttagataggctaccccaaatattgtactggtgtgattatggtgaataagagcaacgaccggcttcggccaacaggagtagggttattacctgacaattcaggggcccgaacctgtataaaaatctctgtctccatctcttttacctcaatctcgcatataccctgataccaacgatctccataccatcaaaataccatagccgcgatatcaaacgtcgacactattaaacttcctacaaacattcctaatccgctatgtggcactcctacaaaagctatagagccgctatgtgacgctctaataaattatagaaattatgagaaaaacgaaaatatctaacagtcgattttcatttaaaatagtggacccaatcatttaaaacatcatatcaaaataaaatccctcttacgtatgtacgtacgcctatcctcccctcattttctctttcttttttttttgctaattaagttagttattactacgagatatgcaccataacttaatattgtaaatggttatatctttccttgcatggcatggagcatcgagttggctgtgcaacgtgcaagtactaattttttttatggacgatttatacattgattttatgatacgcttcaatgattgtatgttttaattaaattaatcaatgagctaagtcctatattcactctattttctatgttttcgatatagacatagacatccgatggatcatctgcaataatatcatatctaatgggtaaaaaaagataagccgtttgagatatagttacggccttacgggatatgagttcctctgttacggtggccgatcttcacatagtctaaatgattatatataaacaatagatagctaaatgattatatttttaaatatattcagtttttagtttgatccatgtaggcttttcttgatatatgataaatatattttcagacataaatccatatcctttccgtgacaactaaacatcaatgcaacgttatataaaaattgataacatatatcgtatcatcatttatttattagatgtccattacaacacctctatgtcttcacatttcacatctaataaattattttttttaaaaaaacctatttttgagaaaaaatacatatgaccatcggttttatttaaatcgatagaccttccctctccgaaaagtttagggctctcctctcctcttgcccttcctattatttagctaaagtccattaaatttactacaaacacttataacttgtcacatgacgctctaataaattagaaatcaaagaaattatgagaaaaaacaaaacaactaaccctcgattttcacttaataaggttgacccgatattatacaccattagatctatctttagaaaaaaaaatcaaaacccatctccaccgcctccttcctcctgggcctcctctcctcacggtacaaacatccctccctctttccttccttcttttaattttcccgctaacagattaataaaaatcataaagattctaataaatgtttagccattatttttttaaaattgatggagccattaattttaaccgttcgatcttcatctaaaaagaaaatcggatacctgcactctcactgtcacctccatacgtgcacacttatgacttatgtagttacgttctccctccaccctcctaactctccccttctctcctactccctccgtttctaaatatttgacaccgttaactttttagcacatgtttgaccgttcgttttattcaaaaacttttgtgaaatgtgtaaaactatatgtatatatgtaagtatatttaaatgataggaaaataattattaattacttaaattttttgaataatatgaacggtcaaacatatttaaaaaagtcaacgacttcaaatatgtagaaacggagggagtatttcttaagctaactgctattttttagctgacactcaatctatcaaaaattaataatcggatttctaaatgatcataaaaactcaagttacatattttctcaatttttttgaattattgtgttatttataattaaatacataatttgagatccatatacataactcgaacttctaatataaatgtttgagatcaaaattttaagcatcatattaaataaatattatattttgatcctataacgcccctaaataatgcccctaagccgacatgtgaccctcaaaataaattataaaaattcatagaaattatattaaaaaaatcgaaccattgatttttcaatatttttaatcattagatctaatcttaatcttaacctatttaaaaatttcaagatgattccatcctccattgcttgatgatgctatccatgagtcagccgcacatactccgcgtatatgttccgttcacgagagagagagcgcacacgattctgactcaaattgataaaaaaaataccacatccatttgactcggctcgctgaaagaaaaagtcgattgaaaaaatatcttacttttaatttgaaattaaattgttagaccgatttttaacaaactaatacatatgcccgcgcatcgcgtgggctaccttcctagttcatataattacgttaagctcatagtccactcaaccaacatgtagctcaaggaatgaaatgcatattacgtactatgctgtatgcaacgtccggctaaatgaatttctttcctgtaccgcgtgctctgtgctcatgatcaatgcttagatttaaatagcaaattctgaacaatcagcagtgccgctttaagttattcacattttttcaacgtataaacatttatatgcacgtttggactgtttatataaaaacattatatattttgatgtgcaactttagtgataatttagacatatatacttgattttagtcgttttatttaggcttacccacctgcaggtccacggtttatcccaaaaatttctggctctgctactagctactcaaatgacattgttagcgatagaagaaatctcaccatataaaccaagccatggaatggaatgccacgagatcacgtaaggcaagaacaaataatttctactatatgggacaagaattcctgagacctagacacacataatctggaaacgaacgagagtggtcgctagcagacagcccgtgaagtacaatctcgacgagcaatctcgcatgtccggtggtccagcgtcccaccaccgcgggggaggcaaggcaatgcaagcggcagtactccccacgccatcatgcctgtccccccctcccctcccgcgcgcgccgccctgctgcctgagacacactccactcgcggccatcatggccgagagacctcctccccccctagggcgcgcaacaatggcgcataaccgcatcgatggccccgacgcggcacgcgcgcgctcgcagcagccacccgggccctcatactactattgcttcgcgtgtgcttgtgcttgtgcttcgttttcgtcgtaacgcagggactgctgctcattcgctcctcttccgtcttccccccattgactctggccccgcctccgcgcacgggccaatgcaacgctgatgcgtgtgagggaggggtaggcaggcagcggcgtgggccccgcgagtcatcggggatgttggtttggggggtgggtttttttttggggggttggggttggcacgttggaagcggcacgcgcacccacacacagcgcacagcagcatcgagtgcgcacgccacctcattaattcgttcgctcctcgcgccaccatccatccattcattccctccattcctctgcactggactgcactgcggctgcactccatatcctctcctctcctctcctcctctcatctcctgccttccccgcttgcttctctgtatcatcatctgctcaaaaggagtgcagcgacgagaaaaaggagaggaacaccaatccgagcatccaacgcttcctcgtccgctgtatataaaaccgaccccctttgctggctccatccatccatccatctatccgtctcacttcctcccctgttccgttccatcgcccgatctgcttcttctacttctgtctgctcttaattggagtaccaagttatcacctgcagttccctgataattttggtacgccaagtagtactactgcatttgcatcccattcgatcattcatacttcactgtcgttgatggccttccaagctctgataagaggctggtgctgtgtctgtttggcagggaagaggcaaggacaggatgccctgggcagggacgacgtccgttcggctggcggtgttcttccgcgtcatcctgtgatcgatctggtcacgggcaaggcgatcggtcaccggcggtgaggggatccgagccgtgccgcggcggaggacatgtgcgttgggttcaacgggaggagccttgacaccgtcgttatgacaagtggcgccgtcgcatattactacagattgatgcaagtgtgccaggtgagagaccacacctcattctctcctcctccatctctttgtgttgcatttttgttcaaatttgcaggcatttcggttacttgcaaaagcgtgtctttttttctttcttctttatttgagagatcgtcgatcaatgtgctggtggtgggaatcataatcatcataacatttcgtggataagcaacttgctaattggtgctgtccgttagcgtatgtagatagaaaaaaggaagtcacaagatggtgtcgcatcgcatgcggataggtggggcccactgcatgcgggacctaccttgatgtcaaccatggggggctaggtctaagctagttgacaaaagttttttttcttttattaaaagacttgacaaagttttctgcggtcaaagtataggtgtgaactttgaggagcctagtacatattgtgtcttgcaattgcatcttgccgcagcctggggagcatgttcatgtgtttgtttccttctggtactaaacgatcttaattaacatccattaattagtgaatcgatgctcctatatcctcggttttacagtaattagttctatgccgcgtgcaaagaccatcttgaatgaagtgctaagctacgtgaagttgttctatttgccagtttatcacgtaagtttatcgtaatttggcataaccagaatcaattgctcctcagttccttgtgtttttttacctaatttagatataaggtgctgatttttttaaatcaacattttatctactagatcagtcaagctaatcagacgagcactcgattcactattcaatccaattattctatcatagttgttgtatcccttcctgtgtgcatactctgttttgctttcgtccaataaagtgtaaactatagatatacaaaaccatactctttttaattggcgtgttcgtactacagcagtacaacatacaaattgaccgaatagtacgttgcaatttaaccatgaatgcaattcatttttgaaactgagaaccaaatatgaagatctgtaggattttttctctggattgtcaccgctctgtacagcatacatcaacatcttggattacaaattcaacattttttttgtcaacttctattcgacaaattgatggataacagtctttgctcctgttctcgcctttatttctgtttcagtctgaaaagagcaagcactatcttcccatatacaacttgcctagattgctttagaccttttctcatatgctctgttctcgccggcaaacatctttgacgaattacattggcaaatcgcagcttattagtactttctccatcaggttgacacatgaaaaacttttacatgacgactttttacctactgtttgattctctcaatgtgaagtattgccttgtcaatcagagtagtaattcatcttcataatggttgttttctgcaggccgaatacttccgccagctgctcaagcccgtgacgtagattagctcacgcacacattccatccaaacagcctgaaacccccaaacaaactaaccaaatcaattttgaattggaccaaaaaaaaaaagccaagctccagttagcaaaacacctttgaattcatacttgtttagtttcgtttcaatcaaaagcaaaacatttcctgctttcccagacaaacacagccacacaaaaccagcacgaatttgagcagcacccgatgcagggcgacccagggtacgggtacggtggctacggctacggctacggctatggctacggcggcgccggctacgacatggccggctacggcggcggcggtggagggtactacacgagcgatccgtacaatgccgctcctgctgcttatgaagacccgctcgccgtcgctggtcggaggcagcacgacttcccggcgccgctcaccggtgtcgagttccagccgtcggacacctgccccaagaactacgtcatcttcgaccagacctacgaccggagccgggtcatgttccacccttcgctggccaacaacctgggcaactccggcggcggctacgaccaccaccaccactgcggctacggcggcttcgagcaggactacgccagcaagagcgcctactatggcgtcgaggacgacggcggcggcgggtgctcgatccggcagaaggaggacaccgacgagatcgacgcgctgatgagcacggaggacggcgaggaggaggacgacgtcctgagcacgggccgcacgcctgggtgccgggccgggggctcgccggactccacgtgctcgtccggcgcgtccaggtccgactgcggcggcgggcggaagcccgaggccggcggcggcgagaggaagaaggagcggatgaagaagatgatgcggactctcaaggggatcatccccggcggcgaaggatggacacccccgccgtcctcgacgaggccgtccgctacctcaagtcgctcaaggtggaggtcaagaagctcggcgtgcgtggctcaagcaggtagcgcgcgccacaacatccacagtcaaaaattttcctactttcaccctttggcagataagacgagactgactggnnnnnnnnnnnnnnnnnnnnnnnnnnnnnnnnnnnnnnnnnnnnnnnnnnnnnnnn

SEQ ID NO: 38288 - DNA, 5772 bp, Oryza sativa
actattcatacgttgaatttgtcttttttatatctcgacgtgtgagcggagtttggacttaagattttgtgaagttgtatatatgtgttgtatgaatgttgtcaaatttttctagaatttttcataaccgtttagatggtttttgagcaaacgagggaacatcccctcaagggattagaatagtttcccttctatatgtgtcaaactctgttttgacaggtttcgagcaaatgtgatttgcctgaaaacacagacaacttcttgtcctactatagtactcctactaacttttttttcttactactactgtatactactataacaaggaagaaagcctgcactaatgggcgggcatttatttatttttaatgataaagagaacactaaaagaattatctcaacatatacatcttagaaattcaccgtaagagatggtaaattatcttataatgataactaaaatggaagaaaaaaatacttataccgtgaaatagatcatagactttgatatactaaattataagaatgtctctcaaattttaaacaaaaatcacttagtcctgcttagatataaactcacctatcaccactatagattattattgtcttgaaagttgggtcccttgataaatggaattgtattagtaccataaaaagagcctaacacatcagtaatacagtaaaataatcacgaacactttacacataattctctgtcttatgtccaaatctatgtatagatatcttaaaccattcctaccaattaacagggtagtacaattaaaattaaatatgaatgtctccctaacatgtgaagccggctaatactacgtactgagaaccatgtgaaaaaaatattagctcgagtaacaatctctcactaacacaggggttagtgggttccgatttttctttcttgtattacatctgaacttttgttttattattttttcccgtgcaatattacatccctaggtggcatgcatttttttttcagcgaatagctttttagtcggacagatcataagcatacgaacataacaacatttaatctgagaattgagaggggagaattgattttttttttcctggtcttacatacgtaggtattatgtatgtctttttgggagaatggtgtgtcctacgtatgtatgcatttttttggcatttatctagcgaatagtttgcacgtatttttcttgtcgtcgtacatacacgtatggacttcgatctgctaatgacattgacaacgggcacaacactacaatttaattttgtacggtgattatggatggatgcttctcaattggtgtacaaattaatgtatggattgtgcgtcgtgctaaattgttacttatatgtatcagatattcagaaggtagctaggcttgttcatcttgccgagaccaactcgtacaaaacttctcgtgcataaaaaatgttcaaaaagagaagttcacacacacataattgtgtcatacctgcacgtgcagtagattagaagggagggtttttttttcggttgtatacaccctattacgtacacggaagaagattaggagtggtggatttttaaaagatctaatctaatggtctaaaataacataacaggtccaccgatttaaataaaaatagagggtttagatgtttcttgccacgtgacggtctaagagtgtttatagagtgtcatatggcggcttagtagcgtttataggatgtttcatggacttttagtatacaataactaggaaggtagcccacggattcacgcgggcatgtatcttaagatgtgtttgagatacttatatagttataaggatggaatattaacagtagaacaccgtcacgcttcgaaaacaatttctatgtgcattttttttgtcatcattgcctgtaattttttttgtcatcattgcttgtaatttgattaatccccataagaagaaggaaaacttagtttgttttaaaaaatatatctaacaaattaaatgtaaattaaaaatcctaaaaatggaattattagatcccaaattgataaattgttgtttaaatggaattattagaaataattttaaaagcctagaagaaaagatctaattttaagtaataaattccaatataaaagagggctagataaaattttattaaatacttctcttgattctatagttcctagatttttctgggatttatttgagccaagaaagtatttttaataaatggaattgcatttcatgaataatttaaaaggaaaaaggtttaaaaatcctttttttggttttgggcgaaagtcagcccaagtctctctctctctcccccggcctgtgcacgcccggctcaagccggcccagtccgcccctctttccctcctctcccgctgacaggtggggcccacctgtcacggtcgtcttccacctcccgccgccagccacccctagccgcgcgcaagccgccgccgccccttccaaattcggtcgcatctttcccgatccgatcaaattgatagaggggaaatgatcccttcgatctcctctatcttttcccctatagaaactttagctaatttcgtttggaaatcatcggattcgagttcgattcggatttgatttcttccctgcaaccctaaaccttgcatcgccgccgttagtcgccgtgggcctagccgccgcctcctagcccctacaaaaggatccccaggacgtcctctattcgccgccaccttcgccctagcccgccgtcgcttgtagcaccgcctccgcgtcagcccgtgcgccgccgtcgccgccgcaactccagccgtgcgccaccgccgctctggtcgtcgtcgtcgctcgggatggtcgcagtcgggttcgccaagttgttgccgtcctcgtcccgtcctccgtttccgccgaagatcgccggagcaccgctgtcgccgtcgacccgaacgtctccgccgcctcgacctcgccgacgtcactgtcggttgtcgtccatcgtcgtcagagccctcggtgagttcgccgcgtcgccctctacccgtaggtgctgtccgtttgcaccgccgcgccgtcattcgccggcgagcacgaggtgccgagccgccatcggcaatgacgtcatcgtcgacgtcagcgccacatcagccgtagacccgtggtagatcggttagatctcggcctttcgttttgtttagattagatctcagccgttcgttccgagactgcttctgtgcactcggtccaccgtgaacccgagccccgctgacgcaataaatcctttttccttttcaaaaataattctttattgcgtcataatccaatgaaaatctatataaatgatttaatccgatttaatctttaaaaattaataactaattcatcttagctcagatttagctggttcaagtctctcaatttctctaaaattgagatctacatgttaaaaatatccacatgtgctgtttatgattgtttatgtactgttttggtgatttttctcttttatgcttagattccgacgtttccagagagtccgattttgcaggagaagactttgaacaattccaaggccagcaaggcaagtcacacagatcccaaacaaccctttgtgcatgttgattgtcacgcccggaaattcactagtaatttccgaacttatttgtgcataaaatcctcgtccaggaatcagccgaggtacacaaactgacaatttaatatacaaatccatcataataataacgttacatacttacaaaagaaaagaaaacagcagtggaattacggtctagcgaagctccggctccactcccacaggcagctcaactagggtataagccaaacgtcttctccttcgcaacttgtcttcaactcaggtttgattgattattgcaagaatgagcatatgacatactcaacaagccacacagcaaatatgcaagtgcacaaggataccaaaggatggcataatatagggctcatttgcaaaagcagcatttagcaaacatttgagaattataaaacaatagggtaattaatcatcaatattaatcaacactgaacagcacacccatgctgcacaggcccaaccattctgaacaaccatatccggctgcacagatctatctccaaaccaggagctaaacaaattattaccaattataacatcttttattatggtgagaagtgtgagactaatcacgaaagacattgttagacccgcccatgaccgcgggcacggctattcgaatagttttactctggccagaggtgtaccactgtacccacaagacacagccccacaacatgtcaccatgcgcctcaataccaccacggtacctcggaaaagagctgtgacattacccctcgcacaacacaatccaccacagtgcactgttcccggatcatagtcacccccttataaacaaggcatggactccccagcgacccccgtgggcttatctccgccacttctcagtctggtgctccgcaatgaaccatgctatacaaaaggtaaagccgttgcctacgctggcttgtggttggcacggttaatgtttcacaaccgaaaatcgtgaaccggtccttaattgtcatgagcacgactctcaaaaccatgtgctcacaacccaccattatcaagttttagttggcaagtaattaattaaccaatcacgattggccatcgtgagctatcattatgccatcattaaataatagagaaacattaattatcccaatagtgtgctaatgtttctaagcatggctaagcaattatatctaatacatctagttgaaccaatatataaatccaactagtcaaattataacccgaggtaatcaagacatagggtaatcaatgcaaactggccataacaaaggaatagggtcacaccacccggtgacattcaaaaataaatgcacagttgaaataaatagagaatttaaatataggatcaacatgctcaaaggaattgtttgggatctgtgtgacttgccttgctggccttggaactcctcaaattcttctcctgcgaaaacggactctccggaaacgtcggaatctaaatagaaaagagcaaaaacaccaaaacagcacataaacaagtacgaacagtacatgtggatatttttaacatgtagatatcaattttagaaaaatttagagacttgaaccaactaaatccgagctaagatgaattagttatgaatttttaaagattaaatcggattaaatcaattatatgggttttaattgaattatgacgcaataatgaattatttttgaaaaggaaaaatgggtttattgcgtcagcggctagggtttgcggtggaccgagtgcacggcggcggctcacagaaacgaacggccgagatctctccatccaaaacggacagccgagatcgactggtccacggccggaccacgagagacgacgacgatgacgtcagcggtgacgtcaccaccggcggcggctcaggcttgcaaactcgccagcgaacgacggcgcgatgacgcgaacggagagcacccacgggtagcggacggcacggcgaactcaccggtgaccaaagcaacggcgaaagatcaacggacggcgacggcgtcgaggaagaagcggcggcgaccttcggcttgacgacgacggcggtgttccggcggtcgacagcaacggcggaggggcggacgaggacggcgacgcgacggcgaccacgatggcgacctctccgagcgacggcgacgactggagcgacggtggcgcatagctggagcggcggcgacgacggc

SEQ ID NO: 38289 - DNA, 14498 bp, Oryza sativa
atttccaaccgaaattagccgagattccataagagaaaagatagagtggatcgcggggatcatttcccctctatcgattcggccggagatggaaaggagcgacggaatttgaaaggccgccgtcggcttgcgcgtggctagggcacggctgcgacggcgcgaggttgacgacgaccctgacaagtggggcccacctgtcagcgggagagagagagaggagagcggcggctcggttgcgggccggcttgggccgaggagagagagaaaaagagagaggatttgggccgactttcggcccaaagccaaaagagacttttaaaaacctttttcaatttaaattattcatgaaatgcaatttcatttattaaaaatacttccttggctcaaataaatcccagaaaaatctaggaactatagaatcaagcaaagtatttaatgaaattttatctggccccattttatattgggatttattaattaaaattagatcttctcttctaggcttttaagatcatttctaataattcccttttagacaacaatttataaattaaggatttttaaaccagaaaagcacttaatataattataattagatcattaatgattaaataattactgaactgttctttgtatcatttaggaattgagctccgaaaaatccgagaaaatttcagagagtataattaatcatggagaatttaatgaaaattaaatccatccatgctttaaatttaggaaattttatttcccacatttgacttcacttgtaaattaaagaatatttaatataaattctattaataatttattagataatttataaatcctgaaacgaaaatgaggatgtgacattgatcctatttaaagctattgtttctattcaactattgcatttatttttgaatgtcaccgggtgggaacgacctatttcctttgttatagccctttgttattgattacctatactttgtcacctggttaataattggattagctagaacattatatggttttagctaaagtaattaggatgcttagccatgcttagagacactagctcatatgaatgggataactaatgattcactactacttaatgatggattaatggtagctcatgaaggtcaatcatgataggatgattaattaagatgccaactaaaacatggtaaaggtgggttgtgagcacatggttttgatggtcgtgctcatgacaattaaggaccggttcacgattttcagttgtgaaacattaaccgtgccaaccacaagccagcgtgggcaacggctttacattttgtatagtgtggttcattgtgggcaccagactgagaagtggcagagataagcccacgggggtcgctggggagtccatgccttgttttataagagggtgattatgatccaggaatggtgcactgctttgaattgtgttatgcggagggtattgtcacaatctctattcgggtacttgttaagtatcgcgacgcatggttgacatgatgttgaggttgtgtcttgtgggtacagtggtacacctctagccagagtaaaactattcgaatagccgtgcccgcggttatgggtgggtctaacaatgtctttcatgattagtctcacacctctcaccataatatatgatgttgtaattgattataacttgtttagctcctggtttggaatggtatattcctggtttggagatagaactgtgtagccaggaatggttgttcagaaagtttgggcctatgcaacgggtatgctctatagcgttggattaatattgtttaattaaatactttactgtttttttaaattcaaaagtatttattgaatgccatttatgcaaatgagactattatgccatcctttgttatccctgcacttgcatatttgctgcatggcttgttgagtatgtcagatactcaccttgcaatcattcattagaggaggagttctacagtgatgctgaaggtgtggaggattaggcgtagccctggtcaagctgcttgtgggatggagtcgcctgtgctctttattttattttccgctgcttagatctttattgtttgagaggaactatctacctctgtaatgactttatattcgcctattaattagagtaataattgcactctattatcaatttgttattgtgtgcctcagctgatttctggacgaggatttacacacatgtaagcgtttggagttttggatagaaattccgggcgtgacaagttggtatcagagcctccttgaccctaggttatgccaaatggttacctatagaagccctctaaaaatattgaaaaagtagaacggttctcctctctttctcttttaattaaaccaagctaatggcacatgcagattatagtctctttaattgttctcattcaaaatttacttattattcctgtgttgttagtactgtacatctattactgtactaatgggccatttaccagcaaaagttttacaatgttacttttatttaatcatgttgcaatataatgaacttagcatgttgattttataactctcttttattttatttcttttgaaacctgttattcaaaagtgcaaaaatttgtgatcctgttttcaactgtttcaacttatcttgcaagattagtttactttatttacctttcactttgattttctaactttattcaatttaattcaaaaacttgtgctattaattggataaatgtcttaactccctcctttctcttgtccttagatgccgcgcttcaagcctgagtacttgttcggtgttgagggatttgtccaggagctgcgtacgatgtcctttaccataggattcgggactgcccctttgtatgcccagattcctcatgatcgtgataaagagaagtgctgtgtcaaggtcaccttgaatagtgatcgtgaagacctcccatcggtgatcttcgaggctggagggggaagctatcctcatgcttgtcaggaggtggcaaggatcgccataggagagctctggaccgttacaatgatctgttggccgacactgagtatcgctaccatcctcatcagccccagggaagggaccgtgccagctatgttgaccctgaaggaattgagaatgatgctagcacaagacatttggtcgagatgctgtgggccatggatgagtcccacgctgaagtcgtgtcagctactcaagctcgtgaagaccggaaccatggtaagatctacaagctggaggacaaggttgatcgtctggagaaggaactgaccgaattgaagggagaagcgccaccacagaaggccagggttcgtcttaccgcaaggaagagagctctttttattccccgctaccagttggtgcccaagattcgtgtggtggcaagagaagctgtcccaatcccagtggatcctcgggtcgttaatttaagtgatgatgagaaagaagattcagagcgcacccattcaaaggttgagtggggtgttacttaagatgatgaggacgagccgaacgagctttcaatcaactccgatgccaggaagacctagacgtcttgttgagtcgttgccttagcgcgttgtgttagtttgcttgtttaagtttggttgtgtgtgtgggtcttgcatgtggtttacatcattggtgggatgtaaatgcatgaatttgtttgctttcaagtgttaggaagtttgagttaagtggtgtgggagtcttcagttttatgtaataatgaaactaagttcagattaataaaagtcaagttagtagaaattaattccctgtcgtaagtagttttcccccttcttgttctcttgcctatgccagatggtgaacacttgcagcaatggaaatgggcccaacaacaacaacaacaacaacaaatgagagattcccacgcttgcccaagtcctagctcaacaggcccaactcatgaacatgatgatgcaacaactccagaaccaacagaactaggggaacaatcacgctcctccccagaacaagttagcagaatttcttcgtgtgaggccgcccactttttccagcactaccaatccggttgaggctggtgattggctgcacgtcatagaaaagaagctggacctgcttcagggcactaaccaagaaaaagtctcctttgcttcacatcagcttcatggccctgcctctaagtggtgggatcacttccgtctcaacagggctactgctgaaccaatcacttggcttgagttcactgccgctttcaggaagactcacgtaccatcgagagtggtgtctctcaagaagaaggagttcagggcgctcactcagggatcccgttctgtcaccaagtacatgcatgaattcaatcgtctggcccgttatgctccggaggatgtgtgcacagatgaagagcgtcaagagaagttcttggaaggactgaatgatgagctttcttaccctctgatgactagggattattctgatttccagaagttggtggataaggccattcgccaggaggataagtacaaccgaatggaacagaagaaacgcaggattgctcacttcaaagctcagcagaggaatagtcagaggtcgcgtctcactatgggacctcaggcagtgtcacagggaggatcttcgtctgttgttcgtccacagcgtcagttcttcaacaacaatgctggcaataacaaccgcaaccaagctccacgccctgttgcaactccagtccagcaccagcctgtcaagagggagcaaggaaacaagccaggggtgtgcttcaactgtggtgaagcaggtcattattctgacaagtgtccgaagcctcgacgtgtgaagattgttcctgtgcagaataactccaatgcaccaacgtcaaaggctcgtgtcaatcatgttgctgctgcagaagcccaaggtgctccagatgtgattttgggtatgtttcctgttaactcagttcctgcaacagtgcttttcgattctggtgctacacattcttttttgtctatgagttttgcgggaaatcatgggatggagatggaagatcttagacgtcctttgatggttagtaccctagtaaccaaggactctcatcacaacgtagcccttctgtcagaatagagattcaaggtgttccatttctggccaactttattttgttagaatccaaagaccttgatgtcatcctagggatggactggttagctagatacaaaggtgtgatagactgtgacaatagtaaagtaactctcaccagcaatgatggtcaagttgtaactgttcatgcattgcctactgaacctttaaggtcaagtttgaaccaaataacattggaagagattcccatagtacgggactacccagatgtgttcccggatgatttacctggtatgccgcctaagagagatatataattcagaatagatctggtaccagggacaaccccgatccataagagaccttatagaatggcagccaatgaattagcagagggggatcaagagacaagtagatgatttgcttcagaaaggatacattagaccaagttcatctccatggggagctccagttatttttgtggagaagaaagatcatacccagaggatgtgtgtggattatcgtgcactgaataatgtgaccatcaagaataagtacccaatgcctagaattgatgatttgtttgatcagcttaaaggtgccaccgttttctccaagatcgatcttcgatcaggatatcaccagttgaggattaaagaggaagatatacctaagacggcttttaccactcagtatgggttatttgaatgtattgtcatgtctttcagacttaccaatgcccctgctttcttcatgaacttgatgaataaggtgtttatggaatacctggataagttcgtggtggtctttattgatgacattcttatctactcccgaaccaaagaagagcatgaagaacatcttcgtcttgcactagagaagctacgagaacatcagctttttgccaagtttagcaaatatgaattttggttgtctgaagtaaagtttcttgggcacgtcatctcagccagaggagttgccgtcgaccctagtaatgtggaatccgtaactaattggaaacaaccgaatacagtttcagagattcgtagtttcctgggtcttgcaggctattaccggaggttcatagagaatttttccaagattgctaagcacatgacacgcctgcttcagaaagacgtgaagtacaagtggtcaaaagaatgtgagcagagctttcaagagttgaaaaatcgcttaatatcagcacccattttgattttgccggatccaaagatgggtttccaagtgtattgcgatgcatctaagcttgggttaggttgtgttctgatgtaagatgggaaggtggttgcctacgcatctcgtcagttatgtccccatgagaagaattaccctacccatgatcttgagttagctgcagtggttcatgccttgaagatttggcgtcactatctctttggtactcatacggaggtgtacacggatcacaagagtttgaagtatatcttcacccagccagatttgaatatgagacagcgaatatggttggaattaattaaggattatgacatgggaattcattatcacccgggaaaggctaatgttgtagcagatgctctcagcaggaaaggcaattgcaatgctacggaaggacgacagttgccatgggagttatgcaaggaatttgaaagactgaatttgggaattgtcagtagaggttttgttgcagctttagaagcgaagtccacactcattgattagtgattaggttagagaagctcaaaccaatgatcctgatatccaagaaatcaagaagaatatgagaagaggaaaggctatcggttatttggaagatgagcaaggaactatgtcacatcctgattttcgtcttaggatttataaattatttaataaattattattagaatttatattaaatgttcactaatttacaagtgaagttaaatgtgggaaataaaatttcctaaatataaatcatggatggatttaatttttatttaattctccatggttaattatactctctggaattttctcggatttttcggagctcaattcctaattttaattatacaaagagcagttcagcaattatttaaataataaattaatccttaaatggtctgattataatcttgttaagtactttgagtgtccaattagtttcaggatttttcctgaaattatttgagcattggaagtatttttaacaattcaaagatcattttggtgattgatttatttggaaaagtaataaaaatcctcctcctcagcttgggcccttttcggcccattccttcctcccttctctctgttcctcagcccagcgtaaagtctaatccttctccctctcgctacagtgcttctcctacctccagccggctggacagaggtcgtgttcatcccgataccggcgccaatctccgccgaacccggtcgcttcgttgcttcccttccaaaattgattgcaaaaacggattcctctctatctcctctatcttatccacaagaaacctccatcaaattcgttaactatctcacgaattttggtcgtttttattcgggtgaactcgagataaatcctaatttccttcaccaaatccatctgttcccgaggcggtctctccctcttcctgctataaatagcatcccctcggcctcctcttcggtttccctctgtttcccgaagttttccctagccctagccgcctccccacgctcgtcttctctctccgtcgccggcagtcgctccagccgccgtttgccgtctcctcggccgtcgccctcctgcaccgccacctccctcggctccgcaaggtcgagctctaccccgtccactggttcccctccgcctaatcccgccggaagccgctgtcaccgtgaaggctgagttcgccacccctgtttgatctccggccgagcctcctcgctattgcggtcgtcacccgttcaccccaaggacgtcgtcggcatcgcagcgccaagctgaagcccgtccacccgtccgttgccgccactcgtcgccggaaagccgtcgccatcgtcaacccaaggtcgccgcccttcggagctcgtcgccggccatctccctcgccgtctgtcgtcgcgtaagtggtggtaagggtcgccttgatctcctctctctcccggtgccctccatttgcatcatcgtaccgtggttcgctggtaaccgccgttcccgtgctcaccggcgtcgatcccgcgtggcagccatgtcatcgctgacatcagcgccatcttggccatcaaaatcaatataaatcctgttatccctttgcaatggcatattagttctttttactatatgtcgtctactaaattcattccaataatttccggaggatgctttagtcttttatctcagatataaattatttgtaaattgtttaattaatttggaatagtattttctttaataggctttaattggaattaatcttgtaaaattcataactaatccatatgaagtcggaattaagtggttcaagtctctaaattcatctaaaattatgatatacatgtttgttttctttttatgtacggtttatttggtttttattagtctttttctttgttttgtgtgttagcttgtcgtttccgttgttgcgaaggttcgtgagtgcgtcggaagtgttcaagaagactaattgaagaccgattattgcaaggcaagtcacacagatcccaaacaaccctttaagcatgttgaacccgtttaaagctaatgttttatgtcaacttatgcattattttcgaatggcatcgggtggtgagcctttcccaattaattaatggccgaagatgactttattttcctatgggttatactttgattagctagaaccttatatattggtttggttcagctaaatgctatatatatatatataattgcttagccatgcttagaaacattagctcataaatgggatgaatcacactacattattatttatgattatatttaatggtagctcacgatggttaattgtgttatgataattaattgataattaaaacctgattaatggtgggttgtgagcacatggttttgaaggtcatgctcttgacaattaagaaccggttcatgagctactgttgtgagacattaaccgtgccaaccacaatccagcgtgggcaacgactttaccttttgtatagcatggttcattgcagggcaccagactgagaagtggcgagaagtccgtggggttcgctggggtgtccatgcctctgttttttttgagggggtgattatgatccaggaatggtgcactgtggtgagttgtgttgtgcgaggggtactgtcacagttcctttccgagataccgtggtggcattgaggcgcatggtaacatgtcgtggagctgtgtcttgtgggtacagtggaacacctctggccagagtaaaactattcgaatagccgtgcccgcggttatgggcgggttaagcaatgtttttcgtgattagtctcatacctctcacaataattattgatgctataattggtaataatttgcttaactcctggtttggagttagatctgtatagccgggtatggttgttcaggatagttgggcctgtgcagcattggggtgctgtgcagtgttggttaaaattgatgattaattactctactgttttactactcttaaatgtttgctaaatgctgcttttgcaaatgagcctatgttatgccatcctttggtacccttgtgcacttgcatatttgctgtgtggcttgttgagtatgtcatatgctcaccttgcaataatcaatcaacctcagttgaagaaaaaggatccgaaggagaagacatttggcttataccccagttgagctgcctgtgggagtggagctgaagccatcgctagaccgttattccgctgctgtttttcttttggtttgtaagtatgtaacgttattattatgatggatttgtatattaaattgtcagtttatgtacctcggctgattcctggacgaggattctatgcacaaattagttcagaaattattagtaaatttctaggcgtgacaactgtatggttgggtgagagaatttgtgtcccagacaacaaggagttgaagggtacagtcctgaaggaagctcatgacactttatactccattcaccctggtagtaccaagatgtaccaagatctcatggagaaattttggtgggcgagtaggaagcgtgagatagcggagtatgtagctgtgtgtgatgtatgtcagcgagtcaaggcagaacatcagaaacccgcaggtttgctgcagcctttaaagataccagaatggaagtgggaggaaattgggatggatttcatcactggtctgcccagaatgtcatctggccatgattctatttgggtgatagtcgacaggcttacaaaagttgctcattgcatccctgtgaggacaacatattccggaaatcgtttggcagaattgtatatggcaaggattgtgtgtttgcatggtgttcctaagaaaatagtatccgatcaagcgagccagtttacttcaaagttctggaagaagcttcttgaagagatggcttctaagctgaatttcagtacctcatatcatccgcaaacagacggacaaactgaaagggtaaatcagattttggaagacatgttgagagcttgtgttttagacttcgatggaagttgttataagaatttgccttacgcagaattctcgtacaacaacagttaccaagctagtcttcaaatggctccttatgaagcactgtatggtcggaagtgccgcactccacttttgtgggatcaaacgggagaacgtcaggtttacgggactgatattctgagggaagcagaagagaaggtaaagatcattcaagaaagattacgtatagcccagtgtcgtcataagagatatgctgacaatcgccgcagggatctaagttttgagaaaggagatcatgtgtaccttcgtgtcacgcctcttcggggagtttatcgttttcacaccaaagggaaattggcaccgcgttttgtgggaccatataagattgtcagtagaagaggtgaggtcgcctatcagttggagttacctcaatccttggcaggtgttcataatgtgttccatgtgtcacagctaaaatagtgtttgagggtacccactgaagaagctaatcctgagcagatagaaatccaggaggatctgacttatgttgagaaaccaatccgtatcttggagacagatgagagaagaaccaggaatcgagttatccgtttctgcaaggtccaatggagcaatcactcggaagaagaagctacctgggaacgagaagatgaattaaagtcagctcatccgcatctcttcgccagctcttccgaatctcaaggacgagattctgtttaagggggtaggtttgtcacacactaaaaatcccaaatttataaattgttgtttaaatggaattgttagaaatgattttaaaagcctagaagaaaagatctaattttaagtaataaattccaatataaaagtgggtaaatttttattaaatacttcccttgattctacagttcctagatttttcggggatttatttgagccaagaaagtatttttaataaatagaattgcatttcatgaataatttataaggaaaaaggtttaaaaatccttcttttggttttgggccgaaagtcagcccaagtctctctctctctctcaccggcctatgcgcgcccggctcaagccggcccagttcgcccctctctccctcctctctctcccgctgacaggtggggcccacctgttagggtcgtcttccacctcccgccgccagccgcgccctagctgcgcgcaagccgccgccccttccagattcggtcgcatcttttccgattcgatcaaattgatagaggggaaatgatccctttgatctcctctatcttttcccctatagaaactttagctaatttcgtttcgaaatcgtcggattcgacctcgattcggatttgatttcttccctccaaccctaaaccttccattgctgctgttggtcgctgtgggcctagccgccgcctcttagccactataaaaggatccccaggacgtcctctgttcgccgccaccttcgccctagcccgccgtcgtttgtagcgccgcttccgcgtcagcccgtgcgccgccgtcgtcgccgcaagtgcagtcgtgcggcaccgccgctcttgtcatcatcgtcgctcgggaaggtcgccatcgggttcgccaagtcgtagccgtcctcgtcccgtcctccgtttccgccaaaggtcaccggagcaccgccgtcgccgtcgacccgaacgtcttcgccgcctcgacctcgccgccgtcgctgtcggttgtcgtccgtcatcgtcagagccctcggtgagttcgccgcgtcgccctctacccgtaggtgttgtccgtttgcgccgccgcgccgtcgttcgccggcgagcatgaggtgccgagccgccgtcggcaatgacgtcatcatcgacgtcagcaccacgtcagccgtagacccgtggtagatcggttagatcttggccgttcgttttgtttagattagatctcagccgttcgttccgtagaccgcttctgtgcacccggtccaccgtgaacccgagccccgctgacgcaataaatcctttttccttttcaaaaataattctttattgcgtcataatcgaattaaaatctatataaatgatttaatccgatttaatctttaaaaattaataactaattcatcttagctcagatttagttggttcaagtctctcaatttttctaaaattgggatctacatgttaaaaatatccacatgtgctgtttatgattgtttatgtactgtttggtgattttgctcttttatgcttagattccgacgttcccggagagtccggttttgcaggagaagactgaagaattccaaggccagcaaggcaagtcacacagatcccaaacaaccctttgagcatgttgatcaagtttaaagctattgtttctattcaactattgtatttatttttgaatgtcaccgggtgggaacgacctatttcctttgttatagccctttgttattgattacctatactttgtcacctggttaataattggattagctaatgattcactattacttaatgatggattaatggtagctcacgatggtcaatcatgataggatgattaattaagaggccaactaaaacatggtaaaggtgggttgtgagcacatggttttgatggtcgtgctcatgacaattaagggccggttcacgatttttggttgtgaaacattaaccgtgccaaccacaagccaacgtgggcaacggctttaccttttgtatagtgtggttcattgtggggcaccagactgagaagtggcggagataagcccacgggggtcgctggggaatccatgccttgttttataagggggtgattatgatccagaaatggtgcactgctttgaattgtgttatgcggagggtattgtcacaatctctattcgggtacttgttaagtatcgcgacgcatggttgacatgatgttgaggttgtgtcttgtgggtaaagtggtacacctctggccagagtaaaactattcgaatagccgtgcccgtggttatgggcgggtctaacaatgtctttcgtgattagtctcgcacctctcaccataataaatgatgctgtaattgataataacttgtttatctcctggtttggaatggtatattcctggtttggagatagaactgtgcagccgggaatggttgttcagaaaggttgggcctatgcaacgggtatgctgtatagcgttggattaatattgtttaattaaatactttactgtttttctaaattctgaagtatttattgaatgccatttatgcaaatgagactattatgccatcctttgttatcccctgcacttgcatatttgctgatggcttgttgagtatgtcatatactcaccttgcaatcattcatcagaggaggagttctacagtgatgctgaaggtgtggaggattaggcgtagccctggtcaagctgcttatgggatggagtcacctgcgctctttattttattttccgctgcttagatctttattgattgagaggaactatctacctctgtaatgactttatattcgcctattaattagagtaataattgcactctattatcaatttgttattgtgtgtctcggctgattcctggatgagggtttacacacatgtaggcgtttggagttttggatagaaattccgggcgtgacacaccaagtcttagatcggctatatttgtttgacatctaactgtcttcaaatttctcatttgtaggccttagccgatctattttcttttgatatcaaagattactttgatgagacagaaga

SEQ ID NO: 38290 - DNA, 28307 bp, Oryza sativa
ctgaaatccaagcctcaattccggacgatctggcaaacaccattactccatccgtgtcccttgagcaacatcaattcaagctggagaaggccaagcaacggatagccgatcggcgagagcggaaggacattgaaaccactatccaagccaatcgacagcttgtgcatgaagagaaggctaaattagatcaactctctgttggaccgattcagtcgaatatagatcggcttgaagctcgcaaaattgatttactagctcaactcgaagagtgcaacgccgagttggattttgaaaaacaaaagctagccaatcttccaagtgtgttgatgaaaaacacgaggcctgggagatctgcttaactccagtgcaggtcgaaagctcgccttcgggtgtgttagcgtgccagttgatttgatcctgcaatcaacaagaaaatagagacagagagaccgcggttaaatctataaatgatagccaatcggctatgtgccgatgacatatcatttatctttgagccgatgtcatacgtgaatcgatcggcgggtataaataaataataaagaactaaacctactcgatcggctgtagatattaccaatatatagttcttatatcgatatatatttaaatcaagtgattgggatagatcggtcgccatgctgagacagtataaatcacttagatcgaaatatatattaataataggactatatatgtttatagcatagccgatcagatagatctagcatatatcggctaatactccgatactactctatatcaggatattaaaacaggtatgatatatcaaacaaaagcttaatatacttagatgcaacaatatcttggcataaaagacggatttaacatctcaatgaagcatatagagcgaatatagttaaatcagataagatcggctgaaacttcgatgctaccctgatcagcaaccaaaaggcaagctagagattgacattctaagcacgacttaatagatcaaatccaactagtgcagcattaagtatgaaaagaagaacaatatctagacaatcaagccgctggaagtttcatagagtggtagatatcttatataatctaaaccaatgtcgatatttaacctaattggctaccttctatcaacggatgttagccgattgcaggttagatggcgatattgctagagattatgtaagatatatgataactcgacgaattacataaacaagattagagtatcataaagatggaagcactaatcccgagaacacaagccgtcataacaagttttacctcttgttgaagatcaaaaccgatgcagctcaacctgaaagcaagaactcgtcgaaataaaactaaagcaaaaaggtggcgatgcgccgaaattgtattgaacgtgtgttagaaattacatatggctcggggtctatttatacccgagaattacaagatatgtccctaccggacacgactattatctctaacaaactctaaaataccataagtctttgcggcagacttttgcccatatttatctctaaggaatttacataaaatatcttaattaatagatacaattgccttcccaggactctatccgtatatggcaatcatcttgaagtacgtcgactcaaacccgatatcggatacaagtcgtattatcggaatcggctgtatcacttaacccagtctgactcggacttagccgatcctaatcgtagctgatccgaacctcagccgattcttactctgtttctgcgataatcctcatctttgattctgcttcaatccaatcttgtttctgatgcaactattaccaaatttggtcgttaacaaagtgccgttgaagaacagtagtccagattgagatcagctatcaagaacgtggctgacatgactaagtctctcaaggtcatccctggaaccgacgcccaagacatccaagctatcgaggaagtagatcaaattagacaacgggccgtgtcggctatccaacgctatctgtctcaatgacattttgtgtaatagaccctaagaatttttgtaatcggctaagaaactttggctaatttttataatcagctgcaaactttggctctttgtttactccatcttgatgtgccgattagtataactccatattttgctaaaaaaattgcaaatttttcatatatgtgcccccctaaatttacaatgtcaaaagcattgataaaattataacttgaactaagggcgatataacaatatcggccattgtacatcggcaaaccacaaccgattacaattaaaacaactaagggcgatataacaatatcggccattgtacatcggcaaatcacaaccgatcacaattaaaacaactaagggcgatataacaatatcggccatcatgtaccggcaacactagccgatcatgcattaacccagacacttgggtaatatttctttaaatacttgccatttagcgctcgtccatagacttctccatcgagtccttgcaacatgtaagctcccttagacacaactttgtagatctgaaacggtccttcccaattcggtgaccacttgccgaatttggtatcccgagtcccaatcggcaaaatcaacttccatacaagttcaccttctgaaaaagtcttgggcaccactttcttgttgtaatgtcgagcaacccattccttatcattggtaacctttgcaagggcccttaatctagactgaaccaagtcttccctttcatcggccatgagattataatactcatcggctgtcaaatcattttgcaactccgttctccttgagccgattctaacctcccatggtaaaacagcttcatgtccataaacaagcttataaggagggacttggatcgatccatgacaagccatccgataagaccacaatgcttcggccaatcgagtatgccactgccaaggatgatcagaaatcttcctcttaatcaatttgatcaaactcttgttagatgcctcggcctgcccattagcttgcgcataatatggtgaagaattcaacaatttgatacccatgctatcggcaaactaaacaaactcatcggacacgaaggttgaaccttgatcggtcgtaatgttttgaggaataccaaatcgatagattatatgccctttacttgatggtggattaatcatatcgatcatatcaattccccatcctctaaatgaccatggtttaatgataggattcaaagccgatgccggtgctctctgtattgctccaaatttctgacaatcttgacatcccttgtaatacttgaaacaatcttccagcattgtcggccaaaaataccctgcacgaccaagcaaccacttcatcttatgagccgattgatgagtaccacaaattccttcgtgaacctcaccgattgcaaccttagcttgattggcactcaaacacttaagcaacaccccatcaatcgttcgataataaagctcatcatccaacaaagtatactttaacgtattgtaacgcaatttccgagaagccgattgagatggattctgtaaatattgatgtacatcatatctccaatgatcggctgttaatgcagcaacttcaaccctaatgtatttgatcatcggcttataccctggtgccccttgggccaaatcattagcttcaatattttgttctcgagacacatgtttcaaagtcaccagccgaaactccatcagttcttggcacttctcattataaaccagtaatgtatcatttttgcactcatactcccctgccaattgactgatcactagcaaagaatcccccataatttcaatagcatcggcttcaacttccttgagtaactgcaatcctttgagaactgcctcatactcagcttgattgttggttgcataaggtttaatggtataagcaaactcaaaacatgctccccaaggggaaattctaactaagccgataccacaaccatgagtacatactgatccatcaaagaataaagtccatggcacaatctcaaccgagccgattgaattatcacgatgatcaacaatgaaattgactatagcttgccccttgactgccttcggggactcataccgaagatcaaactctgttaaggaaaatatccactttccaacccttcctttcaaaattggagccgataacatgtacttgacgacattggctttgcatatgacagtgcattcgttggacaatagataatgcctaaaccttgtacatgaaaaatataaacacaagcacaacttctccacaggggaatatatagtttctgcatctaagagctgacgacttagataaaatacaaccctttcctttccttccagctcctgaatcaggaccgagccgattgacttcccactggctgacagatataatctaaaagttacccctttcgatggaggaatcaaaattggaggagagctaagatattccttaatactatccaaagccttctgttgctctgccccccaagtaaacttttgatcggctttcaatcttaataatggtgtaaaaggctctaaccttccagacaagttagaaataaaccttcgaacaaaatttatcttgccgatctctcttgcaattctgtcatattctctggaggctgaattttcttgattgcattaatactcctttgagttaactcaatccccctctcacgaacaagaaatcctaagaactggccagccgatacgccaaaagcacactttgtcgggttcatcttcaggccatacttcctagttctctcaaaaaccttcctcagatcgactatgtggtcctctatctctttagacttaacaaccacatcatcaatgtagacctcaactaaccaaccgatcagatcatgatatatataattcatagctctctgatatgtagctccggcgcttttcaagccgaaagtcattacaacccactcaaacaagccgattgcaccaggacacctaaaagctgtcttatggatatcttcttcggccatgaagatctgattgtatcccgcatttccatccataaaactcaatatcttgtgccctgaagcagcatcaaccagctgatcggctactggcattggatactcatcctttggggtagctttgtttaaatccctgaaatcaatgcacaccctgaccttgtcgttcttcttgataacaggaactatactagaaactcactcagcatatcggcaaggacgaataaaaccagcatcatatagacgttgaatctcagctttgacaggttcaagcatatgaactttgcatcttttcggaggttgttggtgtggtctaagccctggtttgataggtagccgatgttcaacaattgatcggctgagtcctggcatctcataatactcccaagcaaagcaatctatgaattcctttaacagctctatcaacttggttctaaattctgaagataaattcttactaataaatgtcggccttggtcgatcacctggacctatgtcaatttcttccaaatcgtcggccgacatgaaaccctgtccttgcttgtcatcgagatcatctactgtgtccttggtgtaaacgtttgaaccctccacgacaccctcaaaataatagcttgggctctccgtcttcaattggctgtatatcagaatcggacacttttagaaaatctccatcccaaacttttccagataagcaatcgagaccatccatctcccaaagagctaaatcggcactagcaacattaactaacctgtcagttggaacaatttcaatcttctgccttgccactgaatcaagcattgatgcatggttgaaggaatgcaacaattagcatgaatccaatcgcttccaagcaacaagttgtaggaacccttcccatcgatgacaaagaatgttgtagggatagttttgctgccaactgtcagctccacatttaaaactcctttggtttccgatggattgccaccaaaatctttgagcaccatgtttgtattgatgagatcctcagcatttctgcccaacttcctaaatgtagcataaggcatcaaattcactgcagccccaccatcgaccatcatcttggacatcggcttcccattgacatagccatttatatacaatggtttaagatgccgattctctgtcccttcaggcttctcaaagactgcttgttctggtgataaaaccaacttagccgattcttcttcaacttcatcgacatcggcttgcttgaccccaaactcagcaggcaacgtgaaaaccatgttaaccgacgcagtcacaacacttttccctttagccaatctctttgcttcatcgactgtggcttcatcggctataggagcttgattcttaacacgccactcctgcttcggcttcgtcttctttaaccgatgattgatttcttgctcaacttcttgaaagcgctccctgttcctcaacctttgaaccctcctcttctaatttttcgtaaaaataccagaaggacaccattgagtcttcctgccttcattgtcctcttggttacaatattggttcaccgggcccaatctttgatgagcaggaactcttgcttgccatagccgattgcttctattgaacgatcgacttgaattttctgcaacattactgcacccaggatagtcttgaatagatggcagcctcataccttcattccagcaaaatctaaagaactcacagccccaatgaggatcaaaaccgccatcatcttcttcataatacctctccagctgtttgtcatacttcttctgatacttattgataattttagccgaattcacctgaaaacctcttgcacgacctccatcgactgttcggccagctgtatgcaccatattgacaggaaaaggattgccatcaaccttcatcggcctcttagaatcatcaaatttgattttgcctccctcaatagctgcctggatctgttgcctgaagaccttgcaatcattagtagaatgagacccagaattatgcaagcttctggatcttagctttaacagagccatctttaccagtcgaagacggcgatgctgttgtgattctgacttctaatcggtcccactgggcgtgccaaaaacgtgtttatgtgaaaacacgaggcctgggagatctgcttaactccagtgcagttccaaaactcgcattcgggtaagctagcatgctagttgatttgatcctgcaatcaacaagaaacaaagacaaagaaaccgcggttaaatccataaacgatagccgatcggctaggtgccgatgacatatcatttacctttgagccaatgtcatatatgcatcgatcggcagtcattaataaataagacagaactaaatctactcgatcggctgtagatattaacggtatataatccttatatcgatatatacttaaatcaagtgattgggatagatcggtcgccatgccgagccagtataaatcacttagatcgaaatatatattaataatgagactatatatattcatagcatagccgatcagatagatctagcatgtatcggctaatactccgataccactctatactaagatatcaaagcaagtaaaatatatcaaacaaaagcctaatatacttaaatgcgacaagatcttaacataaagggcagatttaacatatcaatgaagcatataaggtaaacatagttaaatcaggtaagatcggctgaaaccccgatactaccctaatcggcaaccaagaaacaggctagagattgatattctaatcatgactcataagatcaaactcaactgatacagctataagtatgaaagaaggacaatatctagacaatcaagccattggaagtttcatagagtggtggatatcctatataatctaagccaacgtcattatttaacctaatcggctgccctccactgacagatgttagccgattataggttagatagcgatattgccagagattatgtaagatatatgataactcaacgaattacataaacaagattagagtatcataaggatggaagcactaatcccaagaacgcaagccgccataacaagttttacctcttgctgaagatcgaaaacgatgcagctcaacccgaaagcaagaactcgtcgaaacaaaacgaaagcaaaaagggtggcgatgcgccgagattgtattgaacgtgtgttgtttgattacatggggctcgggtctatttatactcaagaattacaagatatgtccatatcggacacgactcttatctctaacaaactctaagataccataagtctttgcggcagacttttgcccaaacatatctctaaggaaattacataaaatatcctaattaatagatacaattgcctcctcagaactctatccatgcgtggcaatcatcatgaagcacatcaacctaaaccgacaacgtatgctgtgtcatattgtcggattcggctcaatcggctaaccccgtctgactcgaactctgccgatcttagccatagccaattcggactccagccgattctcactctgtttccgggacgatttccatctcgatttcttctccatcttcgatccttggattaccaaatttgttcattaacatacccacatgttagtgggccccacttcctcacctcatcccctctcttctatatgtatcctatcccctctctcttctatgagagcagggttgagcggagagcggcggcagacggagcaggcgggggtggagcggcggcgcgcctgggccatctccattgcaccacctctctccactggccgagcgcgctgccgaggtgaggcgaggggatggcacggttggcagctagagggggttgggcagcgatcggagaggaccgacggtaagaaggcccccaaggctacgagagttgaaaggattgaataaggagaggatagaggcgaggagaggggaggggagtcggtgagctcgagctctctatcctactcacccatcctcgccgaccaccacctgcaaccacttgctctgccgcctcgacgtcgacccccctcatgcatggcaccagcgcgtccaccgctaccccgacgccgagccatggctccgctaggacaggcacgggccttgctgcgaggtgcgacgatgaagactgtgtgaccgcctcgcccaccattaataggtttaatcttgttgattaagtgttcctatcatgtgagtgcgtgtagtagagctgtactcagtcatgtgtgtaagtgagaggtgtatgtgtgagttagttggatcggtgatagctatgacctgcatgcaagtgattacacagtgcacattgccttggaggagcggccaagtcaagtgaagtgagagtcatggtgtgtgtgtgcattagccgctggtgtgcagccacacagaaatttacttgtgtgtgcatccagtgcttgtgtgtaaaagttcttgtgttcatctgttagccatttcttcagcgtataaacaactacgtgagtgtgtgatcttgtgagctagtgccaacagtggtatcagagctaggttcgagagatgccgaagatcggcgacggcagcaaggctattgccggtgacgacgacaacagcaagctagtggtgcagcaagtgaaggatgcgggggtgacactatgttaccccatgctcggagggaacaactatggtgtttgggcggtgaaaatgaaaattttcatgcgtgcacaaggtgtgtgggctgccgtggagggcgatgtgtgggctgccgtggaaggcgacgcggccgatgagaagatggaccaaatggctctcgtcaccattgtccaagctgtgccatatccgagaaggagaaggcgaaggaggtgtgggatgccctcaaacagatgaacatgggtgaagagcgtgtcaagaaggctcgagtacaaaccctcaagaggggagcttgatggtatgtacatgagtaattctgagaaaattaacgatttcgctttaaaggttaccacgaaaatttcatagagtatgttagttaatgaagaatttaagaaactaacttggaccatgatttattaagaaatatttattcccttgtttacttcattactttaattaatttgcacattattttaaattctaaaacaagctaagtaatttttaaattcttacaaactcaatacaattgaaacacttgatttgaaagaaaaataaaaaagacacttatgatgaaccaacattgtcatgaacttacgatgtttgtgggttgatctcttatgacaaaacaacaattgtcatgataagccgtgggattagttaatgatgatttgtccttaattttgtgacgaacatcttattttcgtcattaggccacaccgccctccaccaaacgtcataaatgaaatggtataatgacgaacaactccgatgtcacgagaaaattgtcatagaaggtcacatgtgttgtattgcgcctttccctcttctcctccgcctccccccttccaataaatgttcccatacactcgttttgactttggtcaaagtcaagtttaactaagttatagacaaatataataatatttataatactaacttagcttcatcaaatcaataattgaatatattttcataataaatttgtcttgggttgaaaatattactactttttctataaacttgatcaaacttaaaacttaaagtagtttgactaaaacggagggtgtatataatataaaatgagccacttaaataaatgttcactgcaaatgacacgccaaaaattcctgaaaattttactgaaaattagttcgccttgtagcctgtcccataaaattttcatcaatgcaggagtcaatcagtcctcactcctcagtttgaaaaatgaaatacagtgtagtataactatacatctcattttcatatcaacaaaatttaaggacgaggtcttactgtagatggccataaggcccgaggcccgaaggcctggcccacagtacgtcattttgtcttggcccaagtagcccggcccgactgccggactgtgcctgggcctccccaccggcacactgggatggcccggcacgatcgggccagcccggcacgatgggccggcaggctaggcccgacacacaaagtatagggactaaaaatagacatattaatatcacggtccaaagaatagggacgtaaaatagacttattttagctatttatatatcacaacccaaaaaagaggcgaaatccctaatacacgattagtcgcgcgccccctccccgtgacatcccggcccaataaggattaggcctgtgtggcccatgtgagctgtgtgcacatgtttagtaccaccttgcaagtttagcacgagtggaaccgacttataaggcatcttccctccaaccatatcactcccgggttaacccttttacacgaaacgaggacgaaagtgtaaatggggtggtatgtgtaagtgggcccgcttgtcgattggtctgggctacacggttctggagagagggctgttacactcccccgcgcgcggagatggggccgcaggcgacgtgttttttttctttccgtatctttttctttttttggttttttaatacatatgtatacaaactttgtatacacgtatataaattttgtatgtgagtacctttttatatatagatgtacaaactttgtatatatacatacataaagttggtatattttgtatacatacatatacaaattgtatatacgacgtatacaaactttgtatatgcgtatataatttttatacatatatacatattagaaatatacgtatgtatatactttatgtatataaagtatatatgtatatacatgacgtgttttttttctttccgtatctttttctttttttggttttttaatacatacgtatacaaactttgtatacacgtatataaattttgtatatgagtacctttttatatatagatgtacaaactttgtatatatacgtacataaagttggtatattttgtatacatacataaacaaactttatatacgacgtatacaaactctgtatacgcgtatataatttttatacataatacatattagaaatatatgtatgtatatactttatatatatacgtataaactttataagtatatatgtatatacatgtataaagtttatacgtatgtatataaagtatatctctactacttaaaaaatcggtagtggtggtcttgattcctaacacagcagacgcatttgacagacacacgtaatctcaaccatccgattgccatatccaactgcctcgatctcctccccaccgcgcatcgctcctctccccttctctcggatcgatctcctctccctccccacgccgcgtccttcgccctcctccctgcgtcgcctccttgccccgccgccgcgtcgcctcatcaccagacccgcgatcaccgccgccctctccaatctaccgcaccgccatcgccgctccctctctctccccgcgtcacgccaacccccaatccgtcgccgtccccacaccgcgccgccgcccctcgcctctccaccacgccggtctcctctgcgagcgctgcccacgattcgccgccgtcgctcacaactcgtcgccgccggctcctcgcctctccgccgccgtgacaccgatgcccgccgctctacccttactctcgttcgcgacgccaccgatctttgtatgcccgcctccgtgccgccagatcgccgtcgcctggagtcttcggggaacagcctcaacgaaaatccgagcaccgtcgtcgacggccatctccgcccagcgtgcctgatccctggaacagcctcgcgcggtgccaaaaccacctccgccgccgtcttgaagctggccgtcctctcgccaggtgccgtcatttgcccctgatgtatggtttagatacccacggacaaaatcccacatgtactagctcactgcatcagcaccagctccgaagctccgatctggcggcgtcgccggcatccaggcaagacatcaagcctacgctgcaccaagtaagctacccgatctcttatttttctctttaatttgctttcttcagctcctgttttgccatctttgtaagaataagaaatcattaggggtggctgcagtggtgcaggggatcgatgtgatccatgctgtcgcaatcaggttactaattaatatctagctcgctgaccaaacaaatttgtgtttttgtgtatcaggcttgtgctgtggagtttaaacatgctaaaagtgtttcattgattctttgattgcaccaatgtgatgtccctgagttatttgtggcatgggtttcattttttctactgcaacaatctgttggaatatatggaaaacggtcccatttcaatgccattttttaagatgcagaatggcgtaatgtagtatctttattgcaaggaatgaatcacactcttacagtattttgaaaagataagaatgttctcttcttgctgccttaattttggcctgcatatttgtgtccacatgtatcccattattaaatggtgttatgattcctgaattcctccgtctagcatatccgttgacaaattggtcaaatttaggcatgattttgcatgtttcagaccttcagtatatatagtacggttaatctgatgcagaatagtcgctggatttaaaaccaagttctatcctaagtttacatcaaatagtggttatttagagaagcgggtagactgaaacaatacaatcaatatatcttacttgcaaatttgacctccctttatagcatttgcttgattgtggcaacatttttagctgtagaagtactgggaagtatggcagattgccaagtggataagcggactgcagattgtttttttgcttctgcgtagcaggctgaaaaattgagcatctcgcaggttaggggactctgcagccttggtgctgcaatttgttgatcaaggagcagctgagtatgcaggttaaggcaatgtatcctctgttcctagatcctcaaacaagttaataaagattttattgccaaatttgatttggatcttttactgtaaatctatgaagttgagcatactctgcataagatgagaggaaggcacaggggagggaggctgaaaatgaagctcgacgttaagaaaatggactttgatgagaggacgatgtggaaaatggactttgatgatagggtgatgctgaaaatcgactttgatgttaaagaaaatggttgaaaatgataggatttcaaatggttcaaaatgataggatttctctgcatacactgcattttgatggagttatatttacaaaggattaggatgaaaaagcattcgcactttatttccttcgatgagataaaatagctaactgtactttatttcagacatttgcatatgggttcaatttgtgttggagcaaagctgctagatcgtgtgaatcaccctggtaaatctggagctttattttcagatgtatttactctacaaaaactgtcaaagaactaactcaactatcgattttaataacaagatgctttcagttttatcatgggttattatgttttgttatatttctaactacaggtcagcatcacttagttggtgcaagcaccgtggaacatatttattgagttgaaccctaatttaattctaatccgattgattgcaaaattatgtttttttcctcgacggtagggtgcgggtgcactatttatgccgcctgagagcatatgctgctccataatggaatcaacattcttgtaattgtatccagttaattcttcctaaatttaattggcgccaccagttagtactattttctacctacacatagtggcacgaaccagcactaaccacggctgaagataattcttcaggttatatatatatatatatatatatatatatatatatatatatatatatatatatatatgtgtgtgtgtgtgtgtgtgtggatattccctaatggcagatccaagggctgtgtttggtgctgaatgaatcagttcttttttataaaaggtgtaagaaagtctgtaaaaaagttgtaccagaactgactgagcttccttttgggtgaaattggtttgctaccacaagtccttactttaacaaaaatgatatttcctatgccaacctatctcattctatagttagttgttaccacatcttattttgactatttaatatgttttacgacatgttaccgtagcgttagcacgggcatgctactagtacatacgtatatacatgtagtagagaggagagactaaagggtcagaaactgaccgcgcgccacgccaggggcgcgactgatcgccccttaggggccccaagtagagggaggtaaaatagactttttttacctatatatgacacagcccaagagagaggaaaataagacttattctgaggaaaagcacgatgggccgtcgtgccttcgggccggcccgacacagcccaagtcgtgttgagccgtgcctgggccatgtgtgcggcccgtgggctggcacggcacggcccggtgcatcggccgggccccgacaagcctcggcccaggcacggccggtcctgggccgggccgtgccgggcggcccagatggccatctataggccttacattccagacacgtaactgtacatcgatcaggagaaagtgaaatggtttggctgcaccacaacttatggtagttatagatagtcttttccgtcggaggatatagatagcatcaatcagcgccctttgtcctggcaatgcagaaagcctggaggctcatgaagaggatgagcagggccatcgtgatgcacgccacgagctccctagagccaagaacccgcgccttcaagaacctgttgatcctcaccttccagcagctgtcgtgatgccgattcaggtcgtcgatcaccctgtccaacgccggcaccctcgtcagcctcaccgacctcgtcatcccattccacagctccgccacctccctgtcgctcttgaggtggttcaggatcacccccgactccctcagcagccgggcgtcctcgtcggtgtcgatgatcccgttcatcagctcgacgtacctcgccagcaccagcgctctgcgccctgttgacgcctcgaaggcgaccatgttccgcagcacgacctcgctgttcacgtcgacccggatcaccgggaggcgcagcgtcgcggcttccgcgcagaactcgatcgtggagatgccgccgttcgccgggacgaacctgacgccggagtaagctagctcggcaacacaaggcaccgcgatctcctcgagaagcggcgatacgcagctcttgttgttctgaaaatccttaatgggttgttgtccttgtgttggctgtgaattcagttgttgcgcgatcattgagaggcatggtattctggtgaggagcttcagtatgatcctaacaccgagatcaaccagcactgaaagaaacttggtgacacgcttgatgagcaggtctgttaatgaacgcagagtactcttcatgtgatgcttcgattgatcatcatcatcatcatcatctgcttgttctgtggcatcatccaaatccaatccttcgacatagcatggagccatgttagagtagaggaaatcaagaaggtgggcgtgtcgtgtcgtgtcggtgcacggagagcccgtggccacgagggaggagacctcctgaaagaacccggacaggacggagctcaggacagattccgctgtcgcacgcgacgagcctcgcatttccgtcgccttgaggagcagaaacagagggatctggttctccagcatgacaacgtcgtgcagcaccatggtgtgagaggatgtcctccgagatggatcaaccaaatgcgacatccttgacgggatcctctgcagcgctgcccgctggctactgtcctggctaaacgtctgcaagaactcgagaaggaacgacacgtcgatggccatcatccatgctagtgcgtcattgctgaggcctagatgcctagagaaaaaaaagaaattaacaggtacttccttcgtcccaaaataaacgcagccatcagtttccaatgtccaatttcgatcattcatcttatttgaaaattttctgaaaaagctaaaaaaaatataagtgacgcataaagtactattcatgttttataatctaataataacaaaattactaatcataaaaacatttcaaataagacgaacgatcaagattagacacgaaaacttatggttgtgcttattttgagacggagtgagtatattgatagggatggaatatgaagttagtcgaatcctttcttttacatgcaaactgacctgtggtagtaagctcgaatctcgaattctagcgtagcgaagacagccacgagctgttggaagctcatacctgggaggtggcgttgggctctcctggcagcagagagcttgtacatctccatgtcacggagctcttcgcgacaatggtggtaagggccaagcgcaaccagctgaggggtgtaggcttcaggtttggtgcatagtaggggctttgggacatcaaagatggagatgggttggctgtcatggacttcgatctcctcatcaagaatacgtttgatgcgaatgatccattgtgcttcgtcgaattggagatttggacaaatccccattaattgttgaatcgtgttaaacggatcggaagattgatttaagatgatatgtagtaagaacgagatgagcatgcaaatcttgttcagttttgtcaccaaagaaaccaaacctagcggagacagcaacataaggggaaaaaaatatgttgactgttactgcatttttttcctgtagttaattaatagtgtaaccatgacaccagcagattaaagcttcaattatggctgaccggttaacgttacactagaagtaccatccgtgcgttgctatggatctaacaagtaatttatttgggaacaaagagaacatttttttaaaaaaaacactatacaagttggaactgattttccgaattagattccagatggttgtatattttctgtgaatacatatgcttctgcatacccaataagccattcttatatatttattttagtaagaggaagaaaattatgtctatatttatagctaataataaaaaaaatacataaagcttccggtttttgttggttcatccttttttttttttttgccttttttctgattttttttttgcacgtggaaggtttttttttcgcacacgcgttaagtccgttttttatctcgtctggtctgatccgcacatgtgcgcagcacgcctccagccaccggtgggccgaaccctatcgccatcgccacatcgatctacttcaccgtatgtttcctcctttaatttattgcaaatattaattctccactcctccatcattatttttccataattcccctttcaattcggctttaattcacggaatttaatctctatttaacagtttcgtgtttgcagctggatgagccaccgctccactcgtgaagccaccgtctcgccccaccttatgccaggtggagaggaacttcagtgagctacaatctgtgcccctagtgacgcagacgaggtgttcagggtgcgctgccgcggtgctagagatgaaacacatatcattgccgccaacgccacaatggaaaaagagaaaggaaaaaaaaaagagacaagagaaatgaaaagggagcggatgagaaggaaaaaaaacaaaagaagaaaaaaaaggaaaataaaatgttttaggtgggtcccacttgtcagtcaatgtaaagttagtgttggtgtcacatcagcatccaagtggcatgccatgtcagcaccaagtaacatcccagagggcttcgtagcaatatcagaccagaatgacacactttaacatgttttaagatctttttttttttgcattttgggagtttgacctacatgacaccgacgcacaagtttagagattaattgtgcactttacttttttattattgtaatacatgattttttttattaagataagtctttgactaataatggctttatctcatagtactagcgtgaccgtgcattgcaacggcctatatagagatgggctgcatgggcatattggtttacttaaacgctgtgggaatgcttggaatttatagcgccacgtcatgcgattttttcagaaaaaccctcctgctttcgtaaaataatgcccacatccgagtttgtgttcaccgtacgatcgccgtgaggctcgatccgaccatccgtgtggctcagctggcggatgtttcactgccctcggatcggtgatttgggaatgaacggcttagatatcatgctttcaccctcccccacaaaaccctagcgctgcccagccgcccccaacctcgcgccccacccccacgcccgatggctggtgccgccgcctcgccctctcgctgcaagacgatggtggcgccgtctcctttcactcgccctctctccgcgggatagcggaagcgccatctcattccccggccgcgccctctcgccgcaggcaatgtctccgttcccttcccctgacagtttgggtgtcgccgaatctcactgggattagttcgccaccgtagggagttgccgggactggttcgtcacctctgcgacctggcgacctgacgatctgctaccacgcattctactcctccccaggtcaactttacactccctttgcctaatcctcttaatcaatatatatgatcgatccagcctgcttgcttgcgctgattccatatttgttgttctactcctctgctgaagccatcagcagacacaatttggtacactactacttaaatccctattatatgcatatatacatatctgttctagcccctgatctctattcttgacttgctgctcattatgagtttcacatgattggtaggaaggaaagaaaaaagggagtgcaggctagaatgctagattattcagtactaaagtttaaacatcaccgtccaggtacagatcaaatcctctccttctgtcctgtatatattgtattggaatttaatatatgttttcaggttgctgacatcattctgttgattgctattatgtctacaaaagtttaaggattactgcagctgcctatatgatatgattaagatcttttgcactgtaatagttgacagattttcttggtcatctgtatatgttttttttacactatatgaatgtcgtgctaaatcaaaatagctttatataggagcagcaaaattttactatgaaaatattattatagaaaatggatttgaaatgtatattattatgggttctcaaccatcttctcctaacagcatttgtgcccctcaccaatagcctgctacgatggcccactagatgccatggccgcatgtgttgttcatgctggtggcagcgatggtggcatccaggcccacatcaaggcctgcgccacgctgggagcaatctgctcctccgttgtcaccgcacataacaccatagtcgttcaggtatgctgctgaatttcttccttttcagtttgctctcttcggctgatcggctcctatgcgggcttctgagataaggaggagaagaaatgattaggctgacgccagtaaaatttctctctttaacaaaagcgttctatgtgcttggtaaaatttttagtggcaaatctaagtttattctcaaatacatttgttcctgcaacttttttaattataatgtcgtataacttttatgccagctaacttctgcgtaaaaaacttttcactaataatgataaaatattgaagatgacagtgcaccatctatgtcaactaccagaaatgtacaggttaaagatgtgtacatcatccttcataatgaaatcctgatgtacatcggtacatatatatgccaattgtttctggaatcttaacaaattggtctacaagaatatatacttaaaaaaacctttttttattattatcaattacgctcattcaggattgtagataaatgtatatgatatagtactacatggcagatgtgattttttccccaagatatatacttcaaaaatataaaaagttagttggagagttcaagttttgatgttctttgcttagttgtcattttcctgtaaatgttaatgagtgaattctgaagtaatgtcagtattccttcattgtacaatactggtaataatattttgtgggcatgtcaatgagttttcttgctgtcacctttctatgcttctgtttttaggtatggatgttttcttattgtcttcttttgatgatatatgtggtcttcatatttcttatcagataatttaggtttagttccacgatagcatatcatgtttatgctatcagaaggttttgcctcaatttccttcctctccaacaaatcatattttatttgttaattcgtcgtgcgctaattcagtacacataatggtaacatacgcatttgcattgatggtattctttgtcgacaatcttatattggctattgtgatgcatacatcatcagaaattcactgtaagcctgacaatcttggcatattacccttatatttggatcatgcagttaattttctatgagacaaacctcagggtctttacggctcagtatagacagataattgtgccgatattaaggtaatgatatgatttcatggtgcaggtcttttagcctcctatctggaggaagctccattattctacgaatcatattgtaaccaatacattgggtcaatattgggtctataagtcaaggcagtaatcacagattatgttgtacatctagcgaacaaatatttatttggttcgattgaagatttcagtatttgtgaactttactagaccgcaattactacatttttaaaatcagtgctggccctatgtatgttagctaacatttttcttgtgctatagtcatttctatatctgctactattgtttaatatttaatggaacattgatttcataggttagcgttgtttgcagggtgtttcagtgacactgaaaccatggttgcctgagaggattaaagccacaggtacttctgagttgtaacctgcatagttccattctcggttgatctgtgtagtccataccgattaacaatacatatgtgctattccaaagaatccaacccttagtatctctagctatacgtactgtgttattctcttttctgctttgatcataaagtattatttcaatttatttgtgtgtgacgaagtgacatgcacttcaaacaattttacatgagacatgtcatatgttccaatagggcacactggggtgtaattttttcttgacaagcattattcctactttcatttttttttcagcgctgcattgttttggaattttctaataacccatccttccaattgaattttttctttgcaaatatacttatagagttttcattataagctgacttcaaaatatgattttataacttttttaattcatgaaatgttatgtttgccccttctccaaagctacagagatatttcaacacggtttcttatatgagtatttgtactacctactatatactcattgtgtagcaatatatggatgacatccaaacatgccctgtattctataggggatacctcaaaattctgtgccattatgcaaaggaggtaccaatcgtctactaatctgttgtaagtgatgtactgttgtttttattaagctaaagcactaaatttttctttgtgctgcagtgctatagatgagaaaagattcaattagttcatgacgaaggtatctatgagaaaatgctgcaattctcatatcacctaatgattgttgttttttctaacctatactccacattatgtaagatccattctcctctgtcattgctacttttttgtaagtgtacatgattgtacaaacaattatttgagcaaacagattgtattcacatttaaatcttggtgatagtcacaatgtgtacatgcatatgtgggtatgcttctgacataaagttcttttagacaatgtttatatataattcttaaaagttacaactgtagatactgtggctgtgttcgtttgggtgtgttgggaaccaatctcctgaccacagaaaacggagtggtccattagcacgtgattaattaagtatttattattattttttgaaaaatagatcaatatgatttttaaatcaactttcgtatagaaatttttttgcaaaaaatataccgtttagtagtttgaaaagcgggcacgtgaaaaatgattgagttgagttgagaaagttgggaaaagaagtcacctgtgttgttttgatcttaataacacagcttgaaacatttatacccatgcacgcagcgtagcgcgtgattcttgctagtatatattgaaataatctagccggttatttttttaaccatcaactttttttttatgattctccttttaaccaacagcatgaatttttcagagggcggtgcttgcacacatgagtagggatatgacgacgcactaccggacaatgcctaatctctcctggttcgcacctttgtagtcccggttggatgtttttccttttttttttccattttttccctcttaatttttagtcacggttggtgttcccaacatggaataaaaagagtagagggatggacactttttcaaccgggactaaaaatgatcaccaaccaggactaaagatcataaaaaggctatgggctttccaaccggggctaaaggtgatttttagtcccagttcttttttgaaccggggctattgtggttttgggtcgacctaataaagatcagttctccagtagtgacgcctgcgcatttattgttgtagagatatgtgataaaaacataatcataagtaaatacttttgaatagggatttaataacataaattttgtgtcaggtagatttatatcctaatagagtaatttttagtcaaaatctcgtcctaaagaaacaaaatacatctttatttttttttcaaaccaacgagtaattgcaactaagggcacttgatcggtcgataacatactcccttccatagtagaaaaaaaagaagggaaccagaggtaagcggttaggtttccttgacatgcaatcgaaccgctttgagccggctgcaccggccgggtttttggcgaactggaccggcagccatactaacgggccacaaatgtgctgtctaatggcccatttgttaacaactagtgcagctggtggttttttttttggcaaaaatagatggaaaaggtgcactaggtggaaatcgaactttggtcctctggtccaggagttgaaagagcaaagtcctatagccatcatactatccaacaacatataacataagggaatatgtaatatatatacatgtagactgtgaccacggtttgaccgcccgggtcaccggtcggaccggcggaccacttaaccgagaaatcgaccggatcacccaccagttgcattagtatggctgcttgtccaactagttccagtttaatgtctggtttgccaaaaaattggccggttaagtcggctcaaagctattcgattgaatgtctggtctttgaaggaaaacaaaccgtgcttacctctggttctggttttttcgttcgaaccatcggtccggtccggtttttctactatgctgcagatctaggtacttccatggagacccagccagagttgaagattgaaaaggaataaaaagaaacagagagagaaaaggataaaaggttgttattttagtatcactccaggttcctataagtttatgatgaaacaagacattaatagagttgttggaataggtgtttctgtggtagtgatgtatttgataagcaagtatgtagtgtgtgattgattattagccacattttgtcataaccaaggttagataagttgtggtagtcacaaaaatatagtggataaattgctaatcacaaagtgtgacaaagttagcaagaaaattgagtctatgacacgtgattaacaaactgtggtagccaaaagtatagtgtggcaaagtgtggccataaaccaaacacccctataggacaacatcatgcacatgagcagctatacatgatgcatgatacatgagagaaaaatataaatattcaccatacgatactttgacattattgtgagcaatttccataacaatgtgtgacaaactagataatatgttgctctcattatatttcttctactcccacgtgttgtatcggatgtagataaagatctctttttctagagacggtcacgctaaattgctcctccatgtccatcccatcatgtgttacaccgtgagggagatgccaatcaaagtggtatagaagagcagtgagagccaactctattgttgcatgtgcaaatgtcatgcctaggcacatcctccgtcctgccccaaatgatataaactcaaaatgtgtacccttaaaatcaatggttgtgtcctcgaaacgctctggtataaacacttctgcgtcatcccaatatctatggtctctgccaatagtccatacattcacgatcaagattgttccctttggaatatcatatccaaggattttacatgactcttgacactttcttgggacaagtagagatgctagagggtgcaacctcatggtttccttgatgatgttctttgggtactttagattaatcaagtcatcttcagttaccctagactttccttgcaaagcatgtcgtatctccgcttgtgccttctgcatcacttcagggcccattcgagtgttgttgatgttgtttcacttccacccgcaaacatgtcctgatgcatgtcatacgtacatacatacatacatacatacatatatacatatatatgtatatatatatatgtatatatatatatgtatatatatatatgtatgtatgtgtgtgtatatcacatcattgtaagaatagtaagatttattttatccactttatgaatggtggcaggaaataacaagatgataaaaaaatcaatatacaaatatactctctttattctcaaatagattgtgtttagaataatgtagtgccactgctggagaaaccatctttgttgggttcgccaaaaacaacattattcctggttccaataagaaccgggactaaacattatttttttgtcccggttgaaaagccaacgtcacttttacaccaatcaggactaaaaatcatttttagtcccggttcaaaaagtgaccggggccccttactatctttagtcccggttggtattgccgaccgggactaaaattcaacacgtcgtatataatccctcgcacttatcctcccctcctagatcacaaacactcccccctccctttcatcctctctccactctctctttcctctctctcttattctctccttttctttttctctcttattctctccttttctttttctctcttatcctctccttcactttttcttgtagcaatagagggagcgagtggcggcggccccatgcggcgacggcgacggtgaggcagtggagggaggcggcgcgagaagacggggtcccggtagattaaagtgttagatttggttgatttatctgtgaatttgttcatttgtgatgcatttggatctgtaaatttgtgatatggatgatttttgtgaccgtggatgattttgtgatgtttatgtgaatgttgatgattttattatggagtttggctagaaattaatatgcaaacaacaaaaaacaatgaaaaaatgactaaagatggtagcacctgccacgtgacactaccactaaagatgggcatctttagtgacactatcactaaagatgggcatctttagttccggctatttcaatcaggactaaagatgggcatctttagtcccggattcggggtcccggctatgtacgcgggattaaaggggttacgaaccggaagtgaagatgggttttccaccagtgtgctccttaaaatcataacacgctgcatgaataaatactaagatttgatatttcaaaatgacattacttggctgtcgtagaaatatttccattttttatgccaaaatgatcacattagtacataaaactactttcatcttgttataatatcaaaattttcaggaatatgtgattcaaaatggcaataatcaaatatgtgcaccagaaaccaaaatatatatgcgttgatcccctaaaggtcaagtaaaaaggaccaagaattgacctagctatatggcttcaactagattttgtttgttgcagaagtaacaatatgtgaagtagaaagggaaaaatgttgccatcagcaagatattctagtggcagaggtgatgcaaagagggagacaatgctttactttcaggagatccttttgggccgaaagaggtagatgaatggcatgtgattagttcgctgattaattaccaacctaaggcccaacgatgatcctgacaatttgatgtgtcaccggaaaggctaacgcgcggttgatcgctggcagcgatcgttttcttttcttatttttttctctgttagtaagtttatacacctaaagtttacatatctaaagtttatccacctaaagtttgtaaagagaatgtttataagtcaaaagtttatatacccaattcaaattcaaattcaaattttttatattttcctcttttagtaagtttatacacctaaagtttacacatctaaagtttatccacctaaagtttgtagagcgaatgtttataagtcaaaactttatatacctgattcaaattcaaattcgaattcaaatattttatatttttctcttttagtaggttgatacacctaaagtttacacatctaaagtttatccacctaagtttgtagagcgaatgtttataagtcaaaagtttatatacccgattcaaattcatattcgaattcaaatattttatattttcctcttttagtaagttgatacacctaaagtttacacatctaaagtttatccacctaaagtttgtagagcgaatgtttataagtcaaaagcttatatacccaattcaaattcatattcgaattcaaatattttatattttcctcttttagtaagtttatatacctaaattttacacatctaaagtttgtagagcgaatatttataagtcaaaagtttatatacccgattcaaattcaaatttggattcaaatattttatatataaaatatttctatacacaaagtttatgcgtgtaaagtttacggtataaagtctgtgcacacaaatgagagtattagaatttttttctcctaattttcttttacgattttttttgaaatttatgatgtaatagaaaagtaaaaaaagagagatgaaagaggaggtttagggggga

SEQ ID NO: 38291 - DNA, 10341 bp, Oryza sativa
atatcggagttagtttggtagacgtactgatgttaattcggttaatgtagtcctttaccaaactaaaaaacggagtgaacatatatagcgcgcggacaagcacttacaagaatgacggctttgacgtttgccatggtgagatcgccgccatcatcgttgttgtcaccttccttcgggatcctcagaagagtactcaacaggcactccctattgccatgcgtgccgccgtcgtcggcatgctcctggtgttgctcgatggcgcggcccaccatgtcgtacagcttggcgctcagcagcttcacgtcgcgcaccgcggatgtggcggcggtccggacggcgtgcagtgctcccccatgatggcgcgcagcgccaggtcggtcatcggcctaccgatcagccttcggacgttcaccggctcgccggagggtgcagcggcggcgacgacggcaccgacgaggcgggtgtcctgctcctcgcggatggggcggaacgagcgcacccgcttggcgctgagcagctcgagcgtgcagatcccgcggaggtggcgccacctcttgccgtacggcgcgaagaatagcccaccccgtcgccgaagttggcgctcacggcagtgctcatggcggcgtcgtgcgtcttgagcacctccctggcggcgtcgggggtggacgccaccacgacgcggagctcgctgaggcagaggtacatgaggggcgccaagtcatcgcaccgccgcacgaggtcggccagcgcgcggtgcaccacctaccggttcatggctacgataacataaatcaaaattttctatcgcgtaaaccagcaaccatgcaagtattagatcatagatcgttaccactcgacgcgttgcgcagcggaagaagacgctgagaagtcgaaggaactctcgcgaagtagcgcgcgtcgatgtagaggaagtagtcaatcgcaccggctcgaccttctcctcctcgtgcgttctcctcgccgtactcccacgccaatcagcaccgcaaactagcggcgcctctaccggtatccacacgtacagggacggaatgccacgcgcagatatgctagcacccgcgtgcagctagggttttgctcggggagggaagtgacggctagggtttctcacgtgatgcaatgcctccgccagtcacacccctcacgaatatatatgatccatcactcgggcctccaagacccgtaggactcctatttggatccctatccgaattaagctcatattggatctctatccaatccccttattccggcccattaagcgtgcgaccctataagttcatatatactcggctgtaacccgaaaactccatttcggtccacgcatcaacagcggcccctagcagaacatattgacccaccgggcatacataaagatcatattggctgaacctctagtgtatacttgtatgaacccctttgcctcacgatatcgattaagctcaaagctagatatgtgccatcctctaatagctcaatcattcactcgaacctgttgatagattatataacttatgattgactcctcaatcacctttggcatggccatgcacttccataatctacaacatcgaggggctcagagatatctctccataggaggggcaaatcccatcttgattattcatatcccactacatgtttcatagcatacccgaaaactacttttataactacccaattatggagtagcgtttagcagtccctaagtaagctactaaacatgttgagatccatgataatctcattgtctaaggattcaacaccaacactcaatgagatcactgatgacacaacacatatggctcttgcaatgtcttatgttgggtctatccaacaacatattcaccaacatgtgtccacattattaatttggtatctctataccatgatccatgagatatgatcattaattaatacatgtgctgatcatataaacatatttgttccacatatgatatttgatcagggatcctttagaaatagtaacaaacaacataaaaagtctcatgaaaaaatcacatattcattaaccaataaggagttatctatttcaagaaacaatgtcggataaatatgtaaacatagtatgtgatacaatcatctctatgattgcctctagggcatatcactaacagtggcagcctcagtccatccgtgctggcgttctcgcgacgacgacgtagtttcagcgaaactatgtggataccggccgggacaaggagcagcagcagtagcgtcaagttcaagctgcaactccataggagattgagctcatcagtacccgacttgtccatggctttttccaaatgcaaaccttttaattaacacaattaagctatgcacttgcgtggaattataaatgcatacctaagatgcatgcgataagttagtgttgtctgatttgatgcatgatatcccccttagggtatttataggaagcagctagctacctatacacgctttactttgggaattaaagcaacgctaattgggaaaactgctggatgttgcgcaggagacgagaaatctgacagctaatgaacgcatctttcgcgatgatttaaaagcaaagatcctaggcttggctgtccttaataagatacagattcgacaatgatcgaggttaacgtggttaaaggaaggtgatgttaattccaaattctttcatatcaaagcaaactcccgtaggagaaaaaacttcatccagaccctgcagtccccaaacggtttagcagtctcggcctaggataaggctgatactctttttcgcttctttttggataagctgggaactccatcacaaagacagtcttgcctcaattgggaagcactcaacttcacatccttcgatctagacgatcaagaagacgatatcacagaagaagaactaaaacaaacagtattctccatgccgtccgaaaagtcacccggccagatggtttcattggagctttttttaaaattgcttgggagataatcaaagacaatattttgctagctgctcaatccttcttggccacgaacacaaatcaactggaaaggctgaactcagccttcatatgcctcatcccgaagaaagaaggggcgactggcccagaacactgtctccttataagcctaatacacagcttcgcaaagatcttggctaaaatccttgcaaatagacttgctccgtgcctaaatgaattagtttctcaaaatcaaagtgcttttgtcagaaaaagggcaattcatgacaatttcctgttcgttcagaacctagtgcgtaccttacatagaagccatacagaaaccctctttctaaaagttgacatcaccaaggcttttgatacagtgggatggccatacttgcttgaagtacttcaaaggtacggttttggtaccagatggaggaattggatctcaaaccttctcgcaacctcctctcccaggttctacttaacggttcgccaggcactgcattgcagcatgccaaaggacttcggcaaggagatcctctatctccgctcctgtttattctcactatggagccgctgcacaaactctttcaagttgcggaagaggcctccctgctcactccaattggagggcgttttagcaggtttcgatgctctctatacgctgatgacatcgctttgtttgtcaagcccgaccctattgagattgatgcagttaaaagggttcttaatttatttgcccaagctttaggcctccacacaaacctgaacaagactgaaatctatcctatccgttgcgacaccaccgacttgacacatgtcattactcctttccctggaactttgaaatccttcccctgccgctacctaggcttacctttacattttcgaaagcttaggaaagtggatttcttgcctcttattgaaaagattggatcgcgtctccctggctggaaaggatgctacttcacgtcagaagggagaataattcttgtgcaatcagtgttgagtgcattgccgacctttcatctaactgcccttcaagctcccaaatgggtaatcagcagaatagatcgttaccgcagatccttcttatggaagggagaagacccagacaaaacaaatccgggaagtagcttggtaaattggggtacagtctgtagaccaaaaattttaggaggccttggaattccagaccttgagaaattttctcgcgctctaagactacggtggctctggttcaaatggaaagaggacaacaattcttgggttggaatggatttaccttgcgatgactgcgacaaaagactctttcaggctgccactacaataactgtgggtaatggagaaaaaaataaatttttggcatgataagtggctgcaaaatgcatgtccaaaagatattgcacccctgtgtttctacctagctaagcgcaaacagagatcggttaaaacggaattgacaaacaattcttggctcctttcctttcggcaaataactacaattgaagaaatcaacgatcttgtctagcttgggggaatgctgcaaaatgttcagcttctaccgcaaaccaatgacgacatcatttggaacctgaatgaatcgggatcctactctgcaaacaatgcttatttatttcagttccaagggtccttctcttcgattgattttcattccatttggaggtgcccagctgaaccaaagatgtgcttctttggatggctaatccttcaccaaaaaactctcacggcccaaaatcttttgcgccggcactggccatgcaagtggatttgtagcctgtgtggagaggcgtttgaagacactaaccatctcttcaatgtttgccccatcttcagaaaaatttggcttatggtgtgccaatggcaaaacatcccgggggcacagcctgtagatgacaacgcagcttggtgggctgatctcaatcaactacaccctaaacctttcaaattcagggttaaaggatctcttctcgccacttggtggaacgtttggttggaaagaaatagaagaatttttcaaaacatctcttacacagaggatcgcgttgcgagaatagtaaagaaggaacttgatctcagacacactgctttccaaccccctaattgtcttttctttttcggattccctttgttctttctggtttctcccttcttttccttcgatgtcttcccctgtattctatgaactgtttttctctcctctaatgaaattaatgaaattccggcagagctcctgccgtcgttcacctcaaaaaaaagaaaaaaagaaaactctattcactccttatagggtatccctcttttttcatgttacttaaaaaatcataaaaaaaagattaaaaaattagtaagataaatcaataggtgatatatcacttcacaaacatactcattcaaattcaacttatacatgtagaaacgaaaataataaatttaactatgaatataatgtatatataattcacggtcaaatttgttatttttatttgaattgtacatataagttgattttaacttgcatatttgtgaaaagatatatcatatattgatctatcttggtaaaaaaaatttcgaattttttatgattttttgaatgtcatgcacaatatgagaggatgttctctggaggaaaaaaatcacttcccgctaatagaatcatttctgttggctatacaaatagccacgtcaacttattgtagctaatgccagaaagtcaataatacaataatatatactatacatgtccatggctgcacggctgcacgtttatggacaagtatgttttttctaatctcagctttggattcatgattggccggttggccgctgagaagaaagaaggtataactactaagaaaagcattatcgcaagcggtcaaaacggtcttcgcaagcggggcggccgtccgcctgtaagccaacgactgtgaagatcgccgatcttcgcaggcggggcggctgtccgcttgcgaatataattttcgcaggcagacgttggctagtccggtccgcctgcgaaaataggaatcggccgcctgaaaaaaaaacttccgcctgcgaaaataggtagaaaatattgaaatttaataataatttacccgtaaattacttttaaactatttaatagaaattcttgcaggtagaatattatgtacatatattagaagattatcaagcatttggtactgataaatgtacatatattacattactcaaaagtgttgccaaaatatatatattacaatattttttttacattgtcacttcaaatacgccatgtagtaattacattatggtatagcactgttccactcccgaagatcctttaattcgtcacttgtggctagggcaccctctaggtcgaagaaatctcctttcacatgacagcactcatggtggatgaagtggcacagatcacgctggatattttttatgcctgtatcgtcaacgcttgttcgacattctaatcttggcaactgcatgcattgaagataaataatatattagtgtcataaatatatgaagctgtctagcacatagtatagagacttagatcctccgcgttagtcatgtacctcccattaactttaaggaattagcaagcgtaatacccgcaaaggacagttcctcgtggttgcttgtgacacttcatgacatatcataaaagatagttaaaatttgcaatttgtgaaacagttggtatacattaagtgagtggagtattaccggccaataggtacgtactagcagcttctcccttgttcgggtctgttctccacccttgaacttgtagtactagtacgcactgtatggatatcataccgtttcacattaaggaggatatttatttataatacattcatataaaaatgcaatagtcataatcacttactactgtaagattgttagaaattctttatatgactggtgtttgtaatcgagagggtccaagactaccacggttccgtctttagggtggatgagtaaacagatataatgatcgctacatattaacaacatcatagttagttaataccagctaaaataagacatatgtgcagaagataaatgtacccgacttacttaaaattataagcggctaggacaactctcttattttgaaagtgcaagaagactcgtccaatgtactgtgcgacagtaatcaatttctccttgtgcaagcccttcttgtattcagctatctcttttgaagtcttgcccttcagctggtctgaccctggtgctaggctcacagtatgttgtgtttggcagatccgagttggatccaagaagccgataggttcttttgtcttcttagcatctatgtattgcatcctagagaagaagtttgtcagtaacaatcacatggatttgtattgtacatatttttcatataattaattaaaactcatactcacatgcaccaaacaccgacgtagttgacgtccatcttatcccgacgatatatggcgtggagatatgagaaatctagccatacgtaaccttcttcgccgaaacaatctgccggtgatcgagctgttatattgcccaagcctttcttgctggcctgcatgtagaaggtatgtaaccttttcatctcccatggtacttcgttcagtgcccattccggcaagagtgctttcccatgttcgtactcagccgggcaatcatcggttgcgaagtatgttggcccggctagttcagcggccttctgggggtcatcatctctgagcttggcacgttccttaccccctctgaagacgattaccatgaacctctccttgttctcatctttggactttggagtcgtggctcctaagcactctaggcacctcagaacaggtagtggccttctcagggaccgtggtctcttgcacctcggggtctttcgcaggagaagggtcttcaaatatttctggctctgtaccgtcccattccaatcctggtacttcttctatttctgacccgactgatgccacaaattgcaccctctggttatgccactgtaatctccatgggtacttccgacactggaatctccatggctgcctctggcattgcaatctccggtggcacttccggcactggattttccttttgcatctcgggttcctccgccttatcagtcaccttcctcttaggaggtctcggaggttttcccaaccccagttttggcaccacaggtttttgcgtggcgtcagtgcccaatccaaaggatatgtcattcttgtgccagagaattacaagatcgaccgcatccccaagtacggatacaccatctgcagtcgagaagtcaatgtcgtaggactcaaacccatcgtggaccacttgcggctgcaccttggcatacgcatcgggtataaactcttcgttgtatgttctcccagggatagcaatggctatagcggcctcaagagttttcccagagcgtccaatgggaatgtgcaatctgcagggtgtattctctttgaggtcatcgaaggggtaatctggctcaggttctttggtttcggggcgaggcaaaatcatgtgcttgacgcagaaatccatcatttgcctttcaaactccgcagccccttcgtctctaagtttatccttgtacgcttcacgcttcttgtgggggtcatgtttgaacccttccttccaactcatcttgctcgacacatctcgaacccttcccccatgctcaggagtacccagccctgtacttagcacatctttctccctcttaggcttgaaaaatcctttcttctgtgaactggataaattctctattttattggcaacgctctgcagctccggaaattcaaacgatacttttccttcatccgtgatcttaggagttctagctcttacccagttccttgatctctgtgtccattcctccattggtaccggttgccccttcttcctcatttcctcctcctcttttgtccactgctccacctttggtgcgtatcccgtggagcctaagcgatgaggaaatttgttcttcttggccaactctgcatacttttggctcctttgaatttcttccggggagttcttcaacgtcagaaagtcgtcccactgattcagggttatgttggcatacgtcgaaaacagtgtgtgtcctgtcttcacaaatttcgtgttcaaggtggtttttcaaccacgccaagacttggccattgtttgcagtgcacaattcctcactgctgcctctgatccatccgggaattggaagattttcttcaactctttccataggacttccttatccccattcgatacatgatcccagtccttgaccgtgatggggatcttttcccttactattatgccacactgtgaactgaatttcgcacgtgccgtctttggggcgagcggctctccttttggcgaaacatgggtaacaacatggaacccttcatcctttctattgacgcttctctcgcgcttccttttcttcaccttagctgaccgttcgcttttctttgagctggttgtgttagctggtacctcgtcaatttgcgacagaactttttcttcagctgtctttttgatcgctgtggcgccgtttcctacgagaaggtatacatgaaagtttcgaattagctcgggctaatagttatcacggttaacagtttacatattaagtttacttaccccttctttagggggaatgtagtccttgtcgccttcttcaccgtcgccctttttccttctcttcaggcttgggcttggacaaggatcgcttggcgacgagtactcatcgtcttcgtgagcaacgtcgctgtcagaactatcttctggtgggaccgttggttccggaccaaccacaatagcaagggactactcttgctcctctaaacccttctcttcagtccctttagtactatcggccatcgtttgaaacctctaacataaaagaaaaagttatccctcacattttaaattactcaaattagtacaaacaactttaaattgcgaaattaattactacttactattatgctagtatagatatgttattaattagtacttactattatgctaaattaattagtacagacaaaattaaattgcaaaattaattactacttactattaagctaaattaattagtacaaacaaatttgtacaaaatttgaaaagttattatcaagtagtgcactaattcacaattacatttcctcgacatgttgtttaacaaaaaattaaaaaggcaaacatatcctccacaatttttttaaaaatatgttaacataacctcctacatgttatttaaaaaatttgacaaattcacatatcctgcaaaattgaacataccctcccaattccattcacatatcaccca

SEQ ID NO: 38292 - DNA, 3617 bp, Oryza sativa
  unsure (1)..(3617): unsure at all n locations
nnnnnnnnnnnnnnnnnnnnnnnnnnnnnnnnnnnnnnnnnnnnnnctgacgacatgaccagtgtcagaccggtcacaaatcagtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgtcacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcttggagatatggtgatggcgcttcggtcggcgagcgtaattaatgcgcgcacgagatgttccatctcgactgccacagccgcatatccacctcatgcaccgcaaacgggcgaatgggattagtggaagcgtgggcgcgagaaacgagggggcaagatagtgggcgcgagaaatgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtcatggcacggggctccgctccgcttgacggtagcgtgctgccgccttcccgcatcgtgaacgagagacaggccgggctgccgcgccgcttcatgccggaatctgccaccggccgggagatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcttatcccttcggctgttccggtggttcttcaccgtacagccggtgtcgccgccgtcggtggtcggtggttgctacctccagccgcgggcgccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcgaccgcctggcgggcctgcgatcccaggggctcataggggccatggtgttcggcgactatcttcgtcgccggatcgcgccactccagcagcgcgcccggggcgcctgggagtacaccgggtccgaggactgtatgaggacccaccagggggtcagatgggattgggctcctgaggacttcaagatagtggtccaacgggtgctgaatctcagctccgtggaggcatctctcattcctcaaggagtcctccccctctgcagcgatccagaccgcgcctccatcctgaccatcatgcaggcggtcggggcgtcggaggagtgggctcctcgaggccacgatggcgtgggcgggagccgcaggggggaacaatctaccccgggagggggtcgtgcttccgggccccgcgacgggggcccggggagcggccgccctgccgacgcccgggggaagaggaaggaggaaggaacccctcccccatctcctccccgagggggcggggcggcgcgtgccagcagcaggcgcccggagggggccacgccgacgtcgcagcccgagggggagcggaagaagaaacggctccgcaagatggggggggacagaaccatcccggggaaacctcatttcccctctaaggtggtcgtttaaccgaccccctcgcaggttcgtcccactcccatcgtggccgtattcattctctcaatgcgagttttcactcatccatcttgtttgtcttctggtctttcttctgtttcagcgagatcccgtcgcgtccctcctgccattccaagtccggccagtctgaggccgaggactcgacgaccacagaggcccggaggcgggaatctgaccggcgagaagccgcggatcgccttcgggaagccgaggaggccgctcgggaggccgcccgggctcgccagaccgaggaagccgctcgggaggaggccggactccgccaggccgaggcgacgacatcctccgaggcgacccgtgaaactgactggcaagaggccgtggatcgccttcgagaagccgaggaagctgcccaggtggccgtccgagctcgccaagctgaagaagccgctcgggaggaggccagacttcgccaggccgaggcgacgacgacttccgaggcaactcgcgacgaggccgcgggcgcatcgcttgggcccactccctcgtgcgacgctcaggacaaaccaggtccgggggacatccccgggtccggcacgtccatcggcgggccaagccgcgcggcatcctcttcgaggcggctcttccccacgccttccgttgctccactgagcacagaaccccttctacaggccttggccgtcgcaaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcacgtctcagagctcgaagcccgtcggaaggtgctgggggagatcgccaaggaggtggaggaggagcgggggactgccctcatcgccaccaccgtgatgaacgaggcgcaggacaccctccgccttcaatacgggagctgggaggcggagctagggaagaagctcgacgccgcccggggggtccttgacgctgccgctgcccgagaacagcgggcggcggagaccgaggtggcatcccggcggcgcgaagaagcccttgaggcccgtgccatggcgctggaagagcgtgcctgcgccgtggagagggacctggcggatcgcgaggccgccgttgccatcggggaggcaacactgactgcgcacgaggccgcctggggtaccgagctcgaattcgccctatag

SEQ ID NO: 38293 - DNA, 3916 bp, Oryza sativa
  unsure (1)..(3916): unsure at all n locations
nnnnnnnnnnnnnnnnnnnnnnnnnnnnnnnnnnnnnnnnnnnnnnnnnnnnnnnnnnncaacactgactgcgcacgaggccgcctgtgccgaagaggagtccgcgctccgcctccgcgaggacgcgctcaccgagcgggagcgagctctcgaggaggccgaggccgcggcgcaacggctggcggacggtctgtccctccgcgaggcagcgtgggaggagcaggcgcgccgtaatctggaaggtgcccgcgccgagagggccacgctgaactagcgggccgctgagctcgaggcgcgggagaaggagctggacgcgagggcgcgcagcggcggggcggccgcgggcgaaagcgacttaaccgcccgcctcacagctgccgaacacaccatcgccgatctgcagggcgcgctagactcgtccgccggggaggtcgaggccctccgcttggcaggcgaggtagggcccggcatgcttcgggacgccgtctcccgtctagactgcgccggccggcaggcgggcctctggggcgggcggactgcgaagtatgccgccaaccaggggggcctcgcccagcgcctctcggagatagccgggactctccaacggctccccgaggagctcgagaggacgattaagtcatcctcgagggacctcgcccgaggagtggtggagctcgtactggcgagttaccaagccagggatcccgacttctccccatggacggcgctggacgagttccctcccgggaccgaggacggtgcgcgcgcgcaggtccgggacgccgccgaccatatcgtccacagcttcgagggttcggcccctcggctcgcgttcgccctcaactccgacgaggaggacgatgacggcggagtgggcgacagtggcgacgaggctggcggcccgggtgcattggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgagacgaggatgtctgtgccacggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgtcgattcccccccggagttcaccacgccccggggcacggctcggttctgggccccgtttggcgattttagccgacccgagcccccgagggcaggattgaacacgagtgacctatttcaagtcaagatccttcaaaaggaaacaacagcacagatacagcctttaggaaatcgaaaatgcttttattgaaatacagatataagagaaataagaatatgcatatgtggtagcccccggccaaccctgcacgcccgaggggggtgcggggttggcccgagcccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacatggcgctgatggtagcgccacaggctctgctggtagcgcgcggctcggagggccgcgcgccgccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcaaagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgtgacatacagatactcaaacccgcccggggcccgcctaaaaggtcccaggatatcgagcccccagacagcaaatggccatgaaagtggtatgatctgcagggcctgggccggctgatggatttgcttggcgtggaattgacatgctctgcatcgccagaccaggtcgaccgcatcattgagagctgtcggccaatagaaaccttgtcgaaaggctttgccaaccaaggtgcgcgaggcggagtggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttctcggggttggccttgatgcctcgggcaaagaccaaaatcccgagaagcttgcccgcaggtacaccgaacacgcacttatcggggttcagttttatgcgggcggagcggagactctcaaaagtttccgctagatccgagagtaaggtctcttggttgcgcgtctttacaaccaagtcatcgacatgagcctcaacattacgtcctatttggctacccaaagaaattcgagtagtacgttgaaaagtaggacctgcattctttaacccaaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggccttgcgcccgaccgcacggcgagacggtgctcaatcacctccctggggaccccaggcatatccgccggtctccatgcgaagacgtcagcgtttgcccgcaggaaagagacgagcgcgtcttcctatttgtcgtccagaagaccaccgatccgtgtggtcttggacgggccgtcgcccagggcaacctccttgaccgggacctcgtcgcatgtgactatccgctgcctcggggcggcggaggcggaggtgccaagcctctcgtcgcctccctcgggcttggacgcggcggtgaggtggtccgcgcgctgctccatacaagcaagcgcgactttaaggtcgccatggacaaagatggggcccccggggcccggcatcttcatctggaggtaggcgtaatggaccgccgccatgaacttcaccaacgcgggcctccccaggaccgcgttgtagggcagactgaggtccgccacatcgaagttcacccg

SEQ ID NO: 38294 - DNA, 2169 bp, Oryza sativa
  unsure (1)..(2169): unsure at all n locations
nnnnnnnnnnnnnnnnnnnnnnnnnnnnnnnnnnnnnnnncgatcttttcgagcatgcggttgtgccgcacacccccctgaacgcgtagatcaccgcgtgtgcagggatgcatggtatggtgttgcggacttgacagaaccactgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcagcggggttgacgctcccgtcatatttttcggcgatggtgggccggaaccttgggggccaacggacgttccgaaggctcgccacaaaggctctacagccaacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaaccaccgccgctcgccgcgccctccgccttgacgacacggagccggtggtagcagctccagaggtcttggtggcggaggactgcccaccagcacctaggcgctgccgtgccgtcatgaccaagttggccacgtcgtccagccaacattgggctggagactccgggtcagggacaacgggcgggtgacgtaggagcgcgcccgcagcttggagtgcgccctggggcgtgctgccgtcgccatagacgaggaggcgacgctccccatctcggcgccctcctccatcacccgtggatgtcgaagtcgcggatccttcgaccctctcgagcgcctcctcccgcctaggactttggcgtggagggggcggtggagtacgagctcgacggcgtgggtttggctccccgtcgtcaccgctaacactcggagagaggttgtgcgcctttgcttgttcagccattgggttgaacaggaaaagcttggcgcacacgaaagagtgcgagagcttagaagaacacacgcagaaccccctacctggcgcgccagatgacggagcgtggggctcctcaccgggagaccgcgcaggcccccctttgccggttcggccgggggccctgggtgagattctaagctctcggtgtgtggaaggttcgcgagaatggaaacacacaagacacgggcgatgtatacaggttcgggccgctgagaagcgtaataccctactcctgtgttttggtggatctatgtatgaagaagctacaaaagagctggagaaccagagagctcttactctctccctctctgatcgttctggatcccttccaaacaaaatctcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgtcacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaagggg

SEQ ID NO: 38295 - DNA, 653 bp, Oryza sativa
tcgatattttggggagctaagagtgatttggttgtgccggttttgggaagtctgagagcaattgggattcgggggtgggggcgaagacacgatcgtccgtgctgtgacgaacgggaaaatacgattctttatattagttaagatttaaccatttatcttataaaaaaaatatataattattatttattttattataacttgatttatcatcaaatttctttaaatatgatttaaaaaaaatttatatgcaaaaaattttgaataagataaatggttatatgttgatagaaagtcaacaacgtcatatattaaaaaataggtaatatatacgtagaatcagaattaattaacatcacaggctcacggctccaactttaaatggccaatcaagaatggataaacatggtaattaagtagcaaagtaaactagctctaatacagcagataattaaagttgtcgttcccagtaatgcacggcacgttggaaaaattccatgcaactactggctttcctgccgggtctcccaggagttgtccatgtcaaaattttgacacaattcacgaccgattcgacgccagcagccacccaatttgggggggttatacgcgttacgtgagtgcgttctgtgcgtaaacccttttggcattttgca

SEQ ID NO: 38296 - DNA, 1043 bp, Oryza sativa
atctaaatttgtcttttttgtttctcgatgtgtagatcgaatttgaacatgaattttggtggactagtaggtatcattatactctacattgttaatttttttcagattttttcacaactatttgcatcgaatttgaaagaaaaaggtatacgaggggatatcccctcgagggattagaatccactcctcatatagaacgacatcatcattggagcagtattttgaaacccccatcagggcagacagaagaacgacatcatcattcgatctcattaaacaatagtcgcgttaacatcttcgagaagaagcttctctttgaattctcatgccagatttaggcaacacggataagataacacgagccaactcgatctactatagtgcagagcccaacatagcacgaggatagcaaaaaaaacacggtgtatatcatcagcatgcatgatagttacaacacgaggcaccattgaaaggaacaagaaataaaagcagcaagttctgaaaaaagaaaagaagtagaaaagaaaaagaaagcaacacaatccatgcacgcacgcagctagagccatcgagaacgaaataaagcaagaaaagcgtgcggcgacggagctctgtttcccgaatccttcttctccaccgatcgatcctcgggacgatcgagaggttggcaggcaggacgatcatggcagtctcggcttttgggctttttcgaacaagagttccagtcagtctcgtcttatctgccaaagggtgaaagtaggaagatttttgactgtggatgttgtggcgcgcgctagctgcttgagccacgcacgccgagcttcttgacctccaccttgagcgacttgaggtagcggacggcctcgtcgaggacggcgggggtgtccatcctgtcgccgccggggatgatccccttgagagtccgcatcatcttcttcatccgctccttcttcctctcgccgccgccggcctctggcttccgcccgccgccgcagtcggacctggacgcgccggacgagcacgtggagtccggcgagcccccg

SEQ ID NO: 38297 - DNA, 567 bp, Oryza sativa
tgtagatcccaattttagaaaaattgagagacttgaaccaactaaatctgagctaagatgaattagttattaatttttaaagattaaatcggattaaatcatttatatagattttaattcgattatgacgcaataaagaattatttttgaaaaggaaaaaggatttattgcgtcagcggggctcgggttcacggtggaccgggtgcacagaagcggtctacggaacgaacggctgagatctaatctaaacaaaacgaacggccaagatctaaccgatctaccacgggtctacggctgacgtggtgctgacgtcgatgatgacgtcattgccgacggcggctcggcacctcatgctcgccggcgaacgacggcgcggcggcgcaaacggacaacacctacgggtagagggcgacgcggcgaactcaccgagggctctgacgatgacggacgacaaccgacagcgacggcggcgaggtcgaggcggcgaagacgttcgggtcgacggcgacggcggtgctccggtgacctttggcggaaacggaggacgggacgaggacggctacgact

SEQ ID NO: 38298 - DNA, 843 bp, Oryza sativa
taagttcactttatgtcccttaagttgccccgattctgttccccatgacatccatactattgggctatatcatataaaactaaacctttatcatataatatttctatatttattatatttttttcaatgcacggacatttttcaatgtcaaaaaaattgttttaatttacaaaattagtttgctctatttaagctttttaaaacttttcctacttcatattaaattatttttatctaatggaattaaaggataattaataatatttttttttatctttttgaccaaaggtcactgcaattttatttcattattattattttgtccaacagtaagcatgattaaaattaccttaatccgttgcaatgcacggacgtcattgctagtatattttaaaaaatcaacggcaaaaacgaagggtgtacttctcacccgaactcctcgaggggatggcgatgaggtttatgttggtgccaattattggttcggtttcgacttgactgatgctaattttggcttatgtagaagtctacggtaagattcttctttttttaggtttcatgcccggcagtagtgttatcagttatcacttatcacatcccgtacgtcattatcttcaacagtgtcaggccagctgaataaatgttcttatgccagaatgcctaattaatgtacttgggtttcacagaaatgctgctactatggtttgtctaattcgacgtactactccacttattattgaaatattgacaattaatgacactatattcatgattaaacatttactccctccgtcccaaaaaaaagaccaatcctagcaagcatgtccagatacattgctagga

SEQ ID NO: 38299 - DNA, 2825 bp, Oryza sativa
  unsure (1)..(2825): unsure at all n locations
nnnnnnnnnnnnnnnnnnnnnnnnnnnnnnnnnnnnnnnnnnnnnnnnnnnnnnnctgctgagttgttgactgcatcatgttcatagcacagctccaccactgttggaacacacacgtcacgtaattacttcccatggagcctggaatcctcggtgaaagcgattttgatcagcatgtgataaggtgcaattaatccctgtaattttctgcttagtaatcgattcggtttgtggcctacgtgcaatgacagcgatcatttgggggaggaggggagagagatgtttgtgttgcaagtgttgccacatgttgggtgaaaacggcgaccctccaaacgccggaaaatacagaaggttttgaatcatttggatggaatttttcatcatcaaggtttcttgtagtgtgctggagtacttgctgtttgggtggtagtgaaggatttgttgcgttgctcacaagcttcaaatgcttgcctttgttttggcacgtgtggctctgtgctggtttgtgtgaaacttcccaggatgtcgaagttagagcttaccgtgttttgcctatttttggacataggagtatggcacaatcatttatctattcttttatactcttcctttttcatttttcctctgttcttttttttaattaaagaaattttaaggagatggcagcttttcctatgctttttatggttaggtttagcgtgtgttataggatatgacgatctatatttcgttggatagggtgatctaattttttttgtttggtttatatagatatggcgatccaattttttgttttgttagagggatatagcatgtatgggaaaaaaccaaaagttagtgggacccatatatatatatatatcaaaatttaatcatctgagatcttgttttaaagatttaattgtaacaaatataatgtgtaataaaatcataaattagataaaaggtttaggagaaaaaaatcggttggagcttgcttaacagaaaatcaaacaaccacagccaattaaaataggacacatcacccagaccaaaactaatgacttcatccagccaaatcgaccagatgcacttatccagcatattgagagaatattccttattccggaccgcctcatctaccctgcccttcaaccaaacacaaaaaaaaatcgggcggccatcttccatcaggctcatccacccaacctagcaaatgggatatgggagctgggattggaaaagggaaatgaataaatggctaggattaaatgaggtgggaagaatggatggttagatgcaatattactctttggagggtaggatattatttcccaatcctcaaacaaagcctcagttggcacaaataaatgcttgtttagacacagctcgaattctttgcaatgcttactagaattggaaattgctcaaaattgcagctctagatacagcgtgcattcggtcaaatttcaaatagagagctgaagtgaggtcccattggctttgaatacttactatttatatttgaatttagaaaattgctattaaagcattaaagcattaattatttgcagtatgtttgtagtactactcatcagggcaccgtatcacatcatagtaattgcattatactcttaattaattcagacctgaatcttctccaaaaatgcccatttctatatgcatcaagcacgtgttaaaaaagagcacccaaaaagaaaatagagtgcaaaatatagttagctgtaaaaattaatgaattagcatagtgcccctctaaattctcccaaattatagaacccacccctcagcagtcaccacctcatcgatagcacaaccacacatgcacagtgtcacagtggtcacatcacccacccctatacccccctgcacgccccccatcttttttactttacagtatcccccaaatattcccgcaaaaattaaacccactcctccccattcccccgcaggcagaggtagtagtagtactagcccaagaagaggaagagcaagacgaagctggaggtggaatcctcccgccggcgacgagaggccgctctagatcgacatggacgcgcaaatggcggccgcggcggcgcaccacccgctgccgcatcagcagaaggcggacaacctggcccgcaccttcaccaagctgctccgccgcaagcgcgctgacgctgtcgccgccgccaccgcggtgggagagcccggtgtgcccgatgcggccgcggcgtctgtggttggagatgagtaccagtgctccatcaaggcgacggcggcgggtgtgccgtcgttgagcaaactaaagctgtccggtaaccttggcgcggcgtattcgctcgacgcgttcttccgcaatgcggccgagaagaaggcgaccggggtggccggggtggcggtggcgcagacgtcgccgcaggtggcgccggatgtggcgaaggattcgttgctggctaacctgttcgctggcgtctcgccggtgaaggcggcgtacgcgcagctgcagctcgcgcagttcccttacaacgcggaggcaattcaggccgcggacgccgcgctggtggcggagctaaccaggctgtccgacaccaagcggcggtatctccgggaccccgccgcggcggccaagaacgcggcggcggcggggcacaccgcgctgtacgcgcacgccgaggagcagcggcatctcctcaagacgtaccagatcacggccaggaagctggagggcgagctccgcgccaaggaggcggaggccgaccgcgccaggagctccctcaccgccgagctccgcgccgagcgcgccatggaggcgcgcctccaccccgggcgcaccctcgcgt

SEQ ID NO: 38300 - DNA, 954 bp, Oryza sativa
  unsure (1)..(954): unsure at all n locations
tccgccacaccgttaagtcgatccgctccttctccaagtcaatgctcaactcgatgcagtccgccggttgggatctcgccgccgcggcggccgccgtgcacccgggcgtccagctgcgccgcgccggggacaccaagttcgtcttcgagtcctacgtcgccatgaagatgttcgccaatttccaccggagggacttcaacctcagcttcttggacgagcgggagttctacgaccgccgccgcttcttcgaggagttcacggagctcaaggcggcgccggcgagcgccttcctcgacgcgaggaacgcgcggtggggcgggttcggcaagttcctgcgcgccaagtacctgtcactggtgcacgcgaggatggagacggccttcttcgggaggctggagcagcgcggcatcgtgagcgccgggccgggcttcccggagagctcgtggttcgccgacttcgccgagatggcgcgccgcgtctggctgctgcattgcctcttctacgcgttcgacggcggcgccgaggaggacggcgcctccatcttccaagtccgcaccggtgcgcgcttctccgaagtgtacatggagagtgtcagcgacgggcgctccgacgaggccgccgccgccgccgccgaggaacgcgtcgtcgggttcaccgtggtgccggggtttagagttggccggacaatgatccaatgccgggtctacctgtcgcggccgggacggcggccatgatgggttgtgacaaagccgtcttgtttcaggtgtccggcggatgataaagggggaggaatgtccattttggggcggccgtcgaggtctcccgccggcagccggctgcggcggcggcggcggtgttggtgatgatgatcagtgggtggttatgtatctatnnnnnnnnnnnnnnnnnnnnnnnnnnnnnnnnnnnnnnnnnnnnnnnnnnnnnnnnnnnnnn

SEQ ID NO: 38301 - DNA, 1172 bp, Oryza sativa
attttaataggaatgcaagtgtaaaatagaggattgaaaaacgcaggaaaaacacaggaatgaccgttttattgaaccacaggaaaaacacaggaattgggtgagagagatagactcaaaggaaagttagcaagaggttgaagctcttgctaaatttcctccaaaatatttataggattatccattccataggaatttcaaaggattggatagaattgaatcctttgtttcaaagggcttcataggaaattttcctataggattgaaatcctctaaaaattcttatgtttttcctccaaatcaaaggggcctttaacatgcttgaaattacccccgttgtccattcaaaaaaaaacatgcttgaaattacttgaaagattttgagatagagcccaatagcgattattagtcaattgctccctacatcctactagctatttgttgagtttaaattaattgaaaaaatatagttattctccatatacacacactctcatctcaaccaatctaatcattcaccatttaattttacatgctaatttcatagtttcttataaaaacctctacttcctccgtttcacaatgtaagttattttaccattttctgtatttatcttgatgttagtgaatctagacatatataattatctagattcattaacatcaatatgaatgtgggaaatactataatgacttatattgtaaataggaggaagtactttttttatatttttggacggagcagtacatacctgattacatgcggcacaatgcgacaactaaaatagacaaggctcaaacgagggcccacctgctagggtcaaaaaattttggggggcatcatgtattcatgtcccctaatccggggcgtttaacctaacctaacctaacctacgtggctgtctctttatgacacatggggcccgcgctctgaccgtcctggcggcactaggcggcccatgtgcaaatgcaccgttctgacccatcacgtgtgggcctgacccggggggtccacctcccaactcgtgggccagcgttcccaccgcccctgcccaaaatgatccagctcagcgcctctaggagtggatgacccacggagagatatgtgtgtgccccacctgtcagacgggattaagggcctcgctctgtagtgtaatctgccaatgggatta

SEQ ID NO: 38302 - DNA, 572 bp, Oryza sativa
ctacctctacccctacctttttttgtctttgtagccaatcaagcttaaaagccatggataaatggagaaaaataaaaaagataaacccagcatgatggcctacgagatgacctgcaaggtgggtcctcccaaggtgagtgcacttgagaatatctcaaagcggggctctcctacgtgtgggcccaccccataaaatgtggtactttgccttttgggagcctgtcatgtggggccccgacctacctctcgatcatgaccagctagcttaagactaaaaagcaatcaaaaacatatttttttaaaaaaacacttggaatccgatcaaatcattccatgcatgggctttttcatgggtgagtgtgtaggtgtttttacatttggtcactcatttcgcttgcgattcattcatcacaaccggctgctttccgttgaagtttctcggagccaaaccagttttaagctttaggtgaacagaacgaacatttgtgtacacatcaacacagctgtgttgcttacttgctttgatgggagctagccgccatgtgttaattaattaatttcttgaaagcaat

SEQ ID NO: 38303 - DNA, 1662 bp, Oryza sativa
aaaaagttgtgcgcaaattaattttagttcattcccaatcttgaaacagatcacaacttagttaatatttataatgcatttgctttcagtacgtataatcatgttcttgttcttttttgaaataataataataatcatgttcatcatgtgacggcgtgtgtcgcattttagtttaagtactagtactaaccagtagggggcacttcgaattattagtcggtccagtggtttacaccatgattacctccgtaagagcagggctaagagacaggattaattagcctattatatatgctttgactgcaaggtacgtgatcttggagaattatgtgcatgaatctcacatctgtgtggctgatcgatctcgtcgagcatatcacgcaacaaccagctgctaccaacctccccatgattaggtcagagcaaatcatggcttccattcagattggatatatagattcaggcaaaaagagtttgcagttttgtcacatttgattttgtctgatgacatgcatatgcaaagcggccggctccatgttttgattaattcgatgtatggctttatcagcaataactgattgttaatctctctattgttacatcatatattcagctggcaacgagctacgaagaaccagctgtcatagtcgtaaccaacaacatttttagttttgaacagatacatacataaacaattatgaagaacgtcgaacatcataaatataatacatcataaatgtaagacatcatagtgaggtggctagccggtgagactagcaggaacagctacccaggatcgtctggaaatcaggacactaacttgcaaagtctctaagctcaggattatgccattttctttttttttttaaaaaaaggattcaattaataatacataaaagataccctagtttgcccgagagaaaaatcgaaggactaaacggtatgaaagttgagaggaattatagccgcatttgagtcgtcaatcatgaacagatggtccaaacaaggggagaactgaaaatgtgatgagaaaagctggctcctgcctagttccctgtcctgcgttttccactttgtatgtgtgctcttttttttttctcttttaagaatttgcatgtgtaattggttgtcctaagcccaaaaatggcacacgctctctttgctctcatgcatgaaaagcgttgcaatggtacaatcacgtcccaagccatccgtgcatcttgccattgtcggaaaaatggtctaggaagcttattggttgttcatgctctctggtaagtaaaaaggtttattagaaaataaaaattaatttatagataaaacttttatatatttatttgtagcgatttaaaagctaatataaaaagaaattacattgaaaatatcttaaaatcaacttcaggttcaaaaatttgaattttagcttttgctttggcttattaggccaacctatgggctctaaattcacggcacaatcttgaaaagtgttgcaacggtacaatctctggtaattactttctccgttccattttaaacgtagtcatgagttttatttgaaattttttttatgattagtttttttattgttattagatgataaaacaaaattaatattttatacgtgactgatgttttttatttttttcaaacaattttcaaaca

SEQ ID NO: 38304 - DNA, 1478 bp, Oryza sativa
tttcatttcatttgaggggaaaagaaacagcatggcctgcagtggttctgcagttgcacgtgagctctgatagtcttctggggaataacagttgcaattagtcatagtctagcgcatctttttgtactatactacctgtttgtgaatatttttttacatgggagtttcaccgaactccctgtttgtctcttgaatttgaaaagataaatcatctctgggagggttagttactgttcttcacttttggtgcgtttcaccaaacaagtggcagcaccatgattttttccaaaagacaaaaattttccggtaaagaagcacgtgatgtcacctaataccaccggtaggatgcagcaccttgtcgacagaaaaagatgtttttgagttcaacttaagtggcatgaatcattgcaaataaagctgagaggggtaggatgttttagtgctacagcacaatagtagcaagcaatgtgctgttaatcgccgtccattccttttcgtttttagtaggagatgagttgcaagtagccatcaggaatgtgtcgctcgacatgcgcattgcacctttctttgcttccactatactctcatctcgggataattgagccgtggaaaactgtagcaacagatttgttcagctgcacgaggacatttgagttatccttggtgtccgggcttaatctaggttaagatgatgctagcatataggacatgtcgggtttgattagtttatgagcatcggaacatcggagcaaataaactaacccaacctatgaattggctgagttgcttgaatttcattaaggctgtgtttagtctacaccaaaattgaaagtttggttaaaattggaacgatgtgacggaaaagttggaagtttatgtgtgtagaaaagttttgatatggtggaaaagttagaagtttaaagaaaaaatttgcaactaaacacgacctaaaaaagattttgcatgacctcatccactcaggtctgtctttggttggaagttcaaatgcaaaaacgattttggatcctatttggttttaaaatggggatcaggtgtacacaaaacacacatattttagcaccatatactagtagttttgttattttattttatatacccccctgattatgactgacctaaccaatctccaattgaatctagcataaccggagaagttccaaacattgctattgctatcaacaaaaagccattgcctttattaggttcctgccatgtgtgaaccccggaagccagcagcggctagtcatctgtccttacccttgtttcgcatatcaccagcattacttagatttaataaaattagattcagatcagattgccggcctgctgctgctgctgctgctgctgagttgttgactgcatcatgttcatagcacagctccaccactgttggaacacacacgtcacgtaattacttcccatggagcctggaatcctcggtgaaagcgattttgatc

SEQ ID NO: 38305 - DNA, 550 bp, Oryza sativa
atgtccaagctcctgttcgccagagttaaatacgctggaggattctgtgacttgtttccagttgacactgtgaactcatagtagggctgggagttgctagatcctgcaaatgcatagagcccatccgaatgaacagttaaataatacaggtcgctggcaatcagatttactgccaatgcgttaggcttcaatctcattccttgcaccaatctctgtccagggagcaaggaatccgttgggtggtcgaatgactgccagaccggtaagttgttgtgattatacagcaccaggttgccggactctgtgagggtcattcctgcaacagactggccggaagtgttggtagaccagacaaggctgccatccggatgctgaagaaccaggtccccctcagccgtgaagcttagggtggagttctgccggatcaactggtccctgttggccgaccatacatctgccacgggttctgggcgccaagaggtcatgtctgcaaattcaccggcgtcagtaacagtgtagactccaaagatgtaggtgttaaccagggggg

SEQ ID NO: 38306 - DNA, 649 bp, Oryza sativa
ccgccgtgcgccctgctcgcggcgcctccccgctccaggtaccctctctggtacgccgctacggctccaccacggtaaggtttcaaggtggccacatttagtgccactactcactgaattctgaggtgtgttctacatattgactgaattctgaagccgctaattaaccgagaaatgttccgcttacagggagccactgctaccgccacccctgccgctggcgtccctgcccttcaccgtgcatctccacttcccctctttgtgccccgccgccgccgtgtgtattcttctgaggagtattcttctgatgagtattcttctgatgggtattcttctggtcaggtaaccacagatccatccaagcctgtgctttttgtcttagtgttagtccttgtaggaaaagctgtttgggcgtaattagccaccgcttgttacatttgatccaaagccagtgattttataatatgtgttggaaactaatgccaataaacgtgtggtttgcatagaatttgcaatcaccatgcatgttgagtgatagaccgatgcatgcacttggttaaaaaaaggagcaagcaccaatctccacaaacccactaaaatatgcatattggagcttgtctgatgccattggccttaagcatgaaccacc

SEQ ID NO: 38307 - DNA, 3026 bp, Oryza sativa
  unsure (1)..(3026): unsure at all n locations
nnnnnnnnnnnnnnnnnnnnnnnnnnnnnnnnnnnnnnnnnnnnnnnnnnnnnnnnntttcggttaggccatttttggaagccatgaataatgttattaacgagaaaattgtcatattttacttctaaacaaaggagaccactgaaaatcctccccccactatttcaaatttatctatgagtttcttggtctcttgaacatccatcatacatggcatgcactcagataatccctttctgctattttgttgaacacctggcaattagaagcaaagaacagtccggtataggcttgcattttccatgcaaagaaggtttctataacatccagctcatactgaatcaatgattacctttttcagtgtttggtccacattgttcactatttaggtgtgatagtgctgtgcccatgtgccatcacaagtttttcttgttgctgcttatcctcatagtatctggtgtactccctccagtcacaaaagaaagttgttttgaactcttcaaaatcaatatgatattacatgtgttatgagaaactaggatatatcattttcatatgttcaaaacctatatcgtaaatgatatttatggtcaaagttaacgtgtgttgactcgcactctaaaacgatgttcttttgtgatcgaaaggagtatatcgtggcatcatgcagaggctgctaaccttctctcttgtcttctaactgcttccagtggtccaggccatatagttacatttattaagtatttctaaatcaacacttaaaaattgaaaaattgctaaaagtgagttgacctcacccgtgcaagttgctacattctgtgcatagctaataacctgcaaaataacagctccatgtcaccatcagctcattgtccaactgcagcaggaagcccatgggtgtgggatcagctaactgtaggtaaacatagctagccctggtcattcttgaaaatccaaacgttcctgaagctagaactggagtggaccattctgccaaccctgacttatgtttcttttgagaataccctgagtttgtttctgtcaagcccctagatgcatgctgttgagtgatccttattgctctcaatttcagaccacatgacgtagtgtgtttctgcaggaatacaagtatgtggaggattgccaagtggctaaggttatggatcatcaactcagaaggattgagaaagttgaggctggactaaagcagctcgggtggttccaaattatcacggtttcattgctgggattagttacatatcagtgccattcagaggtttcccgtctcgacaaggaagtcgctgctccaaagagcgagagcacgtagactcaagagcaaggtccctgctgattgttccattgatgattaagaagaagacgatctcgcttgatgctcatgaaacctagtcttgccaagtgttttgcactgtagtttcggccacttcatctactgattgatagccgtagtttctgatcgttgtcagggtagtttgctagagtcgcgctgcatgtttccattttgattcgtaacctgattaaaccctcaatgcccaaacttggtgttctgtgtccctttgcttgatgcgtgggcgcgttaactttggtatccagctctgctgtactttcttatgcatgataaacctgggatgtttctgatgtgaactggaaatggactatcatggcattcatgtagtgcacttcgattcttcagtcgacacaagttaatgcatgttcttttatgaggagcacgctcctacatcaagatgcaattactggaacaggtacgaattaagctactattactactactagtggatagttgatgagcaactcggtcacagcaaagctttcatttctgcatcagccaaatgagccgccaactaagcacagaaaaggaccgcaattggtgaggacaattaaaaataggggcctaaaatctagatgcagaaatgtttaagatctctaccatttgcagagcttccctcaaaaccgggatccaaatgaaaaggtcatacgtcccttccctatgggccgctaccaatggtggcgatccaaaataggacggtttgggctttacttgggccatcgtgggctggtgcaccgagacggcgagacctcgccacgctaacgatgcaagacttctgtccccacacggccactccgtagtctcccgcgaatgccgggctggcgggctctcgccgccgtcgccgccgcgtatcaaagcgacaggcaccgccatgtcctgggtccatggtcgccgggtcgccggcaccgcaccccggccacgtccccggcgtcaccgtccaaggtaagaagaggcgcttacggccggtaaaaccgctccggcatttgtttaaccgagataatctgacgaacagggagcgcctcatctagtcatctgcatccgcatgacttcgtcgataacattatggagctcggcatcgcttgatgtgcactaattaggctgcaccttgctccaaatctctcatgagctgtattacccttcttgctactccattatccccgaaatattgacattttaaccttttcataaaacgtattctataaatagaccagaagaactataaccaacattaggcctctacctcaacctcatgggctttggccttagtgttaagattaaaaaattagcatcatatagtttagcgcagagtaatataatacaaattaataaatactataagttgttttcttatcaagatgtatctagtagtctagtggtaagatactcccttattataacagaaggtgctagtttgaagcccatttcgtgatcattgtttttcttttttgccacttcggacccctcccctcccttttttttttctttgttgtgccttcaccttttaaaaatattttagtggtcgtgatttgaaccatgttcttcatggtgatacaaacaccatttaccactacactacgccactactagatatggcaatgagccccgttttcccttttcctacgaggaattcttttattagggacggaaatggctatagttg

SEQ ID NO: 38308 - DNA, 1114 bp, Oryza sativa
actaatttttataattttaataatatttagtgtttatttagtttgaaactaaattttagcatgtcttaaaaaaaaggccatttcaatagttaacttaggttattttgatttcgattcaaatacaactttagcttaccaaaatttggcatgacaaaaattgataaaacctcaaacagcccgtactgcatccatcatcagcatgtcttgtacatatgtgacctgttaaatgcagagaaaaaggctataggcaggatgtgtgttttaatatgcatatgtaaatagtgtagcaagtattcttttaaataatttagttaagtacttatatgcatatgtactaattactccctttattctaaaatgcacttagatatagtgttacctttttacacaatcttttaacattatactttttttagggaaattttaacattatactttaactactactaatttctttcgtttattatcgataactacgaaatcaacgttacataaaaagatttaaatagaaacctgacgacactcccttatcatagtcccttatcatatagtgatataaaaatcaaataaaaatcgacatacatagcactaatcatatactcctatacttttagtccattcattagtcaaatttttaagttttgattttcctcaaaataagaatgccatatatattttagaatagatagagaaacaagttagtatttatttatcatataataatgcactctcttttgtcataaatatatatcttttgtttttttaccgaacctttaaaattttgcccatcaacgagaactcaataacggggcactgttggcctcacccatatatacatatttttacatatctttcgaacgggtcttaaaagagccacgcaacgcgtggcttacgtggctagtagaagctgaaagcatgttaattaactccagccagagatgcatcggaagtccgttacagtccatacttttgcaccactgtccactgcttacgtaaaatcaacaccgtcgaagctgtctcgttaattcctcccgaagcgttgggggaggccgggagggtttggggattgggggtaggggatggatgttttacataaaaacctctacacttatca

SEQ ID NO: 38309 - DNA, 1537 bp, Oryza sativa
aggtattatactagtgtagtatatgtttataggtaactattgttttaacttgccattaaatcgattatagattatttggagctagtagttggctataccattaaacttgctcttagtatcactacaacataatctttatgtcttatttactccatttgtagcattgcacaatttgcgctaatattcaacagaaggcgtgttttttttatttttaggagccatatcatctattatatactttgatgaattatttttatgctactacagtttactgttcaatcagcaattttattgtctaaaatagctcatgtttaatgatgtgttaatgttaatctttcatttctatttggaaacaaaacttttttctattatatatgtgctaacagtgtagtgcctctttttttttttaacttgcctggcccctgttgacgaaaaaatcgaacacaccggcttgggagatctgcttagctccagtgcaggtccaaatatgatgacatacaggcgtgccagtcagtttgatcctgcaactgacaagatatgtaaacaatagatcaaatagccgatcggctaacaagccgatggagtagttccagccgatagccgataatagacgatgccgatacctgccgatagcgatagggtttaatcaatcggctatatgtccaatgcagataatgatataaaggcaatcggctgatgatgatgtaacaaaataacaatataatccagtataaaccaatcggctaataatgatatgatagataagcatcgatctgaaggttaaatcatacatcggctggaatgaaatccacaagattagattaaacagtaaaacctttgttgtcatcggctaatccaacttatatgtatatgcaatccttatgagcagatgcaacgtccagataactcaccggctgaaaccccgatgaaacccttattggcaatcaagaagcaggctagagattatggttctaagcacgacttagtagatcaaacttaactgatgcagcactaagtatgaaaagaaacataatatctagacaatcaagccgttgactgagttttcagggtggtagatgtctaagctaatctaatatagcaacgcgatttagccgataccggcagaaaccctaaaacgagaagcagccgatagagctaaattgatatgctaaaactagattaacagagacatatgataaatatgtaggcaaatatattatctaaaccagagcaatccaagaggtcgaatgtactgatgcagccttgaatgacgccgacgtaaacgatacaattgcctgggccgacagaacattggacttaccccttcgccggagatcgaacaccgatgcagccccgcgtcaggtgccaagtcccgccggacgataacataaagtagaaaaggtaaaaggtggcgatgcgccgaattgtattgatcatgagattaattacatagaccccgggtgtacatatttatacccatgggttgatacaagtccttgttggacaaaaaagaaactttcctatagataaaagaaaa

SEQ ID NO: 38310 - DNA, 728 bp, Oryza sativa
ttaggcttaatagattcgtctcgcagtttataggcggaatcttaatttgttttgttattagtctacatttaatacttcaaatgtgtgcccttatacgtcaaaaatttagtgccaaaacaactaaacccggcctaatacataaagccgcatacacatgcactagtatgatttgctgctgattttacttgtacatgtcatataaagcttgagtttcattgtggtttataatactcaagtaatcggggaaaaacaaaacaaaaggtacaagaatcgaccaacaggacaggtaaactcaacgtactaagcagaacaaaacctgagctcgtttttattaaaaacaagaagaaacataacattatgatagaaataaactaaaaacatgcaaatttaaaaatcttgttcatcctcctcgtctagatacttaaagtattctttcatccggggcttacgggcaatgagggaatcaggcgaggggtgagccactgagccctggcgattgtccgggtcatacttgtgcagcttatgctacctttgcaagtggtgactattaagctttacaaacactgatctactgaaaatttctacttcagcaggagacaccacttgcaaatgaaacggtaatcccagttcagagtcaccgcatgaagcttgtagtactggtagatcactctcagatgattccattaagaatgagattaatgacataatatatacgcgacccatttggc

SEQ ID NO: 38311 - DNA, 1774 bp, Oryza sativa
  unsure (1)..(1774): unsure at all n locations
nnnnnnnnnnnnnnnnnnnnnnnnnnnnnnnnnnnnnnnnnnnnntcaagcaggaggatgaggaaggcagggggcttctccagagggctgcnnagctgctggagaaatgagggcccnnaccgcgcaccgnnccgtcnnttcggtttnnccgcgaggcctggcgcgccctccctcgccgtcgccgctacgccgcgccggtcaggccatctccgttggagattgagggggggggggggggggcatttttctttcccttgatcaatgtggtgtaaatatgtaggagagttcagagtgtttcaggttttcagttcatgtgatccatccatggattggcataacttgatgtgttctcttcctttgtgctgtaaatacaattgagccgcttaaattgccaggttgcattgtgttggtttttctctttgatcctttcttggccggaatagcttcagataagaatgcagaggtcacatcagcaagcaaagcggatgaagcaaagagggaggattagccactcaaactttgtataatccatagacagcagattggaccagaaaacatggattatgtcatgctaaccattggatggatgacaaaccgatgaatcgtgtcattccagtaaacaacaaagtgaatattttttccttggtgttgccgacaaggtagactagtgaaagatcccatctaccagattagaagtcagcatcaacattggagaagaaaaatcatactagcaattactactacctgataaagaaaactattgccgttaaaggacatccaagacttgggataatatagactaaactacgtaacttctacggatgatgatgagtcataaaatcccaggatttacttttgtttgggaagcttaacacgacaatctcaagagcagcagcaccaaaaaaaagaaaaaaaaaacctagggttgcaaatcccagataatcactacacaccacagttgcgtcttcttcaaacttctagaggcagagtttgtttttgcaaacctaagcagaaagttctctgcttccaggagtactacagctcaatcgggctaacctatcataacgataatcttgcaacagatgcttatagagcagttgtgacaaaatggctgccaccaccgttaggtctgcagcgatcagtcggtcttcattgcctcagcatgataagtttccaggtctttgtccagctcatctgcagtcttcccagcttgcctccttccgcgaccacggccctggaattgaccacggcccctgacactgccagtgccacggccctggaactgggactggaatggggcacgacccctgccacggcctcggccccggccagcttggaaggcaccacggttatatctattactggaatggcaagttcaggtgacagatcagcaaaaagatcaataaagtttcaacacatttgtggtgtttttcagtttggttgtgtcaactagggaaaaacacaagcaagatgaaattgtcaccaaccaccgccaaaagtgagaataactagtagaaaacaaccttattttcttctttgtatgtcacaaatgcatacagtatccatgactaaactaggaaaaattgtagtatagcaggaacaggtggaaacatgattaatttatgctagacatgtagtataaaatgtaaacctgaaactctgcacattacatgcttcttattaaaaacaaaaagaaattggttacaataataaccaaatggcagttgctttactgtagatcatgatgcttttaaaataaccagggtaccgagct

SEQ ID NO: 38312 - DNA, 744 bp, Oryza sativa
gagatacatagaaatggaaggattactcacgtcataacaactgttcttgtaggtctgccattagaagccccacccacatttatgcgaggtgtcataggcaaacctaagtcacttccaataacttctatcttcatagctttaccatcaagcagaacattattgtaacgtttcaatgcagcaattgcatcacttctcctagtaaacaccacttctgctgtgccctgcagaaatttaacaaaaaaagatattagcacaataatcgaggcaagaggcagttagcaaaagtttcagtgatcacaaaagttcatttatcattttctttttgcagaataagcaccgcaaatggacactgtttacatgctgttaatttgctaggccagctaattagtacataagattgtgtatatataaatttttttgaccagaaaacagagagggaggtccccacgctatatatagtacataattattacaacaaatacatgtattttgcaaatgtactctaagcagatcaccattttatggagtttcaaccagaaaagctcagcaaagttcaatgtgtgaaagaataagaaagacataatccctacatatatattactaaaaacaaacatttcctatgtttgtcttcttgctgttatctcaaacgcaagataatcactaagatacatattatcctattgttgttttattgttcttggtaaatctaatgcaaggcataaatctgtgcactggaagttttca

SEQ ID NO: 38313 - DNA, 933 bp, Oryza sativa
ggagcgttcagctcaacgaagcattcatttgcgttccgtgcacggacagcaaggcatccacatacttttgccgaagcctgctgctttcctggagctccaccgcggcgatggcggtggtggtcgacggcgtctcgccgccgtggtccaaggaggccgtcgtacacctcctgtccggtgagctggtggtggtggtgattgactattgtatcatccttgccaactcgtgcactacagggtcattttcaggcttaattgaacgtgccattcgaagtcagcaaatgcagctgtgagagcacacctgtgccgtccttttccactgccttcaaaaccaaatcttgcccttgaaaagccagaccacacttgtactgtctgttctccgggtgagcataacagcaggagtggtcgagtacctgatagtagtagtaacaaaaatttttttagaccctgggatttgacttaatcaaatgaagaattcagtagccctgatcacgtaagtattagtgtcacagcttaccaacccttgctgctgaagaacgggttggaggagacagagacaacttgggcaagtggtttgccaaacttgcgcaatgattcgatcaaccgcgttctgattgagtctttggttgaaagggaatttgcattttcagagggttaatcttgacttggggtgttcgagaaaccgcccctgatttttgaacatttagtacaagccaagtaattagaaacatattatagaactttagttgtgctggttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtgga

SEQ ID NO: 38314 - DNA, 356 bp, Oryza sativa
aaaagctgcaagcatagcaaagttatctttatagaagcaatgagaagcatagtgcctatcagagaggtgttaacatggtggctgacaaacctgatagatgtaaagcttcacatagatcaatggcatccgctggttagcattgctgtagtgcttgagcacacggtagagtgtctcagggacgtactccataacaagattcaggaacagctcatccctgcttgtggttgagaagaagcagtgcttcaggcagatgacattggggtgttccattgcgcgcataagctgcagttcacggttcttgtaacgccggtcctgcaacaccttcttgatggccaccgtttcccccgtctccaagc

SEQ ID NO: 38315 - DNA, 3407 bp, Oryza sativa
attttaggattttttttattcatgtttaaatggacagtccaatttaattttgttatatatatagccctgaagagcgggactttacatagcccagtgtttatgtaccatactgctggggaaacttgctttttgacacatacattttagtatgctgtatttggaactttgaagttatttgtcctacatggcgagcttctcaaatcttgaatttctacagcaagaatcaaagtatcaaactaatttctaacaacaatgatgtgaaaaatgaatgctgcaactgtatatatgtagagaactcaatttatcatttaatattggcaatgtactgcaacaaatgaaaaataaattaacaatatatctgaatataaataagtgcaaatttgctccatactgagttataccgcagaacaatgaagcagccaacagcaagaacgcaagtcacttgacaaacatgtatctccaggatatataagctgtgctcgaatttgccattcaaaatttgagtaacctcctagaattagcagtgtcaaagtttaccatattgttaatatgcatatcgaataaaccagaacatgtatatgttcaattttcaacattgtatattctgatatatggaaaatagactcctataaaatttgtagtccactactctatgccctgagccacatgtctaactaactgtgcttcccaaaccacatatttctattgtcatagcttcttaatgcttacctgccactgaaaacaatgttacatcgtgtataagcctatctttaagcatcgataattcaacttgagtacttgacaattggatcactgaaggtgggaaataatgtggctcggtaaaataagccccagcatggtgttgacagggtatttgccaatgatttcagcctaggaatgactaacacagtatcagatattttcaacctgctaaacaggatggttcctatcaaatacaacctacaccaacagtccggtgtcaattatttattgcaaagacatatggccatataacttttctttttctcatgaaaggggcatttctgcttaatgttagtgagctatccatcgtgtggactgaacataacatataagaaggcagcacatcagctgtaataagtagctcaaattccttgaaaaagcctgtaagcataaactacttgttttaaaaagaatacagcttttcaattatgaacacagccaagcaatcaagtaccaacatatacatactgctaccgatttggtttattattgcttatttcctatgatagactgttatctgaattctgcctagttcatgtttagcatagccaaactaaagtttaaaacagacaggtcctgatcacccaagcattataattgagcatgaaaaatatatacatacatgctgaaaaactaaggactctccggctcatctgatcaccatgggcccttatgccgcttttggaaagccaactttcaggttgtcatatccaaacatggtatggttggctacttggctcccataaagacatctggcatctcccaagatcctgcagcagcaagcacccatatttagagtgaaggacaatgtctatggggacttgtttttagtgatgtttagcacaacggagattggaaagtaatatcataaaagaggaaaacttgaacatgtcttaatataaagtctaaaactgttgaatgcacttcttttgttgattaacaagtatctagaagaataccatatcactgaagactaaagataccaaacatctaagaactacctcatttctttcgtggtgacatctctacatatcacagatcttcatttcagattttccaggcaagcaggccataaattaattaaggcaatggctaagctatatagcgcccttggcaatacatttgcttgggggtgattagtaataaatgttatttagctccccatgatattaaacaattgtctgaaaacaagcacttgaaaacaaaggttgataaaataggtagtgttacatattgtattaccataagaaactgaggttaaataccactaacaaccaatccatcgtatatgatgttttgcatcctatacattttcttcaatttgaaagttaaatttccttgataacagttggtccttatacatatggtgttatttagagtgactatttccagtgaactaaagaatgaattaaatgcttttaagcagttccaaacttacctcaaatggaactgcaacaactggatagtgatgcagagacagaagttatgcagcatagtgagggcaccatgttaccaaatactgtgagcatttaaattgcaagacctctgaaaaagtagaacaagcagttgacagaattcagcaatagatctcgagtatatacagttagacaagctagagatgtacgaacaacgaaagtaaatagcaatttttgcaacaattcctaaattatatatccaacaactccatgtcatatgcaccaactatcatcctgaatttcgtttccttcctggagataaattgcttggctaagcacctttaggtccatacgctagtgaagcgtataagaggtgtaaaacatgttaattatatgagaagcatactgtttaagcaatccaacttgaaatcccattgcatcagcgcagttattaatagcaaaaggttgtttaaaataaacagaaaagcaatggttaatcgacattatttcttccccaaaatccatatcctggtaaaaaaaaattctaagtagagacgattggcaccacatgaattagctctaatctattggtacactcataaacaaatactggccatagcttgcaatagaaccagaatcgagattatagatttacaacggttattactgaaatgcaagaaagagaaattatgcaacacaaaccagaatcaaacggatcagagtgggccaaaatcgaaaagcaattggtgttgacaggggatcagagaccgtggaacggcggggtgacccatggaggggcgaaggaaatttgtcctacaaagctttttgaatcaaaggaatgaaccctatggaatcatatgaaattcgtatggaatacctcttcccatataatttttggagaaattttaataagaggtagaacctcatggaagaaatcctttgagtctttatctctcatcaatttcttgtggtctaatcaaaccgctattcctatattttttctgtgttttgtaatcctctgttttacacttacattcttattagaattctatgtttttcctattcctctgttttttcattgatgtgattcaaagggacccttatcgatcttcgttgctctatggctgcggaattaaatttgaaaatatactgttgattcgtttttttctcacaaattttcgggatgtaaattattagcagaaatttaccctcgatctcgcacaaccgttt

SEQ ID NO: 38316 - DNA, 145 bp, Oryza sativa
ccccacctttgccagtcgccaccacgtgcatctccacggcgcaaaaaaaaaaaaaaaaaaaaacggaatcacagttcacatcgtcgccgcggcggcggcggcctgcgcggcggatccggtggggcggaaaggggaggggaggggg

SEQ ID NO: 38317 - DNA, 1801 bp, Oryza sativa
  unsure (1)..(1801): unsure at all n locations
nnnnnnnnnnnnnnnnnnnnnnnnnnnnnnnnnnnnnntgtatccctctcccccatcctttttgttttgttgggtggatgttgaatgcacgcataataagaactaacaatagttttcctttagatctggaactgctgtttcaatctaaaaaaaatagtcatagttttactgccatgtctctgatagcttttgctgctgtgccactaacccaccagaacaatctggcttaaccttgtctcttgctattgatctccttctatagtcagtataggtccaactaatttgtgttcacctccttatatttctagggatatgcaagataccaaagatataaattgttgccacctacaaggtgctcgaaatcatgacctccggatttaaaatatgtgaaagactatggttctaaaaattttttgtgtaactacattgttgtgtttcttctttgtgccgtacctagaagctagaccggaaacgactgtattctttaaaaaaaaaagattgtatacaactgtggtagtatcagacttttttatcttagtgaattcatgtaaatatatatttatctatggttctgtccagtttttgatgattgttcttaaagtgtaatagttacttttttttagcataagtgccatggaagctaatttagcttaacttgttgcatcggttaataacaccattgaatatttcatttaccaaccttttatagacatgaattttggaaactacttagcaagtacacaagggctataatgagcgcgccacttggcgcgctaattttctagtattactgaattcaactccaccaggaaaaacagttcatttcacatgactctggaaaagtttcacggaacaaaattaattcaattcttttagaaaccagtacattttctctttttttcaagtttcaaacaggcagaatgagcttttagacccgaattaattttcccgtgattcgatagaagaggcaacgagaaaacatacttgcgtctttccctcaaaaagaggggaaaaaaaacgtcctacttgcgtacacaaaggatttctccagctgaatactctgccgccttgtcaacatgcacttctaattaatccaaccagccagcttaatagagggctccacttgatgatacaatttttttagaagcttgatggtagattgattacgatcaaaactgaaggattgtggacttttctacacttcttccaggagaataaaaaattacataacctgattctctgctgcatcagtgagatgcatgcatcacgctcctgtgattcaacctttcaaaacgttcaaatagcatgctttctgacatgatcaatcttgcttaactgaagtactactacttgacttattatgtgagagaagttaacaagaagacctatgctattagattactagtggcaggcactaccatgcaagcggcaaaccgggggagagaagaaaagcaatcgctgaccggacaaatgtgaaagaggctccgagtttcagccgaagtttaaaatcaagcaagcagccatcagcacgagacgacgacttgaatactttgatcatcaacacgaggccagaagaatccatcaaaactgaactgtccaagagattagggaaaagaaaccaaaaggaaaaaaaaacagagtagagagtagagcatcacttccgtagaagattcagttctcatcaggcggcaatatggaagggttcacattatcacatagatgaagtgacctaccgacctcgcctcaggagaccagctatcctggattattctacaagagaggtgccatgcagagaagcagt

SEQ ID NO: 38318 - DNA, 2543 bp, Oryza sativa
gattattctacaagagaggtgccatgcagagaagcagtccagttagtctgaagccaaactgttcctctccctgcacaacacaccaaagatcagtgtttccagtcagtctgaaaacgaactcttgatcctgtcgactacatcactacgtgacaatggttgctaaagacccagtgttccatggttggacaagaatacagcacaagaatctccatcatatgaaggagaagaaaagctcgtggctacaaggtaaaggtagaaagtgacggggcattggtctgaaaagggcctccctttttctactgcatcatattttaccaagttagcatgcgctgataggataaggggatccatgccaattggagcttcaggggcacatgaaccatagtgcttcgaatataatatggccaacaaaacctgaaggcagatgcattgccggctaagggcatacattggctgatctttttctaatcacgaaaggaacaggttattaaagaaagagtaagagttagattgagtgataggggtacggtaccttgtccaaactaaatggtttacagctagctaaacaacatcacatggggagtctgactgatgcaagattcctgggtgaaccactgcatcttagcttcagcgcatctgcttctgcggtgcaatcaggttgagttgcttaagtgcaaaaaacaagtaatcagatggtatgtgatacatgtgttggaatgtggaagcgttggtgatgtttaaagaaaaaaggatatcatggtacggcgttatgtaaacttttacgagttcacagcaaaataacaaatcacaggaaacaggaaacaagatatccttatgttttccttgatataaggtcattgaaacaatggcttcataaatatttataaggtcattgaaacagacaatggcttctgaaagcaaaggagcttagaaaaatctatggagtatctctcgtcaagctgacacaagatacttaagagacaaggaacctcataaatatgcagaactgacttaaaggaatcaaataatgtattcaaacagtatgagcttggcagtttacagctatcgtcaattgctactcagtcaggttcacatacccctgcctcaacagaagttacacacaatataaatatgcgaggtcagcgctctaaccttcaggtagtatttgcaaacaaaatatgagcttcatccatttgatccaaataaatttggtcacctctctggcaaaagcaccagaaaaaaaaacatgttataattatgttttagaccttgtcacatagtatcaagtaaataaaatgtacgaaacatgaatgcttgtctacctggtatacttcaagtaccttctacagttacaaatgatctgcttagtaattattggcttaggtttatggtgtccttgacaagcttgcaaatgctagctttcaattcaggagtaaccttgagttgctgaggacatgtatccaggacgaataaagtaagaattctcatagtatctgacaggatcactttatcatgcctagatacttcctggttaacaaactggcatgaatttctcatcttacaagagccgcatatctgaaggaggacaacgagcaaaacgttaacctcaagcatgttttgacagaagtaattctcgcataggattaaattgacaattacatgatacctactttagcttcctggattttaaagaaagctcgtagtctttttgatgcaaaaactgttcttcgctcaacagatggacaaccaaacaacgcaacctttttcaagtcacttccagataaccatctacagtgcacacacaaggttcagcttcaacagcggagaaattgggtgataaagatagttcttcaatgttattttcaacttatttttttgccttacatactactaccaaagaatattaaaatcaaacataaaagaccaaaggaactgttcaacaaaatatcaagcatggccagctcatgtagcatatgcagggacagggagcatgatcagtgttgttcacaaggatgtattatgcctggaatcactattaatcttgaaacacagcatttcagagcacggaaagttaaatggaagagtttcagataagtaaacggttaattcatgattttttttagtatagttttgtgttcaacctataaaatctgctcaggactgatagctcccccactgtaggtggcaattaaccagtttccaaagtgtaagaggaaaaaaaaaggaatgcagttcattgttagaatccactgcaaaacatacagcagcatcagcacaatgcatacggcataccacaatccagaaagtcaagatttgaaacaaggaagcagaaccaattacatggtaaaactcattgccacaaactaagctcttcatttccaaattgaagaagacctagacattggtaattccccagggtagctgttcacttgttctcttctataaggccacattaccacatcttctcccaggttaacgaaatcagaaacgcaatgaattcacccaccatatccagagtttagaccaaacttgctaccaacata

SEQ ID NO: 38319 - DNA, 5668 bp, Oryza sativa
catctatatgaatttaggtaatgctagaaagtcttacattgtgaaatatggaggaagtacattatttgaaactaatgtacgtgtaagaaatgttagtcctatttttatttattgagataattgacggtcgaaatcgatacttaacgaccgtcatacttccactgtcgacatattgttcagagatgcaacagaaaaaaaatacaggcattccgaattaaactcacaaaatctagtgtttcatggtaatttagtggcatccatctgatgtagctaaatcatacaacttatatagagcgcaaagggaacaaagcaatcggagaggcggcactcacttggcgacgacctggtgatcatgaccgaaccgctcggccgcgcccttgacgacgtcgggggacaagacgtgcggcgccaccgacaagtcaggccccgggaggtacccgccgtcgtagaacctccggagcagcgccgccgcctcctccccccacggctgcctcgacctcggcctcggcctcgccctcggcttcctccgctcctgcggtggcccatccccgggctccggccgcggggcgcgaggcttcggagagcttcgaggcgcgaagagggaagagagcgtcccaggccgcgcggcgtcgccgccggcggcggaggagagccggcgagcggcggagagtgccatgggttgagagggttcgggtgacggagacggggaagaaatctggtgtgatctgaaccgtccgatcaaaatccgtatggcctagtttggatgggcctagatcgaagcccatgtacacgaatgggccggtatactgaactccagggcccattcacgtagatggggccggtattttgttactagcctaatgccgtgaagcccatggaacgtgcagtcttcggccctgttcgtttcctctggaaaggatgtattaatttttggatattcgtaccacgtttttcaaaccgctaaacggagtgtttcgtgcgaaaactttttatatgaaatttgttctaaaatatcagattaatccattttttaaatttgtaatagttaaaatttaattaattacatgttattactacatcgttttacgtgaaacatttaaacttcgtcttcattcttaggagattcaaacaccacagaattctcacgaatttgtacacttaggtttctctcatttggttgtgtgtgtttttctttttcaatcactcgaaattcgaaaagactgcactgcacgtgcacccgcaaatgaactctcccaaccctggctcaattgacgaaagcgagtgtactggctcaattgactggtcgacctacgagtcaatggccagttgatacttgatagacatgggtagaccgccctaatcaaaaggtaatctgtggattagtcggttttcaccgattaatcagttaaagtcggtctagtcggctttagtatgtgatttaagtgttgtttggagttcaaaattcttaggaaaatcgattagtatttaacttctaataatttagaaaagctgaaaaacacatcattttacggatttataaccacatcttctaaaaatctagatgaaaaaatagattgtttgtgttatgaaaatagatgcacaacggaaacacaaatttttatatgaaaaattcttgcgggaaaaaactatgggcgccgaccggcaataatcactatagaggagatgattacaaactaagggaatcacaatggaaacgtcaccccttcccgtacggcttacaagagtatatataggggataaaagaaagacacctaatagaaactcctactagaaaacaaatccgaatatattgtggtcccaaaattcagatcacatatttaacagtttgagagagctcttaatgctaggagaagttgcagctaccaaaaactccctcaaacaaccctcgatcaattagatgtgtcattttattttgatccagaaggagtagcgtatctattccgtggaaaatatttttacggctactatattggatcctctaactagttggcctaggtgcctacttactaatcagtgcatcaccgactaagattactccctctattttaaaataaactgattcacgtaggtataaatatgatcgaaaggacatgaacacgaataaaaatgcttggaaagatttgtccgaggcgaagaggtggcgccacatcagactcgaccggggatcagggcaggttcaggaaccggagaagaaataaacagcacattgccctgcaccggctgctacagtgctacttagcattagatgcgccgatcagctgataacaactaaatcaattcaactattcaagcctttaggccctgtttagtttcaaaaacttttcgtaaaaacatcacatcgaatctttgaatacatgtattaagcattaaatatagataaagaaaaaataattgcacagtttgcatgtaaatcgcgagacgaatcttttgaatctaattagtccatgattaaccataagtattacagtaacccacatgtgctaatgatggcttaattaggctcaaaggattcgtctcgtggtttacatgcgagttgtgaaaatagttttttcattcgtgtccgaaaacttcttccaacatctggtcaaacgtctgacgtggcaccaaaaattttcatttcacaaaataaacaggccttaattccttgtgcagaatttctccgggtcgatcgctacagctctcaacaacatgccaaactgcaactttttccgcagattttgacttgaatgagccccagtcgtgcgtcgttttattgctattggatgaaacgcatttatatattagtgatctgatgatatgctcatcctacttttataggcaaaagtgaagttgaatatttggacgtcgacgcataatcttgacgcgaatatgttagttaaaagacagtacgagagctgtgtttattttcggatctataaagtggagataaaatggtgcgaagttgcaactctgttcttcagttcagctgttcccttttgctgtcggtcttatttagtttaagtttagttcttaaaatatctaatttatttctataaccaagtttaatctgttcaataatctaaatcaaataaagttctttctagagaagcattggcaggaaggaacagcaacaagatggactgatacacaccctcctggattccttccaagttccaagagtccaattctccatgcacagttgagcaacacaagccactgcatttttatgtataaattgcatgtatatgttttcagatggctgatgcagaaggagtatgtctccgaggcgccactgcaacagcatgaggttagttggttggttcatctgtggcatttctccttggagtctcttgagagaatataagatacttactccgtatcaaaatatagctatctaatacaagatgtgatattacctaggactatgaatctggacagaacacttcagattcgtattactactccctccgtccaaaaaaaactcaacctaggagggtaggttgagtttttttagacggatgaagtaggtaatgtcacatcttatactaggtaattacattttagaacggagaagtaagtactaagggaggcttggcttggaaggaagagccactctttgcccctgacacagcagatcagacaaaacacgtacatcatttcctgagtgattatctctaattagctcatcataagatagtttaggtactcatcgtttggcttattttctaataagtcaaaacgacttattaggaaataaaaataaatttgtaggtgaaacttttataaatgtgttcttggtgacttaaaagctaatattgaaaaagaaactacgttgaaaatatctcaaaatcaatatcaaaattaagcttaaaaatttaaaatttggctttttctttggctgattagagccttagttggtaatactatatatggttgatgcaatatgaatgagctaagaaatcatcagcagcatatagtgagcatatgtgtcacaaatatataccaacttgtgacatgtagtttagctagtgacccactggaatactggattgtttactgaaacatcatacggatacactgatccctgaacagtaggatatagtatcagatgtgttaggttagcaagtagcgagcgccgttttcctgaagcatttgttgagaaaatgactttcacccctgagagtgttaccacctttaaatctttaatacagtactagctagtagtacgatagatcagcatagagcatagtgggccaataatgcagaagctattttgattgcttgaatacgactaatccataaagccaggacctgagaagtagttagctagcattctaacttccagcaacatccttaacacaagaattcatgtcggtaacatgcatgcatgcatgttgtgatgttggttttcccctgccagttgggacctacaccatcccgttccatagtcaattaaacttttataattttaactatcaacatctttaaaaatatttaatttaaaggcactataacaacatatatagagttgtcttgcaaattactacaatagaaataaatttatatataaaaaaatatagtcaataacgttattttgaagatcgtgttattatctacttcctccgtttcataatgtaagttattctagtattttccacatttatattgatggtaatgaatctagacatatatatctatttagatccattaacattaatatgaatgtggaaatactagaatgacttacattgtgaaacagaaaagtaaaacgtaaaaattcaagaaagtatttaaacctattccttgcgtacgaccaattgcaatcaacccggtatgcatgcgtttcattcattaattcatcaaccctgactggatgatcaggtaatcagctacagtagttaattaagctagcattagagttactccctccaataaaaaaatcttgttgccacattctaatataacgaatatatcacatcttaatataaggttgttttttttaaaaaacggagaaagcaggtaatatcatagacggatttaccatatagccaatggggtttaggatcccaatcaattactactcgttacttttctcgcaatctttgtacatgcattgaggtgtcactaccaatactcgaaccattcgctcccaatcctctcgatctatttacaatcaacaacaaatcaggatgggaagcgagaaattgatgcgtcgtcctacactcaccgaaaaatcttgcgctttcccccaattggggcccaaaaggggccccccaagcccattcaccccttcggaagaggaaggaagcagcgtgtctaacgagtggccgccggaggagttgccactcatggatgctagcgaccttggtacttccttccaatactctctgtccgacaacagcagtgtatctcgctgtccactaggtgacgtcgtacgttgtggccgatatctaccgccacattctagtcggctagttcttacttggtgtgcctaaatcctaaaaccccccattagctatcaagttgtgattcgacgtaatcccctccttactcaccaccacgtcacttgatatagctatgagtacaatatgtatgcaccacgtcactcgatatagctacgagtacaatatacatgcactagatgacccgggtcaatttttatcatgtg

SEQ ID NO: 38320 - DNA, 1759 bp, Oryza sativa
ggagatggaggcggcaggcaggggcagacagatccaacctcatctttttctcttctcccttatctatttctctctctcccgcagccacacaccacttcttttgttatctctttctcctatctcccacaaccgatctctcctacatccacacgcgagcagcgcagtgcgagtgcgagcggcagcaatggcggtggtggccccaactggcgagcagagacatcagcctcgtcgagcagcaggagaggcgatggcctcaccacagcgagtagtgacctcggcctcgtcgggcggcgggagaggtgatggcgtcggtacaggtggcgatgaccccgatgtgcagcggccttggccttggcaggtagcgggagcggtggcgtccttagcctcggcctcgggcaagcaacggcaacatatgtgacctcaacatgttgtggatttgagaagttagtttttcttttttggacagggacattaataattcacatctttccggtttgattcaatttttagataggatgattttgttgacctaggcatcgatctagcatgttctgctgtattgatttaagcatcaatatatgatttggatagagcatgctcgaattgagcttcttccgattttgtgaaacagatcgaagcgtaggaaacgctggcggtgcagttctgtcgacgtttggctgggttttagatttgtgtcatttttttctcactcgaacaccctgtggctaaaaaaaccggcacctatagcagtttataagtgacggtttatgaaaaaaattgcttatattatataatagatgatagatgatgccgttgacttttagacatatgtttgatcatttttcttatacaaaaattttatgcaaatacataagatataaatcgtgattaaaatacttttagtgataaaacaactcaaaacaacataaattaaatgatagttacatattttttttaataagacgaatgattaaacatgtgcccaaaagtaaatgacatgatctaattaaaaaagatgtgaagcagtgaaggcggcggtccacttctccgcgcggcggcagcgcacgaacagcggtgacggcgccccgcgggtggatccggtagcggcggctccctccgcccctctcttctccctccggcagcggtggtcgcgtcggcggcggccacggatggaaggcgtggcagcggccgcagatggatggcgtggcgacgaccgacggcggcggtggcagtggccgagggccgcggtggcaatggccgagggcggatccggcggaagtccctccgccgcctctcttctcccaccaagagcagtggtggcgtcggcggtggccgcagatggatggcgtggtgacgaccgacggcggcggtggcaacggctgagggcccacggtggtgatggccgaaggcggatccggtggaaggcaagagaagttttgtgatgtagttttgaagttttgtgatgtagatttgctgttcttctttaacaattattttgtgattttgtgatgattgtgatttggttgtgccaattttgggaagattttgtgataattgtggtcgatattttggggagctaagagtgatttggttgtgccggttttgggaagtctgagagcaattgggattcgggggtgggggcgaagacacgatcgtccgtgctgtgacgaacgggaaaatacgattctttatattagttaagatttaaccatttatcttataaaaaaaatatataattattatttattttattataact

SEQ ID NO: 38321 - DNA, 5623 bp, Oryza sativa
  unsure (1)..(5623): unsure at all n locations
gacgccagcagccacccaatttgggggggttatacgcgttacgtgagtgcgttctgtgcgtaaacccttttggcattttgcacttttgatcgatccccacagcacgtacaggatattaatgcaataatgctgatcagctcaagttcttttgtgatgacgctgccactgccatcgctggagtggagcgtgtgcaggcaaaatgtttcaatagaaagtctgtctcgtgaagttataataattgtatgcggtcgtttggttccgagacacctacccgtctagaaacaaaaagacaccatgcctgcgaaaatggtttttctaatagagcaatgtcttagaatgatgccatatcttagatattgataaaacccattggttaatatagatctagcatttacagtttctccttttttttaaaaaaaaagttgaaatggcgtgtgtccataaatatgatcattagatatatagtagtattgacgaaccattgagtttcatgatgagatgtatcctttgcgttttgctaaagaatatgcttgcactattttaatagagagtctatctaatacaattatactatcgtgtagttggttttatgcccacaatatgagatactgagatgtgacgctcatatatctcgctaacagagttataatgaatgtcatatctttgatatcgacaaaacctatcagttaatgtaaacttgttttatcctgaaaaaaaataaacttatgttttacaataaaaggtgaaatgacatgtgtgcataaatgttggcattaggtagtcataatggtgggccataatctaagtatctcttatagatctcatgctaactgatataatcacatatgtttcatgtaatttccccatgatttacatcaaaaatcaagtctttcttgaaggaattgacatagtttcaagtaggtttcattaagatttaatgatccggttacctaaaattaatctgggctcaactttgctatgatgaacacagcaaggcaaaataaaccagcagcatcttcccgtgatgttcaataaaaacaaacttgcttgacatggcctacccactgcagaccatatatgtactagacactagtgcatagaggtccacaagatattttcattatctccatcatatctagttaggtcttttcaacaccagcaacaaagatgctgccttcagaaagatgaggaaagagatgaaagcacttttttgatatggtctcaatcaaactactttctttcaactctcatggtaaaatagacaaaattgaaatatttagctggtacagataatagagtataatgccaacaaggtcttactctagacgccccttcttgaagtcaactctatgggccctagatagttatgcttggacttttggataggataatatcagtgtggattgtggaaacaagcatgcacattgagagtttgagatgccctgcttaagtgtgtgtgtgtgtgtgtgtgggtttttttttttttgggggggggacatgtgttgacttactttaggttgtgaagtggtatggatcatataatgcatagtggtgcatgcaaatccataatgtagaaatggtattggtcattttacgtgtgtccatctatcgactctagttatgctcgnncnacactactacaaattaatttggtctttgcatacccccacctttatttttacaaacgtactaaaaatatatatatataataagccaggggatgtccaataaaggcctgtctatggaaatagtttgttctcacagacatgcatgttaagaagaacaattgcgaaagtgaagacctggctccatccttttccttctcccttcattttcgctgcaccccgcatttcttctccatcacttctctttttcttccacatctcctccttcctctctctcccccatcacttctccttccccaacccttccttcccctctcctttctcctcgaatccaccagcggccgacaacgagagtgaccatcgcgtgccttggctcctcctcctccatcgtcggtagccttgtgacaaccagattcagcagaggcagtgatgagagcatccactgctcgcctcggctcctctacctttggtggcctcacaacggtagaggcggagatggaagcggacaccatgcgcctcagctcctccatcgctagcagccttgtgtaggccagctctagtggcgcatctagcgtaggggaggtaggggatcaaggctagggtttctaggtttcctttttttttttgccaaatatcttttgtaggccagcctacgaaaaaacgattttgcacgcggttgaggtgccgacttgtgataatcaacatttttatgtggcaccaggtaggcactccatctacaagcaaataccgaatttgatagtttgggggaaagcctttatgcaattgatcgtaaaaacattatatatatatatatatatatatatatatatatatatatatatatttgagcgaaaatttttaactaaagttgatcaacggctatctacataacggttagtttgtacaagtgtacgtgatacaagtataccagatcgagttaattatctttatgcttcaaaaaaaatgtcttttttaaatgaagcgcctgtgttaattatcacaaggctttttttctagacttgatatttatgtccgttaattttagagatacacgaacatacgcttatacacattcagtggatctccggcaaagtgccaatgctgcagggttcggtggatctcctctactctacttgtagtacttgcctaggtcaatgcaactgatcgaagtgccacattaaagcatagtactactatataaaaaagagattgaacatatgaaaacacacacaaaagtttgagaaaaagacccttgattttgattccggtcaggccatcgtccaacaactataacaaaacaaaacgcgtttgtaattcgttccttcgttgaattcccgcgatgcaacgcaagctggcggcatgtctcgcggcgggcagaaagcacgcgcgccaccacccacttgcgctcccgtgggcctactcttggcccatctatccaacaacggcgacgctcccgcccaactgggcggaatccttggggcccacaccgccaccccgcccgcgtgcgccgcccctgggcccactcctcggtgcccggggcccaccgatcacacggaccacggcaacaacgcgccaagttgccgtcgcacgcgcgcccggtggcggcgccggtgtagctcaacgacggcggcggcgacggcgacggcgagcccggagtagttaaagcatttaaacattgcttacccagaatcgatggatgtatcatgtattattatcattcggattataatttaatcatacggttatgtacaagctcgatcgattgatgatgatcgcgcgaacgctagctagctagctaagctagctgtggccgccgtcactggggccggacggcggcagcggcggccttcccgtcttggcaacggcgacaaactggccacccgtcgacgacaccggcaccgccgccgccgccgccgatggggacgacgacgacgacgcagctgccaccgccgcggccgccgccgccgtcttagaagcagagtaatgctgctcgntccgcctcacgcccgccgtgtcctcagtgaagacgacggtgagcgccatgaagacgagcactagcaccgatgctgccgcaatcgccagcgtcgcaagaacacgcgccgtcgtcgtcatggttgagacgccgagaagaagatcgactcgatcggcggcttaatttctctcgatccaggcaagtattaatatatattgttcatatgtgttcatgcacggatcgatttgatttgattacgaaaaggggcgacgcgtgattgcatgccccggtgtacgtatgtaacacatgcatgatggcattcaggattaggttttcaaatcgcagaggcgaagtcccggataatcttgagaattgcaaattgcttgcgttggcgtcaagttacaactttgcctttattggatagaagcccatgtttgtgttggaaaatcattccacaatgagacagactggatagatagggaatcgaattcaaggtatctttttgaatataggagttttatggcatttatgttgcgtttgtttctcacttttcccatcatttattttctcggtttaaatgcacacgctcctcaaactataaaacaatgtgtttttaaaaataattctataaaaaagttgtttaaaaaagagtaaatttcataaaactatatatactttgcacaatctttcacaaaactacagatttaagaatttatttcacaaattataaattcactggcttcatttatcacaaattaaactacaggtactttgcataatatatcacaaaactacagatttaagaacttgttttcaaaactacatatttaatatctccatttatcctagaactataagacactaaatctgtagttttgtgataaataaagacactaaacaagttctaattagtgttttaacatccgatgtattttagtccctagatccaaacaggccttaggctgtgttcgctcctcctggatgggaacactccccctccatcacggaaaacggagcagtccattagcgcgtgattaattaagtattagctatttgttttttcaaaagtggatcaatatgatttttttaaacaactttcgtatagaaattttttacaaaaaaacacactgtttagtagtttgaaaagcatgcgcgcgaaaaacgagatagaggggttgggaacatgggatgcaaacacagccttagtttagttgctgcatgtggcgaaagaaacaggagtagggcagaaaagccatactcctgatctgaaatatttcctaaaattgcactttaaaactttaaaaatagaagataaagataaaaccatgtaaattactaacttcgacctaaaataaaccaaaaattgcagagagtaattaaacctaaaataaatttattttaagatgaatgtggtactatatttgggaagccagagagtatacgtgacatttcagtatacaatgtacataataatatacactgtacataagtattatagatccagacagtgaaagaaaagattgtactggtactccacagcatatttgtctgcgttagtagcccacttgacagtgtcatctgttatcaaatgtcattcttggaaggggcccatggaccatggccgaaagacgacatgtacggcactggaatatttgacctttagctccggtttgccacgtgacatgtttgacatttcctgtctcgtggcatgacactggaattaatatgcacgcacgaacctgtgattatttgtgatttgcctgcctccttgtgtgctcctcctgcctgcaaccaacatgtgctcgaaataatggaattggatgatttggttggatggcaggggcttaagggaaattatcttaggacagtcaaacatttttgggacgtactgaattttgatttttcgttccaagaactgtcgatgaactacctgaagtaacctaacaaaagtacgattttggttgcaaattatttgagaaaacgcacagtttacaaatgtatttcctatagtacaaaagatggaatg

SEQ ID NO: 38322 - DNA, 624 bp, Oryza sativa
ttctctgaaagaaaaagaacaatcaaaggtgtttgaggttctagtaagattttttgtacgggaaaaatattcaagaaataatcacggatggcctcaattgttccaagcaaatttatcatttatgccatgtggtgatcgctgcagagaagaggatgacgagtacttgtcattgctgtgatgttgtgttgccaggtttacacacacatttgcttctgatacaagtatcaccgaggaaaaagaaaatcaaacctccatactcatcaatttgaccagatcagttgttgagtactccaactccttttctttttttagaccagagcttcttaagcatgtgctttctcgtttctcctttctacctgcttgctgctgctgcatgagagttgagatagtaataattatggagtcctagcagtaattaacttaaccaatgggtctttttttaaaaaaaacaactgggctgttttggtcattccattttacgttacggcctgaccgcaatgtggtccatcagtggacgaaagctggtggtaaaccaccagccacttttatattgcactcctacctcacttttgacggtgatagtacgtactactcctatatcaatacatattactgacatgtggg

SEQ ID NO: 38323 - DNA, 13460 bp, Oryza sativa
  unsure (1)..(13460): unsure at all n locations
nnnnnnnnnnnnnnnnnnnnnnnnnnnnnnnnnnnnnnnnnnnnnnnnnnnnnnnnnntcccggtttttaatggaaccgaaactattgtgaaatttggtcgaccgaccaaagatggtttctcctccagtgaaccgcttgctagcctgcacctgctgccggggacgacgagcaggcgcggcgaacggaggagggcgaggttgagggtcttgaagaattggtgggacttcatgtcggcggcgccgcggcgggagccgaggcgagcggaggggtccttggctaggagccgcgggcgatgaggccgtgcgcgtcggcgtcggccggccgctttaatttctctcgatccctaactatatatgccgccacgtgcatggctagctaagctcatcatcgatccatctccctgcagctacgtactgtacttgttagcaaccaatcccatcaaatcatccgccgcttgctgctgccgctgctgctacgtaactatacaccttgttagcaatcaacttgattagttaggtttaacgacgacggcaacagggacagatatgacggccgccctgcaagcgctgctcgacccgacggcgctgtccctgggcctgcccacgccggtgatcaacaaggaggtgtacctcgccatctgcctcaccgtgctcgccggcacgcgggcggggaaggccctggtgggcaaggccgtcctaggggtgtgcggtcagcgcgtccgcacagggcctccaatttccagggaccccttaggtccaaaacttcaacactagtctaactagttccgaaaatctgttattttttcttatcgtttcggtttcgattacgtctttgctggttcgaacagttgcgccggttcgcaatcttgaatcgcctcccactgtggaactcgccaatcgccaatcacaacgaacgagaggagtaaacgacgccttacctctctctctcgtgcggtcgtgccgcctaacgccgtcgccgcctgacacctgtcacgcccctgacctaattctttccggtaatttctaatccgataatccctaattttggattatcattttaggccatactagattgctatgaaatatattacggagtataaattattttcatattatatcatcaattaagtttttatccttcaactttgcacagggccaccctgctggtgggagtgggagaccagcaggaggtgcagccatgtaggcctgcaagcggttgtccccgaggtggcgagcggcggcgcgcaccgtggactggaggccaccctccgcaacattgtccgccgacctcttgccttcctctccgcctccggctcgtgcggccccgccaatgctgacatgcgccacctcatcgctcgcctccttgcgaaggaccccgccgcccgtctcggctcccacgcggcgccaccgacgtgaagtcccacccgctcttcaagaccctcaacctcgccctcctccgttcgtcacgcccacccattgtcccgggcactggcgccgcgccgctgcactggtcgcagtcgtgtaaggtggcgcggacaacgcaaccaccgccgacgataatgaagatggcctgctcagagtttagagaggagagagaggaggaaaggagaggaagggagaggctggcctgctttcgtggcatcctgagtcagccgccacgtcggataaatccggagtcaaaaccgctgatggatctagtttgcactggtttttataagttggaggatgagttgtatccggttttgtggttgggggacgattttgtaacttgatgacaagttcaggggtgtactttttccttgtagtagtagacccaaagtcccgcacacgcgccaagccgccaaccggtccttgcactcccgcctcggcggctgctgcttgggccgtgcgcatgccatgccgccttgctgcctgatgggccttgatgtctcgttgccaatccggctagcccgagcgaacaggccacctccatcgatcaaacagctagcttgatatgctacagtgatcacattaccattggtgtttacaatttgacaaaatttactacatcacccgctcaaagttcatggtctttgttactgcaaatccagaaaacgtgatacagtttataaatgctctaaaaaatcaaaccaataatttgctaaaaggcactgccaccattattttattatttgcggatcaaatagaaagagaaacaacgtagaaaagacaagtttgcccctctgcctccatgtacctcctgcggttgatcacctcctcccatcacgtccgtgcattagaaatttttactgtgctgctatggaccgctggttctgaaccgtttgggacttgaacaatttgtagtgaacccttgtgctagtataaaagattgtttgtgtatgtctactcagctcacgtacgtattcgacctagtgtttcagtgtattagcgtgataaataatagccatgctgcatgttctagcttgagagtataagaaataatatgcaaattaaggaaatgagagacgtttggcttgcctggaacagtgcgccttgtggaagtaatcggtggtttttgatgccgccggcgccggtgcggatgaagatgtggcgggcgcccaggcttgttggcagggcactggtcagctacggcttgcgctggtgcccggcccggctgcagcacacgcgccagttgtcgcagcgaaacgtactcgagccacccgtcgtcgttgttagatagcttgtcgtcgatcctgttagtgcgtgtactggtcgctgaagtcggcgatggtcgataatcagggtgaagatatgtccgccatccttgtctgtccgatccggatatacgtacgtatatgcctcgacaccacgccctcaggctgcacgcgccactgatgcctcgccgcggcgcgccaaggttggacacgtcagtgctcgtggcggcctccacggtcgcccatgcatgatgcgggtgcgccgtcaactcagcatcaatgtagtggaggtgtagctcgtcgatcgtcaatcagctgatggacggtgacgcggcacgacacaaagaggcggacgagcaacttggcggccagagacgcggtgcgcacgtggtcacgggcgatgtcggggtgaatataactagcaggttggcccgcgcatttgcgcgactaggtttaagtcattttatgttttactcatattacttttgttctttaaactataaaacatgtgtttgtttactaagtaattgttgtctgtttcagtataattctatttaatatttatctatatgtttttattctttaagcatatattaattgtgccatggtgttgcgcaagcttagaaccatagctgcatgtgagatcatgtgaactaccatcctttaaacttactcaagactattgtcggctgatgctctcttgtctgtccgctacagtggtcgagctatcatgttgtcatctccttgagcttgctctccactttagacattactatcatcaagctcgctttctattatcataccgtcaatcttgttccatggccattgcactctttgtgcttacttgtggttgtcaccttgtttgatctcgcctcatgcacaattgctattgtcctcgagctcaaaacttgcaactgaaactcatcagcaagggctgggtatccgagcttattcatgatcgtctcatcctcgatctcaactgaaacaatcactactgctatgccctcaagcttgtccacaaccaccattatatcgacctcgctcgacattctcgttaaatttcttgtgtagtttgtcttcaaacatatatgctctcaagaaagtggtgaggaagaagggtggcaaaagatgtaagcttgaaaagataatgcatggcttttaatagtaggacggtaaagatgagaacaaagatgattctttatagtaagatggcaaaagtgaactaaaattcctgctatatgtttaaaatcgtaatatatttactgtatgtcaattttgtctatctaaaagtataatgtggaaacaaataccttttgcaacctattattatctgtaccaatctatattatctatgattatggagaagattaaccaatgaccacatgaatatatatgatgtgcaatttgttctgtgccttatttcaaggctctttttacattatttctagtaggattttttgttgttaaatgtgtatgatctaatggtgtagaggtccaagtggctgtttatgttttgtttgactcgctgacgcatcaaaatctaatccttacgatctagatatattatgatctaaaaatgtagatttttcttttctatagcagatctagaccttacgatctaggtatattatgatagaacggtctagaccttacgatctatatatattatgatctaaaggtgtaatttttttctttttatagcagatctagaccttacgatctagatatattatgatgtaatggtgtagattttttcttttttcttttgtctaatctttttttttgttttttggttaatatgggattttctaacccgtgagagtgaacgtggtggctttttttctaattacattgtatttctaatcggattcttcttaactggaattttagatatttccagattgtatttatagatggactcttacctaatatcaattatggcggcgggcctcggctagggtaacagtgccggcggcgacggctggattagggttagggtttgtttattctttttttttgtttcgattttttatttttccgtgcgggcggcacgcgaaaatcgattttcccgtgcgggtgcatcgcccacacgaaaaaatcgcgtatttttgcagacgatttcttccagacggtcgaatcttctgcacgcgaaaatcgatttcatccgcacggaaaaatccttgtagtagtgtaatcgattttctctatttttaaaaaaataaccggtagccaatgaaattgtactagataatgcatgttgcatgcatgcattcacatttggcatatgtctgtcgttaacactcgtacgggctactccagaacatatattgtataagaaaatgcttgcttttgtcaaaagggacaagcacaagcaatagcaaacatacagatcactacaggttctacgcgtgcatatggtcaaagaatcattcgtatctgatcaagcagaagcgtatgtatgtacgtacatagctaggacatatacatacatacatacatacatacatatatatatatatatatatatatatatatatatattaactccctctctctctaacctaatggcgccatgagctacagttggacatagctagcttattaggcagattgtccagtgtcgtacttaccgagctgtctcacatgtacagtgcccacacgcagaagcatcccatggtgcaatgctaacaccaagctgtacgtgccatgcacacttctgatttgtccatgcatgcatggtcactcttatcatcatatcggttccatccattcattggccctcgatccatatcgatctatcatcgcatgcatgcaagcgctcctactaggtaggtatggtactccagtaataactccactctggatcgatatgatcgattgatcgtcgtcagacaccacacccaccaactacacatacacacatccttctcgagccttgaacaagctatccatcacctttcacttttatataaaggcaaacaaaaagcgatgatcttttaggtgagaatttactgtgtgtttgctatcacattattgtgtacgacatatgcaagaaatgtatggaaaaaatatattatatatatatgatgtggcttcagggctagtagctattttttccctgcaggtagatctcattaaaaaaaaaactactagctagtgttgtccatgtttgccaacattgttggaattttttttttaaaatggaattagtaagcttagttggttaatttcaatatgcaaccatccgtgcatgcataaagaaatttgtgtagtctgcatctaagctggagatactattactacaaatactgcatctatgtttgaatgcatccaagtcttaaaaaaagaaaaagaatgttcaccacatgtcatcacaaaaatgcttgatatatacctagacccgtatcaggttcagtcaggtgacgaactaaaactctataagcaagaatatatagcagttaacaaagctctttaccgatagctacatttttgaagaaaaaatgtctggtgtgattactggacagcgatggacacgtatgtaaagcggttgcatgcattagtcaatgctagtcatgcatgtccgtcttacaagcacagcgcagcacgcgtacgtacgtacgcacgtaggatcgatcgagcaagcggctggtaagtgtagtgacataggccaggtgcagtaaaatgcatggcagacagggcgatgtgcaatgatcagtacaacacaacacacggccaggccggccggccattaatattttgcttctcatctctcttgctcctttttctttttcttttggctcgtcgtcctctagcgtttgtactggagacagtgtctgcgcccgcgaaagaaggatcaaaaaaattatacatatatatatatccaccagagaaaacaacaacaaaacgtaaaaaggaaattaaaggcaatgcagcatgcatgagatgagaaaaaaaaaagagcaaaagtccggaaagccatcggaaaagaaagaaagaaagagagagagcggccggtgctcgctttagggagcagcaaaagcccaacgggcgtcaccgatcgatcgaccgatcggccgctctgcagcagcgagcgttgcatctcgcatgcactttgcagagaggaagctagaggtagacgacgacgcgcgaggcatgcagcgaagcgaggagagcaagcgctgcaagcgggcgagagcgagtgatggagacgtgtgagaggagagaggcctctcctctgctgcaggtgcacgcatgccgtttgcgtccatccagtccacgacaagggaatatcgtcgtcgatgcagcagcagcaccagccgccctttgtttatttaccaccataccttgctacacatccactttactagtttcatatacacattgtagagggagaaagtaagagacagagagaaggtgttgtatatatactcctacctcacacattctcattctctctacataggagtatatatctgtcgtcgatcttctaaaactagtacgcacattctatctgtatgtcgctccgatgttcatcagaaagttgttaaaataatcaaagcatgtttgttgcaggatcattgtcttgaagggatcaaacgtacgcagatgtgattaaactattgcccgaatctctctgacccctttttcttcggacatcaccgatctggccgtaataaacaggctattccctgtttaactatctatccacggtctccaatgcaaatttgcagccaggaggaggatcggaatggaagcggcacttgcagtaaaaaaattgaggcatcgaaagaataggtcgcggtacgtacggccaggatcgtccgtagctgggatgagaattaccagcagataatatgtgttggttctttgttcggagcgagtaaaaaattagtggtaacatttaagccataggtaggaagcaaatcaagagagacatcgcacagtggattctgacatgactgtgcattcaggcgtgattactttaaggccagcacaggataaggctgctgatatcttcactgagacagcgagattagataactgctgccaggtgagctccattggtgttacttaagccagcttcaacatgattcgagcatggagagtttgggccttttattttgtgtgtggaaaggagagtgtgggcatgcatgtgtcaagatgggtggataaattggtacaaatggttgagcatatatatattatcaccttgagaagtgttacaccttagttacaaaatttataccctcataacctcacaatatctgcgccttattggaaaatgttacacatttatcattatttatataatacactgttggaatattgtcggttcttctttaaatgttattttacagacaagagaaacaaaattttgatcaaaaagagcatctgcgcccctttcaacattcataaaaagatggcaaatttacgggataggtaatcagagtgcttgggtggtgctcagttctatatatatatatcggtctgtactggctgcattttgatgaaagctttgataaataacatctctgtttgttctaaatcagcatacacatcgtttcatgcgatcgaaacatataattggcactctggtcaatgtagatgcgttgtactggagcacatattcgatgatttgcaaagtccgaattttcaataaattgcaaatattcgataaaaggacgcatgagttgcgtcaattactcaaaaattcacaaggttcaaactggaaacagcagcagtcagcagtgcgctcctaaagaaagcaaattcaaccggggactttctgcgcccaagactcccaacactccccacgcataattcacaccaagacaccggcccatggctcatggcacgcacagttgtcgccgctggatcttactgtgcatctcaccttaccctacatgcgtagtactccccttgacgatctacctatatttacacataaacgcaggacctaggagagggctagaaccaaacggaaccagaacccacagggccactacggcaaaagcacggaggagtagggggtatgtaggacactcctccgggcagcgtacatcatctgggtgttccgatgataggagcagtgtttaggagaaaagcgctctgctgctgcatgcaggctgcagcaggcactagccaagccaagagagaagaagaaaaaggcgacaggggagacagacagggcgcaatcatgccgacccccccaaaacacgactcgattccaacctacacaaacggcacaaccacaaacgtccacgcccagtttccttggactctctcctatgctcctatgcatcctactactcgctttctcgctcacctgcacgcctctctctctttcttggaaaacgtgacacattctctcctctcctctcctactcccagattctctctcatggggggatggagtgagtgagcgagtagttttttctaccagccccataacatcgcaccatcgcataatggaagagagaattgaaacaagttgcagcacgaccacaagacgacaatctgccccaagacaaaaacttgctgcttataaataggcacatgcccactacactaccaccaccactactaccccccctcaaacaacagaacccccaccaccaaagcacatacggcaaagtagccagacaaacggaaactcaaagagaggagagagtgagttcctttgatcatacagttgtttttggccaatcatcgtccgaggagagatggggatgcagagcaacgacggcgccgtcatgttctcctccatcgcgctgctgcagcagaggttcagggagctggagaggatcaaggaggagcgggaggagaggctcatccagatgctccctccccgctccgaccgctcccacagtggcgctgcggccgtcgtcgtagccacggctgctccgagggaagtgccggtgaaatggttcttccatccggagctgttgtatccatgcaggcctctgcgtgacatggctgctgctaccttacttccggtcatgccggccaccatcgactgtgaattcaaaaccttccagctccgtggtgactcgctcgccgtggacctgtggcctagtaaggcctacaagcatgtatccagtgaagttgatgtcgacacctcactgcacctctagattactactactgctactaaaattgctatcctaagctgttaaccttccaagtatccaccagtgttgctgctctagttgtttttggtagcctagtatgtttctcttcttctttggttttgtaacaaggggcaggagggtggtgagttgtaattattgccagtagtaagattgtgctggttgtttccctgttaccttgtcgccgctgaattgccagcatcttccaattgggcactgttatcgtctgagtagtagagtagctctgcagggcaaccattttctgatgtatcagtacactcctcatcatcgctatcggaagaatcaccagggttctgtttcttccgtttgatgatctttttcgaaatcatccggttaacacccttgctgtcaacatctacacattcgctgctaattggcttgaaacggactttgccaacctttcttgcattagcctctagtatctgcaagggaggccagagatttagaaaaggtgacaaaaattatactccctccgtccctaaatatttgacgtcgttgacttttttaaacatatttgaccgttcgtcttattcaaaaaatttaagtaattattaattattttcctatcatttgattcattgttaaatatacttttatgtatacatatagttttacatatttcatataagtttttgaataaaacgaacggttaaacatgtttaaaaaagtcaacagcgtcgaatatttagggacggagggagtaattagtaagcagaacatgatgcaagttaaagcacaactgaggaagcttcagattcctaagaaggattgctaactgcaccaaaaaaaaaagatctggagacaactaaatcaaagttctgtacaaaacgtcaatgaaaagtgttgtgattattctgctaccagctcttttttcttgagttatttattagaaaataaaaaaatatttaagtaatacgatcttgagcaagataattgtactactttatatccctgcataaatagaatatttaaaatccactttccctagtaaggaaatggtaagggtgaaaaaaaatatggcaagcataattgggcaactactcttgtggtaaacaatgtttactaaacatgtgaaaaatatgcaagctttggaacttagtccagcctgactagagatcaagtatgttggtatgtttcctttttttttcctgaagacaaatatacattatacatggatttgccttcatacagttttagtaattcaactgttttattatattgttatctagagaacataagtgtaataggtaaaaaaaaacaaacaagaagttagttgtttcctagaaccatgttacttttcatattacccttttcatttgatagttgacaccttacatcatgtgttatgcttaaaattatagaatatggatatatgaaaatagtattatactttataaattcgagtgatctaaagttggaaaaataataattgtaagtcacagctcagggactgtaaaaaaaaaagcaaaataaaaaaagagagaaagaaatgagtactggaaaaaaacagctttattgtgggctatgtacacagaataggcatgaacacaataaatatcttccaactgaaaagaaagtggtgacataacccaataaatacaaccttgaataaaagctaaataaatcaactgaagtaaacgttctcacagggtttttggaaacctgaactaggtcagacagcagaaggggcactggttaaaattcacacaaaaatcatcaaatccagctacctttcttttttctcaactttttttttctcaattttccatgttttccccggatttgaccctaagcatataaagcatatgcaactacaagtctattgatatgtaagatgagtttgaagaaactattattttggacatggtgaaccaaaataggggtaccaaaagcagacatggtgattgagcagtatggtccattttttatatatatggtggataaataattcaaaaggtgcaatgagtttgacaaattttccattttcatgaactctaaactctagccagatttggtaagcagagattgtaggctgatggccaagtgggattggttaggccagccaggtatagttgcatgatgtgccaagattattttacagtgcatagcacgagggaacctatgacaaggacatggtccatgggttgctaaaattatggatcaaagaagaaaggtaatctgtaggtcactagttatttagcaaattgcattaaacagacaaatatcatgagattgacaactaccctacaaagccccacattctcatgccttcactccaaatgacagctctcggcagcagccccctcttcagccacagctccccctgctgtctcatccttcctccacccctgactttaggatacggtggagaacatccagagggagacatcttggacgatgtcccatgtgggatgaacttcacaactgtattcataaggggatcctagtgtggtcttgaagaaccaaaccacggaacaataacttaagtccatgccccaaaacctgtttgccacgagacaccacgacccttgcactgggataaggaaccaaagaggccagtgtatggatccgagctgacacaaaggaaacaaggtttgaccttcagctggtccttgatgattcaggtcacgccaccttgctgatgtagttttgaaattccgccgtaagcagaacattgtctgagactgttcacctatggcctttgtactccctgtgtacttccaaatttttctaaagttatgtatagtgagtgtgtgttttggaggtaagaccaccatgaaggtctaagtgctctggttccaaaagttcaggagtaaagatatccaattgtgcagttcatgaggttcagtcaaaacctgaaacttaccccaaccttgaggtggtaatattgattattccattgcctttattaatgctatgttcaggttaataactgaagtactgaactcatattaactattttcaaataaagcaaaaaaatgaaaaacaaattatcagaacacataactgaacatttcatcctatgtagaaatagaaaggtatttaaaaggcaaagtagtacaaatagaacgtgaacaaaatggaaatgaatcaccaaaggaagttttggacatgacacaaataacataagccaattttgttggatgacatttgtgcatccaaatgcattagaaaccattccgggcttggaaaaaaatcactaaaaaaatatagatgcaggagatgttcatctctgcttacaaaaaaaaaagttataaaatgtatcctacatgatgaaatgatatgaacaaccaaagtagctaggaacatcaacccgagttcctattttggttgttttctaaagtctggtgtgaagttagaaaacgtcttatgtatgtatatgggctggagtgtgtgtgtgtgtgtgtgtttggtgttgtatcccgtatgttcttctttaacaaaatgacaagcagttctcctgcgttcgagaaaaaaattgtaccctacaattttttttttttaaaaataaaggccatttctagaaagtagctctagatctgtttattgctctttgttttcctgatatgcagaataaaacatctagggtaatgttggc

SEQ ID NO: 38324 - DNA, 542 bp, Oryza sativa
  unsure (1)..(542): unsure at all n locations
agagcaacgacggctccgtcatgttctcctccatcgcgctgctgcagcagaggttcagggagctggataggatcaagagggagcgggaggagaggctcatccagatgctccctccccgctccgaccgctcccacagtggcgctgcggccgtcgtcgtagccacggctgctccgagggaagtgccggtgaaatggttcttccatccggagctgttgtatccatgcaggcctctgcgtgacatggctgctgctaccttacttccggtcatgccggccaccatcgactgtgaattcaaaaccttccagctccgtggtgactcgctcgccgtggacctgtggcctagtaaggcctacaagcatgtatccagtgaagttgatgtcgacacctcactgcacctctagattactactactgctactaaaattgctatcctaagctgttaaccttccaagtatccaccagcgttgctgctctagttgnnnnnnnnnnnnnnnnnnnnnnnnnnnnnnnnnnnnnnnnnnnnnnnnnnnnnnnnnnnnnnn

SEQ ID NO: 38325 - DNA, 1404 bp, Oryza sativa
caatggagtcatctaggattgcaatgtccagctcatggaaaaataaacgaacaaaacggtggcgtcgcggtgccctttagctcccagcatgcgcaaagttgaggccatgttgccgtctgatatgatccggtatgagcctgtggatgagttctggagaggcgctggctagctgcataccagaaatgagcattgataagcatccatgacaggtaaatataaatgtaccataaaaagcgactgtttgaaaatgttctcgtttacttacttcatgcttgaagttgaacagaggagggaatggacgaccatttggcaggcgtgcattgggctctcgtagctcatcaaagaaggaatgtgcacatgcgtcaagctgcatataatcaaccaaatgctaagctctttgaaaatgtccagcatgctgctttagagattatactgttttccagctaaagcataagctttaaacaattaacagcaactttttcaagtggagcactaacaactatatttaacaggcacatgcgactgtatgaaagttgcactcactcttcaccagccaacacaccaatttggttttggaccactggatattataattacaatgaccatgcaggaccagggatccatcaatctacttccataagggacctcaacagaaacatttcgtttattgttcttgacacacggtctatgaatatttgactgtaacagctaacaacacttgaaatgaaatgctaaaataagcaaatccatgtaaataatcattatcctagcgcttagcgaaaacaatagatttatagataatataaaactaagcaaacgaaagaaaactcacagcagtgcagcgtagacttggtgaatattggagaagacgggaagcaaggtctatggcttctggaggcattctcttgtggaaaatctggtggtaagcgaaagaacaacagatggatcagttaagcagctgcagatacattttttttatttcaaattaaacatgatgcagaaactggttttgaagtggcctacaatgccctgcaagtaaaatggtatgaggaaggtgatccaatataagaaaacatggctaccttgtgccaaggatgagccttaatctgaggaaatttgaactcagtatagttggggttcatgcatcgtatttcctcacgggttggagtaccaagaacctgccataatatcaagttaacacaagaaatacccgtggcaaaaaaaaaaatgtagcttgcacaacatcatgcaataccttgattatctctactagctggtcaacagcactctctccaggaaacagtggctgacaaatacacattatgaaatataatcagaataacatcacagcataatctaatcaaggaacctgaatgttgcagttccttacataaagatatagtg

SEQ ID NO: 38326 - DNA, 3105 bp, Oryza sativa
cggcgccgcgagacaccggagagaaaaccagcattagcccaacgaccaccgaaaccagcagatcggcaccgagccccagcccagatccaccccgacaccccagatctggacacccccctccccacgggttaccttctcgctgatgccggcggtcgccgccgccgccgccacggcggcggggggcggtggcgcgtccagctccatgggctccggccccggcggcgcctccatgcgggggggagctgagctgagctggggagggaggcggctgctgctgctgagcgttggtgcttggctttgcggggggatggtggtggtgtgcttttgaccggtcagggaggggaggcagcaaggctgcggggtgttgtggtgtggtgtggtgtggctgctgccggtgaggccggctttggagtttggacagatggggaagtggttttaccgataactgtgctgactcctccagctaataactgtgctcagtatgatatttttgaagggttttctttcatgaactgggatgttttataggaggaattttagaggatttgcatgagagatgaaccaaggtgaaaatcttgagtttcttagtttagaaggagtctttggtggtattgattaggataaagaattgggtatggatgacgaatggagatgtggtacgtctttggcatgaattttgttgatgcttaatttgtatgttcaaatggcggttatatagaaatattttttatcatcgtacggtttttatcggtttcatcgtaattgttgctttcttaaggttgtatcgggataaaaagctcgggctagaataagtcaagaagaatagagatgttgtacatctttagcatgaattttatgaatgcttcatttgtatatttcaatgactggtaagtagaaatatttttattaacatatggttttatgtttttatccgtttcatcgtgattgttgctttctttaggttgtattacgataaaaggttgggacagaaagaaacaactatacggtacgtttttagcatgatttttataaatgcttaatttgtatatttcaatgacggttacgtagaaatatttttgttaacacgtgattttgtccgtttcatcgtaattgttgctttcttaagattgtatcaggataaaaagttgggccggtataaataaagaagaatagagatgtagtacatctttagcatgaattttatagatgcttagttggtatatttcaacaacgggtacatagtaatatttatattaacatgtggttttatctgtttcatcatgattgtttctttcttaaggttgtatcaggataaaaggttggggctgaaaatagtcaggaggaatagaaatgtggtacgtctttagcatgaaatttatggatgcttaatctgtatagttcaacgacggttacgtagtaattttttattaacatgtggttttatccgtttcatcgtgattgttgctttcttaaggttgtatcaggataaaatgttagggttgaaagtagtcaagaagaatatagatgtggtacatttttagaataaattgtatggatgcttaagttgtatattttagtcatgttacatagcgatatttttattaaaatgtgattgtattcgtttcattataattgttgtttttttttgttgtatctagattaaaaaaaactagggccaaaagaaactaagaagattaaagatgcggtaagtctttagcatgaattttatggatgcttaatttgtatatttcaatcacggttgcatagcaatgttttaattaacaagcagttttatatgtttcatcgtattagttgcttttttaaggctactgatgctacttatctatgatttttatgcaattgatgctactgttttagattgcagagatattatccactaatttgatctctctaaacaaaccatcggacaagatgattcactgatactaatagatttatcgtgggaaacattttcagttttagaggatttgtttgaaatataaactaagtcatgtgaaaatcttgaatttatttatttagaaggagtgtgtaatattaatgatcatgataaaaaaattggggttgagaacagaatataggtgtgatactatgaattttatagatgcttaatttttatatctcaatcatggttaagtagtaatgtctttattaacacaaagttaccgaaataacatattccgtgataatcctcatttctaaaagtgcgattgaacatattcggcataaattagtgcctatatattcaatttagtagtaactactttttatttcagcatgatacaaatacatcgatatattagaggtgattttttttcttattcatgtgctgccggttgccactacattgttttggtgacagtcggtgactccttgttattacacgaggaaaatattaagtgcatgataactacagttgtatatcgacacatcctctttcaaatatttttaaaatacgaggtaaatgttttaaaaaacttattagcgtttttttgagaaaattattacaacatttttaacagagtgtatcatgaaaataaattatgagttaacttcatcgcttagtgaaagttttgtctttttttctttatcttatagtcatcgtctttattctgtagttttccatgattttacccaaaggtgtgatatgcggtaccgaaatgccctcaatatatgaacatgtccggacatcatctgaacgaccgaaaaaaagagaaacacgggacatcaatatcagaccatatttaaagatctttttaaacgttggaacgtgtcttgaatcctaaaatcgaacaataaggccggctaagagcacccgcaatagtaaagtaaggtgctctctataaaatatgtacatctcagcaatagactcgattgatagtaagtatgtctacattagtatctatagctctctcatacattgcctcgtttttctctatagactatctctaagttagtagatagttttgctctctctcttcatttaataccttttaagtaggaaaatatgctgacatacatctcttttatatatatatatatatatatatatatatatatatatatatatatatatatatatataac

SEQ ID NO: 38327 - DNA, 1740 bp, Oryza sativa
attagatcaccatatccactttcatccctgcaaccaaacaaaaaactggatcgccatatttactccaccatacaaaaaaccgaatcgccatatccagtaaaatatggaccgccatatcccatctaaccttgaccgggaaccaatcgcaccctaacagtaccatgcgatcatacttaacagaactactccgagcagtagtggtgagagggagtagtagggactatcatttctgaaagcacgaatagtacgtaactggatgaaggagtaatgggcaaacgatgtgctagtccagccagcagccatacatcaacatcaataagcaacaaatgttctcaggggcttgggcttttttgtccagcttgggatctagcccaggtccatatggaacaggagcggaaaaagtacattgaaggtccctcaacttgttacaaaatcatcccccaaccatgaactcagatattcgacgtcccttaactaatcaaaataggtccttaactaatcaacatgtgagacccacatgggtcccacgttgactcagccgccatgtaggacaaaaccagggtcaaaaccaccgaaagacctattttgattggttttgattagttaagagacgtcggatatctgattttatggttgggggatgattttgtaactcgatgacaagttgagggaccttcggtgtacttttaccaacaggagccaccacaaaagaaaggaaatatcaaatataggccggagtgaacctgctactgggctaggcggctagcaaatgttaacacaaaaaggctaaggtggtgtttacttccagagacttaactttagtccctgtctttagacactaatttagagtattaaatatagactacttacaaaactaattatataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgataggaacttaaaagttttagtcccatctaaacagggtctaactagatcccgcgttgcaaatactgtactctcttcatccaaaagttttaaaacgtattttagtttttgggttttccaaataaaatgattatatttgttttatccatgcataaaaaaagtaaatgaagaaaaatgtctcttcgtttagaagcagattattaattactcattgcatgcattctctttctttgttgcacgaggagtaaagatggatgagttaatttctccttatttttttggtgaataaagaaatacatcttagacttttgaatggagtgagtaaaatttaacaaaactggcattgtcgtatgatacaatttcatttttctttctaaaccaatcctaagtttccaaccaagaggcaagcaaacgtctaaagttgttcgaagtttttaacgctatctagtttgttatggcttattattcggtttggaggaatagaaacgcatgcacacttttaatcgtaggaattcccaataggtttgagtggatgaaaaatttcttatatcaacttgtatataaaaaaagaacttcctttagttttcctgtacttatatttctacaaaccaaatgtcgttcgtaagaattagtctttacaaatccaaatcttatgcg

SEQ ID NO: 38328 - DNA, 1422 bp, Oryza sativa
  unsure (1)..(1422): unsure at all n locations
ggtccgtgcgctcactgcgtcctgcatgtgtgtgtgggcgtgtcgggggtctcgaccgccgtgcgcgctcgggccgtgccggcacgagatgccacggttcacatgaggcgcaacgcacgcagcgcatctgcgcatgtcccccactcggttggtggtggtggtggtagctttggggcgtttggctcggggctcgcacgcgacgcgaccgagacaagcaagcgcggtctgcctagcttgtctccttgcgcgacttgtagatagatagatagatagatagaaatagaacggcagacggtgcagcagtagctggaaactcgcgcgcgcgcgcgagcggcgggcggcttttccgtgttcggtgtttcggtgcggcggccatatatacgcgcgcgcgctcgcgtactacgtgcagacgacggactagtgcgtgcgtgcgtgacgcgagaggctgagaggagcattttggcccttggtttctttcggttcttctgctcttttttgctggcgatggggtggtcgtcgtcaagggctatgctcgtggcgcgcgctgtggccttggcggtggtgttcctcgcggcggaggctcagctgtcgccggggtactacaacgcgacgtgccccggggtggtgtccatcgtgcgccgcggcatggcgcaggcagtgcagaaggagtcgcgcatgggcgcctccatcctccgcctcttcttccacgactgcttcgtcaacgtaactacgcgaaatggatctcttgctcggccaatgtacttcgccttgttgagtttaatggccgcgtgcgtgtgtgcaggggtgcgacgcctccatcttgctcgacgacacggcgaacttcaccggggagaagaacgccgggccgaacgccaactcggtgcgcgggtacgaggtcatcgacgccatcaaggcgcagctcgaggcctcctgcaaggccaccgtctcctgcgccgacatcatcacgctcgccgcgcgcgacgccgtcaacctggtcagtatctgcctcgtgtttttctgcacccatgtaatgctggcattaatggcggggcgcgtgcagctcgggggcccgaactggacggtgccgctggggcggcgtgacgcgcgcacgacgagccagagcgcggcgaacaccaacctgccgccgcccggcgcgagcctcgcgtcgctcctgtcgatgttcagcgccaagggcctcgacgcgcgggacctcaccgcgctgtcgggcgcgcacaccgtcgggtgggcgcgctgctccaccttccgcacgcacatctacaacgacaccggcgtgaacgccacctttgccttgcaagtgggcaccaagtcctgcccgaccaccggcggcgacggcaacctcgnnnnnnnnnnnnnnnnnnnnnnnnnnnnnnnnnnnnnnnnnnnnnnnnnnnnnnnnnnnnn

SEQ ID NO: 38329 - DNA, 1890 bp, Oryza sativa
  unsure (1)..(1890): unsure at all n locations
atgtttgattggctgactgccagattatcgctgtcttttccaacgagctaagcagtttgtcagttgtcacatgagttaactctgaattttcaatcattttcaagtcttgaaccatgctttagatatactattaattaacgcaatttgttggctttctcaactctataaaaccgtgtgacagtggaatcatctctctttctgagataataataaagatctaattaagcacattaagcaaaacaaagcatccggtttccagcgatgaatgcatcattgaataaaaaataaacataaaatctagcactgaatgtctgctaaaagtcctgaaaacccatggctctttcatcatcacacattggcatttgcattgacgcgcagacacttcacgctagccgacttcgtcggtgctgtttatcggcgactcgtcagtcagtacactgtgaatctgtgatccatagctactgatgattgagcaaagcccctgcggcgacgaagccggcaaagtagccacaggttgggccacagcccacatggaacggacgggctcacatgctgtgatgagcctgtgacactgtgtcccgatctgtgtaccttttctctttctggtttttacaggctaatcatcatctcactctgctcacccatcattgcagattaagcatcacaggaatgagaaagaaagtaagtataacactcgctttacacggctgaatcctgatcagaaaaatgcccagctggcaggtgtgtctgagaagttgttcccctttgcatcctgctagaaaagtcttttgctacaggttgccacgcccatctgttcgagtccgcggcggcgccaaaatcgctttggtgcgctgcagaaaaaagcgtcgcacaccacagtcacaccatgcccgccctccatgcaacgcggcgccagcgcacggggaattcgcgagagaaaaccgcggcccataatacaacatggcacgaacgcgtacacgcgcgagcgcggcaatgcgatgcgtcacgcgtcggcgcgacggcgcgtattagtattatcctccgcacggggcgtttgctgatgagacgcacgcgccgccggacgcacgtccacggggatgacaaaacgcaggagtcaggacgagacggagacgacgtgtatgcgtggttgtgtgcagggcatcgcgccgcgccgcgcgcggcatatgctgcatgcgccctgtgcgcgcgggggcagttgatccgcggcgttttggaatggagaagggagaggcgcccgagctgccagcctctgcgtcgtgcgcgcgctgccctcgcggccacggcagccgcgcgcgcgctcggtcacgcagagcagaggcaggcgtacgtgaacccgccgtgcacccaccatgtggcccatgctggtgctgcggctgcagtagcgtggtgtacacacaggacgatctacaatggcacgaaacaatggagcatcgcattcgcaccgcatggcggctagatagatatagtattcttttgtcttgtagatcctctggtcctcgacatcctcaagagtctcggaacctcatcaggattcaggacaaggggaagcgaaggtaaacatgaaaacatggtgttggaagtggaactgtaacaccaggtctgtgacgagggagggaccatggaattgcctgcatctgcggcggggataaaaaaaaagcggtatattctctctattctaaaaaaaattaacctcatactacgacgtgacacatactactacaatgaatctggacatagagtatgtctatatcgtggtgccacatcctagtactaggttttttttagaacggtggaagtagcatttgtccacttcagtttttnnnnnnnnnnnnnnnnnnnnnnnnnnnnnnnnnnnnnnnnnnnnnnnnn

SEQ ID NO: 38330 - DNA, 823 bp, Oryza sativa
aaagaatacttgctacactatttacatatgcatattaaaacacacatcctgcctatagcctttttttctgcatttaacaggtcacatatgtacaagacatgctgatgatggatgcagtacgggctgtttgaggttttatcaatttttgtcatgccaaattttggtaagctaaagttgtatttgaatcgaaatcaaaataacctaagttaactattgaaatggccttttttttaagacatgctaaaatttagtttcaaactaaataaacactaaatattattaaaattataaaaattagtaagatcaatttagacctcaaaccaatccagccctacacgttttcctacagtcaaaataaaaattaatcgtccagtcctcatcgttatcgtccctactcatttcttcattgtttcccttttgcatctgactctgggttctgggatacacagaccaaccacgactccacgagtaggaccgcatcttgtccccctcgtctctgctataggtagcctgtagctcgacctttgccaccgtggatttgcgctgaaaaggaggagaatgtctgaaggatgaggctggcttcactgaggagtgaggagtgatctcctcaacctagccccctttcgtcgatcttttctaaagatgagttttcggcggccagcagcatggcaacgcatcgagggcttctatcttgtgctgcctgcactgacttggtctcaatagggagatggtgagttggtgtggtgaagatcaaggaagcggtgcgtttttttttcgtcaattttctccattcttttctgctagttgcataggtctcctattg

SEQ ID NO: 38331 - DNA, 802 bp, Oryza sativa
gcccccatgggctaggatttttttctgattccaaacgactgtccttgccaggccaggctaggcccctgctagccttggatccaaacgcaccctgagccttctttactctgactcatccagatccaatggcttggaataaatcttcctttcatcagatggtcagtatttacttgatgacgtggcgcaatgtggtgaggaaaaactttagtattttcactactttagatacataatctgttgcctgtgataattagcaagcaacttcgttgtacaagctacccaacatatacatggctcagggcaccagggcggtcgcactgcccgtcctaccccaggaccagaccagaactgttcatgagtggtcgacgacggtcgagatgcgatggaaagtatggagacgataacctccacaagagtgtgcatgtagtgtctgaggcaaccgatgcgagtgtacatgtggctgaagtgtgcctgcgtcgcccgccgtgtgccagagtaggctggtggaggccgaggagaagtcgcgtggccatagaggattttgaacttgattaaataaaacatgtctttgtcttaataaaaaccaaagagaacaaaccataaatgtatttgagaaaactgaataagcctttaaaaagaagccaacaatttaactttcttaaaaaatttaaatttttttgggggttcttccaatttctgcccaattacttctactcttattcatcatcctcatcaagcccaattattttttatcttattcatcatcctcattaagaagcttgaggtaatcttgttcatcatc

SEQ ID NO: 38332 - DNA, 2806 bp, Oryza sativa
tatttcaccttgtccttgctgcttcctgatggcacttgagttcactaattcagtaccaattgtcccaccataactttcccagcatgaagatgttgtagagatctcatctaggatttcatatacgatcggtaaaaactacaaaattggcactaggtacatgcaagaacgttatgaattgctatgaacttggtgaatgtgcatccgtttgctgatatcatcttacagccagtaggtgttttcttcttttagggcatttccctttttctgcaaagttacaattctaaccgtgtgtcgcactaccttgagaatatgattcataattcttgacccttcttatttgaccacattaggatggatgtctttgctggtttgatttgcgtacgaaggatgtgcttttcaccatggaggcgacaaatcaaccaatttcttctgtgtgtttcaaagcaggtcagcatgccctccgttgtccaaaccactccagagttttgtcccaaaaatatgtggggcgtgccaatgtcacacactaaaatgtcctctcttttggtaggaaatgaagatcttgtgtatgcctctgctggaaatgaaattttatctttcgatgttcgaatggtaagttcagcatccctatttttattatgtgcttaacttggtttctctcttgtaatatggttaccatgattcttttttcttattagggacctcaagcaaagccattggacacttataactacaatagagatgaaatcaatcaggtaccctggagtatattgccatctcattctctatgaaaagatcactatttcatcctgaaatgatgctttcactttatggatgttctcttattattttacctaaagcttttatgcaaatgcgattggattaaaaagagaatctaaaaggccacatttgatgcagattgctgtgagctctaaaggttttcttgctgctgcagatgacagtggggatgtcaaggtaaaatattgtgttgacataaatgttgaagacaagcatgcttctattatcttaaaacatattaagtgatcaaaatattggtagtgctgtttagacttagaggacttcacttgaaaatgttgaaagagttggcaaatctgtaagcaatgcagtttaccattaaatttaagtaaatgaacattgactgtaaatatttatgttgcagtttttctagtttttcaattattaacaagttatatagctagagaatttatggtgatattttcacactacttgcttcatttaattggtttgttgttagaaagttttcttgttgagattttctgattttgtgtgcttgtgtatcatttagataaaataatagtttttgaattggaaatagatttctgaactaccttgctttggtgcaatagaaggttattccaagtcagaacttgctcatgttttcactcttagagaaattctgcttttgcttttgcagattatcaacaccatccaaaaaagcctgtacaaaagattgagggaagcccacacaagtgtatccttatgtagtgctactgggatgtttaactctgatgtttcatctttttatgatcctagtattttttttttaatttccctgcaacatgtaaatcagttatcccttagttatctttataagatttgcagcagtgtacaattcattccttggagaccttggacaggtcagtgctacttcatgcttcattgtttgacttatacttttcttttgtcaacttgtaagatgcaaatactagctattctccttggattcttttattttaatttgtaatttttttatcctcacaattagttcagtttcatctaacagctattactggaggccttgattcaaagcttgctgtgtgggatttctccaaagggcgaacactgttttctatagattatggtacctcctttttccttgaatgaaaaacttacaatccatgcattgcaccaacttctatgtatgtgtttaccttttgacagggtcatatactaacaattcctagtgaatcttgtatggttactttaatgggttcacatctttaagattaaatgggaaagttgggttttgctgattaaccacaatgctgtatattcccttcttttcgcataaattttctccagcatgcattgattaacttttttttttttttgctcttggacgtcaggatcacctgaaatgcagaatggaagttcaggtgggcaatgtttcaatcctccttttgttcactcaatagcagtttctgaagagggcatcttgggagggtcgtacaaagtttgtgctgttgcaagaggagatggtgctgttgatgtggttgatctagaatatgaacttgcccctgcaaaatcaaaagggcttcctcggatggcagatttgagtttaagctcgaaaagaactgatttaggagatggatgtggtagtcaaagtcaagggaacaggatccaccttgattacacagtgggtggtcatacttcatctgtttcttgcgtgtaagtcccactatgttgtttctctgtaatttcttacatatcttacccttttactaactgcttaatactttaacagtacattttcagcatttggcgagaaggggaagtttcttgtttctggtggcaatgattcatcaattaaattatgggattggtccaaagggttctcctctgaaacaaacaacagtgctgaattggtgttggatataaaggttaataaaaaggtagccactcaaccttaaattttgtgaaatgttgtttgcagactttggctatctatttgcacataatactccattacttgatgtactactagata

SEQ ID NO: 38333 - DNA, 1647 bp, Oryza sativa
gcttagacgggaatacccaactttaaaatcctggctccgccactgcatgggttccacgtggaccccaaatgacagcagccaacccatcttcctcctctctctcttcccaacggatgcatgtccagggacatatgcgagtactgcgcgtccgcggtggcgatgccgtccaagaaggcgctggtatcgtgtatgaggcggagcgaactccgtgagcgggacctggcctaagcgtgttgaagcgtcacgctcaagagcggcttcatctcgtcatcgttcttgttccccaccacgcaccctctcatccttctacccgcagcgggccattgctctctagataagtcagcttcacctgcctctgcagcttcaaaactccaaaccacatatctagtttgaatcaacacattcaaaacctcaggttctgaaaattgcatatcaagatacatttgaaaccctgtgttgaattgaagaactatatcgatatgagcaattttaccatttaacatttgatacccaaaggtacgtaccacaaatttttggtacatcgagataccttctagtataaaatttagtacctcgaggtactttgtagtataaaatttagtacctcgaggttttaaaactttatatgcaaaatgtggtacctcgatgtaccaaatgttggatggtaaaattactctaccggtatacgtgtgcacattgcactacacactactcctctcacctcttgtactactacttcctgtttccctgcgaggcagaggaggaagagagacgcggaggacaccgtcgctcacccacccatcactcacctgccgcgcgcgtggccatgaggctccacgcgctctccgcatgttctcttttttctatccccttttaatgaggttatctttagtcaagataagtgctaaccaaatgaacacttcgagtttaactgaaattttaaattcacatcttcttgaaagggtaaccacttgtttctattttcattgcatcataaaatgatttgactgaaaacaaaatcccattttttgtgagtatcccaaccattttgtgtctctatgtagcaattaattggtagtactgtcacgaaccttataagatttgaattcagatcagacactttccctcgtgaaattgctaaagtggtattgtaaactttttttctaagacaagcttctatttcagaaaaaaaaagtgttttgggcattatgttgttacatcttcaggtgcatctggtagatgttgggctaaattctctccaattggagcctgtgtggcatcccagctaagggcttaatagaattaatagaatactcataccaacaagttgcaacttcttttccggaagccgattttgaaagaactctgagattaagcgtgcttggcctggagcaatttcgggataggtgaccgactgggaaatttttcccgggtgcgcacgagtgaggacaaagtgggcctcggagagtgtggggcatcacagatggtatcagagccgacccttgcaactatacgtatatatacgccgaaaattgtttgtatatacgtggtgctaataggggatgttcctggcctgggttgaccaacgaggacgtcggtatcttaaggggggtgagaatgtgacatcccggcacaggtcttaatagg

SEQ ID NO: 38334 - DNA, 1489 bp, Oryza sativa
tcagcagtcccgctttaagttattcacattttttcaacgtataaacatttatatgcacgtttggactgtttatataaaaacattatatattttgatgtgcaactttagtgataatttagacatatatacttgattttagtcgttttatttaggcttacccactgcccacggtttagaaaatttctggctctgctactagctactcaaatgacattgttagcgatagaagaaatctcaccatataaaccaagccatggaatggaatgccacgagatcacgtaaggcaagaacaaataatttctactatatgggacaagaattcctgagacctagacacacataatctggaaacgaacgagagtggtcgctagcagacagcccgtgaagtacaatctcgacgagcaatctcgcatgtccggtggtccagcgtcccaccaccgcgggggaggcaaggcaatgcaagcggcagtactccccacgccatcatgcctgtccccccctcccctcccgcgcgcgccgccctgctgcctgagacacactccactcgcggccatcatggccgagagacctcctccccccctagggcgcgcaacaatggcgcataaccgcatcgatggccccgacgcggcacgcgcgcgctcgcagcagccacccgggccctcatactactattgcttcgcgtgtgcttgtgcttgtgcttcgttttcgtcgtaacgcagggactgctgctcattcgctcctctttcgttttccccccattgactctggccccgcctccgcgcacgggccaatgcaacgttgatgcgtgtaaggaaggggtaggcaggcagcggcgtgggccccgcgagtcatcggggatgtgggtttggggggtgggtttttttttggagggttggggttggcacgttggaagcggcacgcgcacccacacacagcgcacagcagcatcgagtgcgcacgccacctcattaattcgttcgctcctcgcgccaccatccatccattcattccctccattcctctgcactggactgcactgcggctgcactccatatcctctcctctcctctcctcctctcatctcctgccttccccgcttgcttctctgtatcatcatctgctcaaaaggagtgcagcgacgagaaaaaggagaggaacaccaatccgagcatccaacgcttcctcgtccgctgtatataaaaccgaccccctttgctggctccatccatccatccatctatccgtctcacttcctcccctgttccgttccatcgcccgatctgcttcttctacttctgtctgctcttaattggagtaccaagttatcacctgcagttccctgataattttggtacgccaagtagtactactgcatttgcatcccattcgatcattcatacttcactgtcgttgatggccttccaagctctgataagaggctggtgctgtgtctgtttggcaggggatctctagagtcgacctgcaggca

SEQ ID NO: 38335 - DNA, 663 bp, Oryza sativa
tggatcgacgaagcgggcaccacgcgcgtgacggcgtggaggtgaagacggccccaccgccctggaaccaaaaaatttttagggggggttgggaagggtttttggtcgggtgatcaccgcaaaacgcaacgcaaggaggcggcgggggggatggctcataccttggcgcagggtccaggggacgagtacggcaggaggcgggccaccggcgaagagacggcgtggcgacggcgaaggacggcgcggagcgcggcggccatggcgtcgccgcgagggttttgggtttgctcgcgtctcgtctccacccactccggtgaagcgtacgaaggaagcgtctgtggactgcgtgtagtgcaatgaatggaagaaggcaataagccaagggagtctttatgggccgggccgggcctggctcagtgttggaaatgtaaaggaaagccactgaaagcaaaatgctttcagtttttttttttttggagaaacaaaatgctttcatgtttgtgtgccattactagaaacttatattgctcatctaataaagtttatacaaaatgctttcttgtatttgggttgatgaaccccctggctatattctaaatcatctggtaaatgatgtaacaattttatcatatcaataaagctagccgaatggcgggtaccgag

SEQ ID NO: 38336 - DNA, 723 bp, Oryza sativa
  unsure (1)..(723): unsure at all n locations
nnnnnnnnnnnnnnnnnnnnnnnnnnnnnnnnnnnnnnnnnnnnnnnnnnnnnnncaacaacaacaacaacaaatgagagattcccacgcttgcccaagtcctagctcaacaggcccaactcatgaacatgatgatgcaacaactccagaaccaacagaactaggggaacaatcacgctcctccccagaacaagttagcagaatttcttcgtgtgaggccgcccactttttccagcactaccaatccggttgaggctggtgattggctgcacgtcatagaaaagaagctggacctgcttcagggcactaaccaagaaaaagtctcctttgcttcacatcagcttcatggccctgcctctaagtggtgggatcacttccgtctcaacagggctactgctgaaccaatcacttggcttgagttcactgccgctttcaggaagactcacgtaccatcgagagtggtgtctctcaagaagaaggagttcagggcgctcactcagggatcccgttctgtcaccaagtacatgcatgaattcaatcgtctggcccgttatgctccggaggatgtgtgcacagatgaagagcgtcaagagaagttcttggaaggactgaatgatgagctttcttaccctctgatgactagggattattctgatttccagaagttggtggataaggccattcgccaggaggataagtacaaccgaatggaacagaagaaac

SEQ ID NO: 38337 - DNA, 698 bp, Oryza sativa
catgcgattttttcagaaaaaccctcctgctttcgtaaaataatgcccacatccgagtttgtgttcaccgtacgatcgccgtgaggctcgatccgaccatccgtgtggctcagctggcggatgtttcactgccctcggatcggtgatttgggaatgaacggcttagatatcatgctttcaccctcccccacaaaaccctagcgctgcccagccgcccccaacctcgcgccccacccccacgcccgatggctggtgccgccgcctcgccctctcgctgcaagacgatggtggcgccgtctcctttcactcgccctctctccgcgggatagcggaagcgccatctcattccccggccgcgccctctcgccgcaggcaatgtctccgttcccttcccctgacagtttgggtgtcgccgaatctcactgggattagttcgccaccgtagggagttgccgggactggttcgtcacctctgcgacctggcgacctgacgatctgctaccacgcattctactcctccccaggtcaactttacactccctttgcctaatcctcttaatcaatatatatgatcgatccagcctgcttgcttgcgctgattccatatttgttgttctactcctctgctgaagccatcagcagacacaatttggtacactactacttaaatccctattatatgcatatatacatatctg

SEQ ID NO: 38338 - DNA, 1609 bp, Oryza sativa
attgacattttctaatataataaatccagaagagatttatttagattcattgtaatagaaaatgtcgcatattttttttcgaacgcgcaaaaggattgcatgtcaatatattagaagaaaatagtatttgttacacaacgcaatcagttagactgacttatgccaagaaaggagggaaacaaaagaccaaagaaaaaaaaactaggttattatgactccaacagcggggaagggggcagagcccactactctccccataaaaccccaaaattagcaatgccagctaacggctatagatgaccctctgagaggatggactgaaggacctccaagactgaagataatatagagtcgaaaaccctagagtccactgttgccaggagaccaggagaatcagagaatcgaagccggcacggagatgctcaggcaaagcatgccttagacgatggccaccaatcctggaggcagctaccacggggaggagagagggcagcccaaccaagaggtgacaacacacggagccagacctgtcgagcgaacacacaatcgaggaggatgtggtttgccatctaaagctcttgagtgtaaaaggggcagaccgagtgactatcaatgctgcgcttctgggggagatcgggcgtgcaacaacatcgttgaaatgcaaactagaggaagaatttgtatttagcaggacccttcgcgtgctacagaagatcagcacaagcaaatgagggctggccataaaagaacatctggtacgccgaacgtgttgagtagcgttggtcactcgtctaacactgcaacaccaaacaagacgatccccgaaacctggcgagagctgaaagtgaagcaccaaatcccaaaataagaagaaattgggagatgaattgatttttttggatggaaaaaagtacgtactcaattactcatatgcatggtcgttttaactgctctgttctgccgacacgaagcatgctagctagtagcgtgtacattatcaagcagctcgtcttctatacttctataaaatcaaaggcaaagggaagggacttgatgatggcgcatcgatcgatccccattccatatctgccgtgaacttaaagccttcacaaaccaaggtggacactgataaggtcgtagtaatccagaacctctgcctgcctccatcagcgccggccggccggccggtctgctcattactagcagcacacagtttaaactctactttggtgtagtacttctcgtacacgttgttgcttgttgccattatcacgcgtagtttattcggagtagttctagtctggagctttggaagggggccggccgcttgtccagacatgcgcaggcccagcttgcaacttgccgcgtactactgccccgatgctcgctgttggttggtgccacatcccacgctgccatgccatgcacgtatgtgcacgcacacgcgacgtacaacaacgtcgcgttccggtggccattggtccgtgcgctcactgcgtcctgcatgtgtgtgtgggcgtgtcgggggtctcgaccgccgtgcgcgctcgggccgtgccggcacgagatgccacggttcacatgaggcgcaacgcacgcagcgcatctg

SEQ ID NO: 38339 - DNA, 1048 bp, Oryza sativa
cgtcgcctcatgagtaggggccgcggccagaagctctcgcttcatggccttgaggctccggcgagaaacgtgagcacacactcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctccctcctctcctcctcccacttcctcgtccgctcagccaaacttttgactgcgcggcagtccgcgaggtcgtgaagggaggtgttgtggacgatgcaccacttgccggttgggcgctccccactgggagcgccggcctccttctttttgtcgctcgcaggcctcccctttcgggtggcccgcgaagcgccctcgacggcgaggacatgaccctcgtcgtcggaatgggctgacctcttcttcctcctcctgtcacgccgccctgtccgagcagcagatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacacccccctgaacgcgtagatcaccgcgtgtgcagggatgcatggtatggtgttgcggacttgacagaaccactgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcagcggggttgacgctcccgtcatatttttcggcgatggtgggccggaaccttg

SEQ ID NO: 38340 - DNA, 682 bp, Oryza sativa
  unsure (1)..(682): unsure at all n locations
ccatggttgtcggtcaagaactcagaattggatcgatcagggctagctatggctgaattcttgtgtaagattgatcaggttgtacagctgaattcttgtgtttggctcgtgcaggagaaggagatagcagagcatatttataggcagaggaagaggaggatgaagaggaggagatgctagtcgttgccccagtgcccgcgaatctagccggcatttcgattgttttgccacgtcattatggtcccgtttgagttcactgaatataaagatttttttacgaacacataaaacgagaaaatcgttaatgtacgactaattaacttctagttattataaaattaaaaatagatttaactgatattttgaaaagtaacttctacataaattttttatatgaaatataccgtgtagtagttcaaatatcgtgacaacaaaataccgaggtaaaaggtttatcttaattagaaacagagctatgctaattgattaggctatgtttggcaacctgggttaggaacccatgtgctgcgcacggaaaacagagcaatctattaatatgtgattaattaagtattagcttcttttaaaaaaaagggatcaatatgatttttatgcaatttttgtatataaacttttagaaaaacatattgnnnnnnnnnnnnnnnnnnnnnnnnnnnnnnna

SEQ ID NO: 38341 - DNA, 4521 bp, Oryza sativa
  unsure (1)..(4521): unsure at all n locations
aattatactggcagatttatgattttattcccaagacgagtttgaaatttgatctaccgtttcaagattgagatacaaattctcattatggcaagtgatgatttgaagcgggatgaggagatgctaatactgtcgtgcaccaatctatcagttgcgcatacatgtttcaggacacacaagcgaaatcatcgagagggagttggaaggttcctgtccaaatcacatgagggtggtcaaatttttggcggaattgctacgtccgtttgcccagtgtatcagaagggtaataagaagatctaagtactccgttttgagcacaagagtttcgcgtttctgctaggattacagaaattcatgccagcaaattcaagattttattcccatggtgagtttaaagtttgtgcatcaattttgcatctctgctaggttcacaccggtttatactagcagattcaggatttattcccaatggcgagtttgaagtatagtctacctcttctggatcgagggtgatacagtatagtcatggaggctatttgccgcgcagtgattttatctcatatgtgaggttgtttggagattgaagatttttatgttgggaaattcgtatcaaggtggagattttgttaaatatgtgatccgaaatttaggcctgcaatatattcggataagtttactaatagaacttgactattatgattagtttactagtatgactcttaaatctttccccactaggattcatatatttctcctatatatatccctcgtaagccgcacaagaagggtgcaacagcccaatgtattccccgcatttgtatccaactcctctatagtgattattgttggtcagcgcccgtggttttttcctataagggttttccacgtaaaaatcgtgtctccattgtgcatctattttcataatatatcctactttgtttcaaattatgtctgatctttatttttctaatttagcctcagataactttttttgcacactgcgcaagttctaattcataattacaagtggctacagcactgacatctcactgtatgtacatcgatctcaattgaaggtgattttgtttttgttttctttgagatcaactgtatgtataattctgaatgtgccttttttggctatcaagttttcatgtagtccatttagattaatcattcatgtctcttttccatattatttcctcattcaaagcaagaataacacttcaatgtataccaaatactgtttggtagaataaaaatatcactcagcaaagcgcggggtatctatctagtatctataatctatccgatcatcaagttagaaaaagaaaaaaaatgtgtagaggaagcaccattggtacgttgatggagtgactccaccaccaaccaggtttaagattcttatgctcacaattatgttttgcattttttagataatggaataaaatctcagcctttgctcaaggagctacagccaattattatacaaattcacacaaactagcataaaaaacaagttttaaaaaatacaccagcaaagctaaagaaaacacaagctaataaatatccacacaaaacaaagacgcattaattattgaattctactgggaacctccaaccaaagttattatgttttgcacgtgggtgcgtttttaatagaattcaatgatgatatgaatctaccgttgatttttgtatcttcgagatcgtgtcaaatgatgtattattatatattcttatatgtccgagtgtagtatatgtatgttttggtgtatatatactgctttaagtgatgctagtgtggtattcgagtctgcctttaataccacaaactaacatgtgggggccataagccccacaacacatgaatgaataagagaattgttaactctagaaattgcaaggggtttcacacacaaatatatatgtgggtgtcaggtgaattagaagtgttcaacgttgtattgtccgaccatataacttgtggaaatatatgaagaggataagaatagatgatccaccagcatagcagcatattttagtatggctgcctttgaagatgacattatatatctaatcgaccgactatactgtatttttttttcttttataatattcgttgcaacttctgggtttttacctagttcggtaaaaataaaaagaaaagagaatcgtgtaaccgacgtacgtgcacgacgaccccactagccgctcgcgcagcccactatgggcccaccgcatctctgacatcacggcccgatacttcattccgcctcggcccaaatttcaccaaatcaaccgaaggatgggccggtccgcctgcctgcctgcctgggccgttaattacacatttacacttgcaacgggcatgaaaaacattagcatcacggtgattggatttttgctgcaaattcgagagacagaacggcttcaattctgtctatatatctatcactaactcctacgcgagctcctcctgaggaaggaggcggtgttggcgatgtcacgcagcggcttgtcggtgaagcggagcaggttgtacgcccacgcgccgcacaccgtcccggttcaccggcgccgccacgtacacccacacgccgccgtacctccccgccaccatcgccggaccaaggctccgagccgggttcatcgacgcccccgtcaccggcctgcaaattaaacccccaatgcaatacacactgtagcagcagcagcaacaacaacaatgaggggcctcatcgtttagcttattcgtggaataaatcaaacgacgtgtttataaaaaaaagataatttgtgaataaaacttttatatacaggtttttagcgctttaaaagtaaaggctgaaaaataaactttgatgaaaaaaattcacaaaattagtttcaaatttaattttaaaaattcaaactggctgataagtataagcataaacgaaaaagaataccgaacaactactactaatgcggcatcaacagcacgtagttaactgtgaaattttatgatttacttcaacacataccctgcgaagagcacgttcaccgcgaccgtcgcaccgacagcgagcccagccaattcaccgatctgtgttgtacaccacaaaattatcatcgatcatcatgcatatatatatagttaatttgttagttttggtgttcgatcttatactgctctgttgtccgtggcgacgccggagacgacgaacatgaggaagaaggagatgacgaactccagcgccgccgcctgcgccatcgaccccgccggcgtcgtcccgaagaacaagtgctccccgcgcgcgccgccgccgccgccgccgaacaccacgcgcagcgtcaggcttgccatggtggatcccagcacctgggccaccacgtacgatggcacctgcaccacacacacacattgatcaccacaaatgagttattggcagtaaatttaaccgaaacataatccgatccatcgtttgatccacggttgataagccctggaaaaattgaaggaagcaaccacaaataattgacgggtagaaagagatgtacttaatagtacagcgttaagtggtgtgtgtggttttcaatcaacgagatcacaattccttcttagaaaatgtttggagcaaaatgtctctccttccaattctcgtttttaattgacagttaaaaacttttacatccatgttctttacaatctaaaagccaatgttaaaggagaaaagaaatattatctatcttctatctactactatttaaaaaataaaagaaatttccgtcgtccgtttggaaaaaaaaaagcgagaaaaacaaaaaaggaggaaaaaaaatcaatcggcaaaaaaaaaacgtccaactccccggtggagaaaaaaagcgagaaaaaaaggagaaaaatcttctaccatgaaaaaaagaaaaaaaaaggtccgactcctagagaaaagctacgactccctaaaaaaatttcttgtccgtaatcttctcttctacttatactactttactttttttaaaaaaatatatctcttctctatctctactacttaaaaaatacaaagtgtttcctccgtccgtctaaataaaaaaaatagcgaaaaaaaccgaaaaaaaagaagtccgattccccttaaaaacagggaaaagcaaaaaaaaagagtttgagaaaaaaaatagcgaaaaaaacaaaaaaaatcgtagatccggttcccttaaaaatggggaaaaacaacgacaaaaaaacatgctgtccgattcctatgcaatggaaaaaaacagtagatctgattcccacatatggttttcctgttttccttcttttttttcgtttcttttcctttttttctttcccttttttttcttttcttggttttttatttcttaatactatatatgtatacaaactttatatacacgtatacaaactttgtatactgtatattttttatacacacgtatataacaaaaacctttaaatcaacttttttgannnnnnnnnnnnnnnnnnnnnnnnnnnnnnnnnnnnnn

SEQ ID NO: 38342 - DNA, 749 bp, Oryza sativa
cgagctctgtaccctatgatcaaagtcaaaaaacgcgagatcgaagcagcctctctctaccaaacccgacgaaaaactaagcatccgcagatcagctacggtccaatcaaatcatcaaccgcgccttggattccaactaacacgagcgagagagagaagcgagccaaccacggggaaggaatcgaaaaacaacaagagaaacagaaaaaaaaaagcgagagaagaggaggactcaccgtagaggccgggagaagaagcgtacactcctctagggaggaagacgcccctcgagtacgaactccgaaggaagacgcggcgccggcaaccttgcaagtcacttcctccacacctgacgtcgtcgtcgtcccctttccttcaccttcaacttcagtcggtcacccaggtcggcgcagtctggcgccggacgctaccccgtctccaccggcgccggcttgccgccgtattcgccggaccagcgggggaagaagaggaggaggaggcggcgccgcggcggcaatggcgagagagcagagaagacacaacacaaaaaaaaatatttctgtaattttccacgccttcctcaaaatctccggctcaatttatttcgggggggaattcaattcaatgcacccagggtggtgtaccgaaattgccctccccgcccgttccgggtttccggcctttcacgccacgtggcacgcgatggacgagggtggagcacacggcaggaagcgatttcctcgttcttt

SEQ ID NO: 38343 - DNA, 697 bp, Oryza sativa
ctagagaaaaaaaagaaattacgggtacttctttcgtcccaaaataaacgcagccatcagtttccaatgtccaatttggatcattcatcttatttgaaaattttctgaaaaggttaaaaaaaatataagtgacgcataaagtactattcatgttttataatctaataataccaaaattattattcataaaaacatttcaattaagacgaacgatcaagattagccacgaaaactaatggttgtgcttattttgagacggagtgagtatattgatagggatggaatatgaagttagtcgaatcctttcttttacatgcaaactgacctgtggtagtaagctcgaatctcgaattctagcgtagcgaagacagccacgagctgttggaagctcatacctgggaggtggcgttgggctctcctggcagcagagagcttgtacatctccatgtcacggagctcttcgcgacaatggtggtaagggccaagcgcaaccagctgaggggtgtaggcttcaggtttggtgcatagtaggggctttgggacatcaaagatggagatgggttggctgtcatggacttcgatctcctcatcaagaatacgtttgatgcgaatgatccattgtggtttgtcgaattggagatttggacaaatccccattaaatggtgaattgtgttaaacggatcggaagattgattt

SEQ ID NO: 38344 - DNA, 578 bp, Oryza sativa
tatgagaatgtcccaactgttgttttgaccgtcatctttaggccttaatcaaacgggtcgcatctctgcattttgccccatgggctatcgcctgaatatataggggctagccaatggggtcatcgtacattcttgagggcccgtttgaattggaggaaaaacatatgaattttagaggattttaatcttataggaaaatttcctatgaagccctttaaaacaaaagattggatcctatctaatcctttaaaattcctatggaatggacaatcctatagagattttggaggaaatttagcaagagcttcaacctcttgataaatttcccttgagtctatctctctcattcaattcctacgtttttcctgcggttcaatcaaacggccattcctgtatttttcctgcgttttgcaatcctctgttttacacttatatttctattaaaatcctacattttttctattcctacgttttctcaatcctgcgaatgaaaggggcctgaactgtgtcattctttggagtcttgtttcacaactttgggcggcatgcaataggctgtaggctttagtcacaagtag

SEQ ID NO: 38345 - DNA, 612 bp, Oryza sativa
ttcgccaaagaatcaggcttgcagatctcgtcgctctcttcccccactcttggctgaactatagggctcacagatccagtcaatttgcaatcatcctcctccccttgctgaactttcaagcatcctcgattcatctgcagtaatcccgtgcccatatataaatgcagtagagcctccggcctccacgcagtaaatcggagagcaaggccaactcgatttgaggagagcatgttcttgcagaagattgctactggacacaagattgctcgtggtgagaactgagaagctcccaaatttgatttcttccgccgatggtgcctcgtctatctagatttgcaggtacgaggacttttttcttatattaaatctctccatcttcctgccatggatggatgtatacgagctgtctatgttgcttcatgtactatttccacatccagtaatcttgctttgggcctttggtgctggattctgattttgcattaatggagattgtcgatggtatgggcagtagtagctaggaactttctggccgtcggcaccaagcatgatggaagacaacttgtatttaaagaagtttatcatgaggaatgtgcaaagcaaattaatggc

SEQ ID NO: 38346 - DNA, 109 bp, Oryza sativa
tcatgatgagttacactcgccggcagttgatccgtacctcgccgttcttcccggtgagcgggctcaggttgcccagcctcaccatcgcggcggcgaagtccgccgcgaa

SEQ ID NO: 38347 - DNA, 661 bp, Oryza sativa
ttacctccctctacttggggcccctaaggggcgatcagtcgcgcccctggcgtggcgcgcggtcagtttctgaccctttagtctctcctctgtactacatgtatatacgtatgtactagtagcatgcccgtgctaacgctacggtaacatgtcgtaaaacatattaaatagtcaaaataagatgtggtaacaactaactatagaatgagataggttggcataggaaatatcatttttgttaaagtaaggacttgtggtagcaaaccaatttcacccaaaaggaagctcagtcagttctggtacaacttttttacagactttcttacaccttttataaaaaagaactgattcattcagcaccaaacacagcccttggatctgccattagggaatatccacacacacacacacacacacatatatatatatatatatatatatatatatatatatatatatatatatatatatataacctgaagaattatcttcagccgtggttagtgctggttcgtgccactatgtgtaggtagaaaatagtactaactggtggcgccaattaaatttaggaagaattaactggatacaattacaagaatgttgattccattatggagcagcatatgctctcaggcggcataaatagtgcacccgcacccta

SEQ ID NO: 38348 - DNA, 630 bp, Oryza sativa
cgatgggacaatttcttgaggacatttagcacaaaattgtgtgcccgaccatcagtgtcagcttggtcctgactagtcttttgacaatgatgaagctaggcccactgcagcaagttgtgtgacgtgagaaatcaagattgttagttctctgcagctagttgtgtgaagtgagagttcaagattgttaatacggtgaaatgaacgtatgttctctaagagtcagcgtgtttttgtgcttgcaaccagcttccttgtactaatggcgaaatccatttatgttttgtgttattttagctgttctttcttacaaagacaataccacaatgatgtagcgcatcatcttcaattcttcctcatgtaatgtaacgagtaaatcatagtcaatattcaagcttacatggtgctatatgtagcacatatgtacgctactatgaacaaaactatgcctgagtaatgaaacatgtttttttttttttttttttgctcaccaataacctctgcaagaacacctaccttcttcaaaatggtgaaatctatttgaatccctcaaaattatctctctaccacacatcttggagatgaacttggcagcctcatggcaatggctgcaaactcttgaattcttggtca

SEQ ID NO: 38349 - DNA, 635 bp, Oryza sativa
tgatttatttataggcgcggtctccgcctttccctgtacgcgttggcctacgagtcggactatgtttgtccgggtcggagttaagttcgggctcgagatagcagcggagaccgtcggattttgatcgcacggtttgcggctccgtgtcggcctcgctggggttcagcgctgcgacgccatgtccgagacggattcatcggcggcggcggcggagggtcggaagccgaggcggctgcgggggcacaagaagggcgccgtcacctgatgcgtcgcctcctcctcccgcccgggcgtcgtcgcctcctccggcgaggtaagcgattctgctcgtgcgtgggtctttcttccgaggggaaggcgcgcgacgccatccagggccttgcgacttcctctgccggagcaacgcgtggcctctctggtgggagacaccttgctgcagcagcagcaggaggaggaggagaggggtgcccttcgctgaggacaacggtcgaacacctcgtgggcgctgtctgctgagctagtggcacaatcttgtaggctcgcatcgcatgcttcctcccctgcgatgcagaaatctgcagccatgactattggcagccaaattcattgccggaggctttagatggctgcttgtg

SEQ ID NO: 38350 - DNA, 638 bp, Oryza sativa
  unsure (1)..(638): unsure at all n locations
nnnnnnnnnnnnnnnnnnnnnnnnnnnnnnnnnnnnnnnnnnnnnnnnnnnnnnnnnnnnntgataaataatagccatgctgcatgttctagcttgagagtataagaaataatatgcaaattaaggaaatgagagacgtttggcttgcctggaacagtgcgccttgtggaagtaatcggtggtttttgatgccgccggcgccggtgcggatgaagatgtggcgggcgcccaggcttgttggcagggcactggtcagctacggcttgcgctggtgcccggcccggctgcagcacacgcgccagttgtcgcagcgaaacgtactcgagccacccgtcgtcgttgttagatagcttgtcgtcgatcctgttagtgcgtgtactggtcgctgaagtcggcgatggtcgataatcagggtgaagatatgtccgccatccttgtctgtccgatccggatatacgtacgtatatgcctcgacaccacgccctcaggctgcacgcgccactgatgcctcgccgcggcgcgccaaggttggacacgtcagtgctcgtggcggcctccacggtcgcccatgcatgatgcgggtgcgccgtcaactcagcatcaatgtagtggggtaccgagctcgaattcgccctatt

SEQ ID NO: 38351 - DNA, 830 bp, Oryza sativa
tctagaggatcccctcttcagtccctttagtactatcggccatcgtttgaaacctctaacataaaagaaaaagttatccctcacattttaaattactcaaattagtacaaacaactttaaattgcgaaattaattactacttactattatgctagtatagatatgttattaattagtacttactattatgctaaattaattagtacagacaaaattaaattgcaaaattaattactacttactattaagctaaattaattagtacaaacaaatttgtacaaaatttgaaaagttattatcaagtagtgcactaattcacaattacatttcctcgacatgttgtttaacaaaaaattaaaaaggcaaacatatcctccacaatttttttaaaaatatgttaacataacctcctacatgttatttaaaaaatttgacaaattcacatatcctgcaaaattgaacataccctcccaattccattcacatatcacccacattcccaaattcacattcacaatcacatataacccctcattcacatatcacccacccctcattcccaatcacactgacggagcgtggggctcctcaccgggagaccacgcaggcccccctttgccggttcggccgggggccctgggtgagattctaagctctcggtgtgtggaaggttcgcgagaatggaaacacacaagacacgggcgatgtatacaggttcgggccgctgagaagcgtaataccctactcctgtgttttggtggatctatgtatgaagaagctacaaaagagctggagaaccagagagctcttactctctccctctctgatcg

SEQ ID NO: 38352 - DNA, 377 bp, Oryza sativa
ttaagccatgggaggataggattaccatcaacaccattggccatgttgttagggtgaggaaggaagggggaggatgcgccgctagggaatgaggaggaagtaggactcgcattgtatgatgcccgcgggcttggttgatacgaggaacacgggcttggtgatacggagcacccaatcacttccatgcgttcaggaggcttgtatccctgtggaaaaaggcacaatcggttacacataaataaaatcattcatcaaattattcaattagctgaaattaagtcaaatgcattgtttctcaagatgtttgggacgcagacaagcacatttgatacagaacaaggtgagtgaactaacaacacaaacaacctccaagcttt

SEQ ID NO: 38353 - DNA, 659 bp, Oryza sativa
tactataggcgaattcgacctcggtacccgtgtacgacatatgcaagaaaggtatggaaaaaatatattatatatataggatgtggcttcagggctagtagctattttttccctgcaggtagatctcattaaaaaagaaactactagctagtgttgtccatgtttgccaacattgttggaattttttttttaaaatggaattagtaagcttagttggttaatttcaatatgcaaccatccgtgcatgcataaagaaatttgtgtagtctgcatctaagctggagatactattactacaaatactgcatctatgtttgaatgcatccaagtcttaaaaaaagaaaaagaatgttcaccacatgtcatcacaaaaatgcttgatatatacctagacccgtatcaggttcagtcaggtgacgaactaaaactctataagcaagaatatatagcagttaacaaagctctttaccgatagctacatttttgaagaaaaaatgtctggtgtgattactggacagcgatggacacgtatgtaaagcggttgcatgcattagtcaatgctagtcatgcatgtccgtcttacaagcacagcgcagcacgcgtacgtacgtacgcacgtaggatcgatcgagcaagcggctggtaagtgtagtgacata

SEQ ID NO: 38354 - DNA, 270 bp, Oryza sativa
aaaacagggagcagctactcttctgtagggcaatgctaaggatcacaaaatgggaaggaacccaaatgaaaggagaaaaaaaaaagaagggaagcagggttccctagcttaacatgtctctcagtctccaccaactacatttatccttaaccttacctactactcaaccagcatgccccgtcacgtacttaacaccagcagcagcagcacgcatttctccatggttagataatttacataattgtacttcttctctggtactgagtccct

SEQ ID NO: 38355 - DNA, 388 bp, Oryza sativa
ggttatttcgtcaatctctccagaatttaccggccctgtcttcgaagatgttcatagggatagggtttgcgtgcgtgtgttcataggcccagtcttcgaagatgctcatagggatagggtttgcgtgcgtatgtttataggggtgagtgcgtgtgcgttgtgagtatctgcgttgtactgtgtaattctaaaaaaaataattagtattgaattatttatgggtagtactgtgtaattctaaaaaaaataattagtattgaattatttatgggtagggtttacgtacgtgtgttcataggcccagtcttcgaagatgctcatagagatagggtttgcgtgcgtgtgtttataggggtgagtgcgcgtgtgttgtgagtgtctgcgttgt

SEQ ID NO: 38356 - DNA, 564 bp, Oryza sativa
  unsure (1)..(564): unsure at all n locations
nnnnnnnnnnnnnnnnnnnnnnnnnnnnnnnnnnnnnnnnnnnnnnnnnnnnnnnnnnaaatctaaaaactagcatcggatgtaaaaatagacatctgattgatttgttctcttcaagtcctaagtactagctgtgttggtgcatgcaagtatgccatctaatctgatttcaacatttttcctgatttgatgtctctatcttaattagtttgtgagacgactaggcaacttcagctagcgtgtcatttttaacagaactccctcacaaaaccaacgtacctgatccgattggacctgctgataactattgttctccttgcattttctgtcagggcaactctctcaagcaagccgcagccagtagcaaagaccgaaaaaagcaatgcttcgagtaaaacagccggcaacaagaaacctgccaaggctggaaccaagcaaggcaacattatgtcattcttcaagaaggtataagccttctcgcttatctgacagagttattcaggaaggagtatctgttgttgccctggctaaagctaccgtgccaagctcccaggcaactgtagt

SEQ ID NO: 38357 - DNA, 707 bp, Oryza sativa
tcaacctcgctatggcagaaagaaggaagaagacaggagaaagaaggaagaaggtggaaaaggaaggaaattgacggaaaccgtgacgacagtggcatggttctaattttgtaaaatttcagtggcacggttacggatagactgagttgttgacgatcttgagttgtgcatctgccatccagccaaggctggtaagctgctcaatggtaagatcctcgaggcctgcgcagcggctatagaaggcttcaacgatgagtatcttggtctcgctttcatcggcatcacgtcttaccttgtgcaacttttcttggagcttgtcggtgcgctccttgatgaagccatccagatccatcgtcttcttgtatctgtctagctgtggcatggccttgaagcgctcaagaaccctcgtcgcctcctgcaccgacagccaaacctctgttgcttgcacctcgccctcaccatacaccatgaggcatgtatccacactacatagtgtcgacaactcgcttgccttcttcttctagcccttgagccgcttcttgaatgccgcccgccacttcgcatcattgatgatccgctgcaacttcaccttgttgcgagccatggccttcacgattcaccactttctagcaagactgcacctatggattgatgggaaatggttagattgatatgagttcaaagaaaggggaatatggtggttttat

SEQ ID NO: 38358 - DNA, 784 bp, Oryza sativa
attgaaagccatgtatatttgtccccattttctttaccatggtatatttatccccttttgcactttggaccaccctctctccatctatctcttctccacctctggttccctaccccccccattcggaccttgattgacaaggcgtctgtgtgctccttttctcttgaaccgcgacattcttcctcccaatcccatttctccatcatgcctcttagcacctcgaccacaaacgccactggatcaagtgaaattggaggaggaggaggtcaagcttgggagccatgagagcataggcgatgatagagatcgagctcatggtcttgatgatgctcaagtttctggtgttgcaagtgaatatcaagttttgggtcttgtcgatgccgttgatctccctctcctcatggagcagagctggagggcaaagtagtgcaactgcatcggcaatccccatgaagaagtaaaagcggggtagtggcagtcgtccccaactctggtcagttagatctagggaaaaggatggcatcaatggtttcatggaggacaagaagaaggaaggaggtagtttttccttactccggacattgatatttagaatgaagctgaggtaacaggcaacaatgagcttgtagaggtcctcgttgtcgagcttgagctccccaccgttgtcttcctacaaggaagagactgagcttaatataggggacaccagagtcaaatgttgagcttgagctcgggggaggtggcaaaccagcaataacaggtggggcgggggtaccgagctcga

SEQ ID NO: 38359 - DNA, 481 bp, Oryza sativa
ccttcgggaagctgaagaggccgcccgggaggccgcccgggtccgccaggcggaggagctgctcgggaggaggccgcccgggctcgccaggctgaggaagctgctaaggaggaggccgaccgggctcgccaggctgaggcgacagctgctgctggcgcgtcacttgggcccactccctcgggcggccctcaggcgacatcctccgaggcggctcgcgacgaggccgcgggcgcatcgcctgggcctacctcaccgggcgacgcccaagaccaaacgggcccgggggacatccccgagcccagcgcatcctccggggggccaagccgcgtcgcattttctccaaggcggctcttctcctcatcttctgtcgccccgctgagcgccgagccccttctgtaggccctggccgccgcaaacaccgcagtgctggaggggttcaacgcccaagtggaggccctgcgtgccgaacgagcggagctcg

SEQ ID NO: 38360 - DNA, 652 bp, Oryza sativa
gccctatatctttgcagtaagtctttcttcctcctctctttcactctatgacacataaactcaaaggcgacgacccacagggaataaagccaaccgtgcggcgggaggtgggaagaaaggggtgacgccgggcaagaaaggagtcaacggcctccgcatgttcgtccctagcctgcgcgccacatgcttgccttcttccactccgtcaggcggaggggaggagcacacacgggctgtcgtgcttcctattcgaggagtccacaggcggggccatctgcctcctcttccacctccatacgccaccggaggagtggaacaccgccgtcctagtggcacccattgtgctcactgttgatgctcctaaagttcgtagtggcgccggcgctggacgcaatggcagggacaaggtgagggaggaggctgggggctcgtcacatcggtgtgggtcgtcggtgggtgtagtgcgtctccggcacagctacaccctctcgtgtgggaggaggttggcagcgcctgggacgagcgggaggaggaggtgcttcgccacaataaacacgctcgccaatgccatcttggttgaggataaattaagcagcagcaacctagttaatcgtggcggccaccatggccgccatgaagccagagctcatgc

SEQ ID NO: 38361 - DNA, 1897 bp, Oryza sativa
ttaggccaatgcgtgataatggaactattataactcaggtgatcaaagtaaccaaagctggtcatataatgtggtaagatatgcttctgcccctttacaagatattgagatataccacgtttaggcggttaatgcatgacagtggaattataactcaagtggtcacagtaaaccaaagctggtcatataatgtggtaagatatgcttctgcccctttaggccttattcagtttgatggggattgaagaggatcggaggggattgagagggaataattccacatcacaataggtgtggaataaatcccctccattccccccacctagggatttaccgaacatgaccttacaaggtattgagtaaatatacctgttgctaaacttctcgatggcagtagatgcataaagaagtgtttcaccagccttctctaacgccatataaagttctcttcctcgggtaactttagcaatgacccatgcattatttttggctctgatgcatacttcaaaatccttgtcatgacaagagtcagacctcttggcccttgacttctccaaatctatttcttctcttagtctattcaaggaaagtagagaatcctgcatgatttcattgcagagcacggttaaaagaaatgcatggcaatccaattcaacacaaaaacgtaaaattgcaaccgaagaacaatagtgaggaagaaatgaacaggagatacgaattgatcatctaaaacatattagtctacaaaaacagaccaactttaacaatctttaggatctaaaatttatggagatattgaggtgaagagaagaacagaaccattaacacatattgtaggaaacatcgtatgttactctatatgcaagtatgcaacagaacaaacctttgagagggtggtgactttcccaggtggggaggctcttgatacttttctatctggatcaacaagtaagtagcgatatccaccaacatgataagcattttctcctccccatcctcgtgataatttcagctccagagtcacaatgttctgtgatgcctgcaatataaatataaaaaaatgagcatgtgttcacaaccacagtatcaatattttgcaagccacaccagacatgagaatatttcttattttcattcaacatggcctgcttgagctcagtaccgcatcaagaaatcatgaaaagggtggaaattatgcaagggccactcacattttcaagaagatgtctcttcacatgagcaatgccatcatctccatttattagagatgaagctggaatcagtagcagaatggttatgttcttgtgctgataaacacagagatgcatgcggtcttctgcctgctggaaccacagtatgggaacccaagccacagcaccacgaacttttgaagtagtggaaccagcggcaacaaaaccatcctttcctttgtatagtttctcacgctggagaggcctgaaataatgatgcatctgattttgtccgccaggagaagtatcacgagatcgactacgatacctttctactgaagctgttccatttgatgaactagaagtggggccagcatgaaccgaagttcctttccgcagataggaccaggaagttgcattggacaataaagcacgaggagttaacctcaagatagcataagtatataggtttagtgtatcatcctacaaagtggtaaaactacattaatcacatgggaactgctcaaagccatcaaagaaacaaagttataaaagaagtgatgattaaagggagaccccgtaccggtggaagtgttgtggacaccaagagatcttcaaataatacaagtgattggcacatgacatttccaagacatgacccaagaactgtggtgagtgactgcaaatattcatgcatcaatagttga

SEQ ID NO: 38362 - DNA, 1398 bp, Oryza sativa
ttatccataatagatgctggccagaagttacagtcttctattgcgtaaatctgtttactactgcagaatgctaatatatatgttcaattttgatgctttgttatttctggaagatgaaatcaatatcatatgctcatgaaaagtacatattcacttcacgtcgtaccacttacttctatgcaatagctttagtgacctttgggtgcattttatctaacttattctttaacttgcagctctatatgcccagatgtacaggcttgactgctgaaggtgtggtgaagattgtccaggttctttatgaatgcaaggggaatctaaaccgcattcgactccatggtatttgcaggatgactaagcatcatcttgatgctatcagttctgccatgtgcaagggtaaccaacaagaagatgatcaatcacttttctatagccacagagtccatgaagtgctcaacaccaacgatgaacgccgtattgatgttgatgtgtgccctatgtgcacaaatgtgaggctggtgtttgattgtacaagggatggctgtaggtttgtaccttctgatcttttgaactcttatttgctctttgcttcgaaaatttcccttcaaatttgttgaaagtttgccactgtttttcttatttgcttattgacaactcatctttgctatatggtcacaatattcagtgcctttagatatttgatagtgttgtctcctgtggttgtggaatagctgacatagggatctcatctttcctggaaagcttttaagtgatggtccagaaactcatttattctcctcccctatgggctacaggaaagcaactgcacaattaatttttatttggttgctctcgtctttggaacaactggttcaatatgttaaatattcttcagtattttttcaggtctattgactttgacctgaactttgttcgcatttctacaaaataaggtttgatctattttgatgatttatttatatttcaggagaaaggatagttgggctcaatgtcgaggctgcttcttctgtgttgcccgatgcgaaacatgcggtgggtgcatcgacttggaggagctcagcgagactgaacttgcatgctcggacttcctgtgcatggagtgctggcttccgctcccgaaatgtagcacttgcaatcggccctactgcaagaggcatgaaaatctgaaggtagatttatcaccatctggccagtttacttgtcatcgttgcgtggaattttctagtaactcacgcgagaacctggaagaaagttcttagaggtgagttcctgcccctctacaggaaatacaagttgtcgagtatacttgggtatgaaactactgtctgtgtaccagtacttgctgatgacttttacttaaagcgtcaaatgtactag

SEQ ID NO: 38363 - DNA, 290 bp, Oryza sativa
aaagccaactcgttgattgatctcgtcgggtcattctcgacaggggtgaactcagtaactcgatggttctgtggttctctattataatctctgtggttttcttcataatcccatataaacaagattgggactattaccttacgaggggtctgaactaatataatcattgttttctgtgtgcttgatatcgtttcgtataaatcctcgtaccaacgtaccctaatacctcagaatacgatctacatgtatcccccgttgacaattatatcgagagtagtttgaaggtgaaa

SEQ ID NO: 38364 - DNA, 852 bp, Oryza sativa
ataaaaaaaatcaatttctagatgaacctaaacaagcatgtatccaagttcatcccccaaaagttatctatttttaggatagagggagtgcaataagtaggaacttaggcccttcacagtgctccaccctggagcgttccttcgtcccaccacgtagacttcgtgatgtcatggaggagagaatgtgtgggcccgagttcctccgcatgattgctcggttccttggtgagcaacgagttcctcataaaaaagcctgcaaaaaggtctgaagcatgcacaaaaccatcggaaagaggcgaggaagagcatgaggaggagaacgggaagagtctgggtcacgcgtctggctcgccacttccccaccgccgaggccgccgcgctcgcctacgacgacgccacaagccaccaccgccgccgcgctcgcctacgacagtgtcgcgagcgcagcggcgcacgacgacgctgcaagccgccgtcgtcgcgtcccacccggtgatcgtcgggctcgccagggaggtcgccggcgagtgccgtgggctgccactcacgctcatcaccatcagcatggaggaggagaacgccggcatgctgtaggaccgagatgtcgactagaggagggtgaataggcgatttaaaaactaaatgacacctaatcaaaactaacctaagttgctaggctcggtgagggttaagtctaactaagcaactaagttatgttttgcaaacctagggtgatagtggctcaattaattctctaggaaagtaaattacactcctatgtcaatgttttgcaatcctagggtgatatgatctcaagaaagtctctaggaatgtaaattgcacaaatgtaaa

SEQ ID NO: 38365 - DNA, 801 bp, Oryza sativa
aatcaggatgaacctaggctttgtacaaaggcgctgccatctagttcttttgttgcaggccataatgagtataataacctttcacctgtcctgtcacaaaacaatactgaaggtagcatcaatacaactccaaaacaagtcaaagttcaaggctgcaggaaaagtttgtctaaaaaattgtcgaagtgcaaggcaaatcagagagatagctctgcatcactatcaaaagatagctcatccagcagccaatatccttccacctccagtaatgctgaagtaccaagacgaaaaggggatttggaatttgagttgcagctggaaatggctcttttagcatctgcagctaaaagtcaagacaacaagctagcaactcaattaaatcagtcaactgatagcttactaagttcaactccaccattgaagaagttacgaaaaagtgaagaagcctcaagcaactcgagcgtggtttggtcgaggaatagagcaccgttattttgggctgaggtattttgtggtggcgaggcatcgtctggaagatgggtccatgttgatgttgcaaatgatattattgatggtgaacaaaaagtagaagctgcttccgctgtttgcaggaagcctttgagatatgttgttgcctttgctggaaatggtgctaaagatgtgaccagaaggtttacctctttcataattcctaacttagtagctatatagaatcatgaggatatattctttgcttttggaaatttgtaaaagaactggtttgagaactgggttctatattttcctagggattgcctgcaa

SEQ ID NO: 38366 - DNA, 790 bp, Oryza sativa
taaattaataagtgcttgtccatcctttcatacattaaaattaaatgataggctaagtctctttaagagcagagatctaggtctttttaaaacagagtttttttagtaaggccttgtttagttttcaaaaatgtcacatcaaatctttagatacatgtatggatcattaaatatagataaaataaaaaactaattgcacagtttgtatgaaaatcgcaagatgaatcttttgagcttaattagtcaatgattagcgataagtgctacagtcacccatatatgctaatgatggattaattaggcttaataaattcgtttcgtggtttccaggcgagttatgaaattagttttgtcattcgtgtccgaaaacccttccaacatctggacaaacgtccgatgtgacacctaaaaaaatttcttttcatcaactaaacaaggccttgtattattcgtgatctcacgatgaagtcaggcacacgcgtgatcactacagtagtacacacaaatcgatcgatatcaatcacacactcatgaatcattttgtgtttgactcggaacgagcgatctatcactctctcaaactgtgctcttcctcactcttgacgatacaagtctaccggtttgctaattagcaacaaagtcaagaaaagacaccagaactcgtcaattacattgaacgttcctacctacgcgtaccaacacacaaatatgcctattgcctaaggtctaaatcttgaagataaatacatatgtgtacaacgtatgtatacttcatgggtaccgagctcga

SEQ ID NO: 38367 - DNA, 608 bp, Oryza sativa
acttcatataagatttgattgatgtttatgtaggcaacggcgagaagctggacttcgcggcgcgggcgcgcatcgcgctggcggtggcgcgcggcgtggcgttcatccaccgcggagggccaatctcatcgcacggcgacatcaagtcgtccaacgtcgtcgtcaccgcgacacgggacgccgcctacgtcaccgactacggcctggcccagctcgtcggcggcgcggcggcgccgccgactacgaagcggggcgcggggtaccgcgcgccggaggtggtcgacgcgcggcgcgtgtcgcagagcgccgacgtgtacagcttcggcgtgctgctgctcgagctgctcagcggccggccgccgctcgacgcgacgccggacggcggcgccgccgtcgacctgccgcggtggatgcggtcggtggtgcacgaggagtggacgtcggaggtgttcgacgccgccatcggcaacgaggcgcgcaccgagggggagatgatgcggctgctgcagctgggcatggagtgcaccgagcaccaccccgaccggcggccggccatggccgaggtggaggcgcggatcgagcccatcttcgaggacgcgtgccggaac

SEQ ID NO: 38368 - DNA, 1403 bp, Oryza sativa
cgtcaaatttagcgggtgcagacttcatggacttgtgcaacttgtctgaaactctgaataacactgaaacagtccattgccctcaagtcccatatgcctatggaatgtgtttaaccttccaggcttccagctcagaatgtgctcagcatgacagactgaaggacaccgttattaaccgccatttgtcattttggagcgtgctgtactctgtctggctgccatttgcgcctataatttcagaattcaaatgatactcctgcaagaaatgctactcgactggaataccttccatcatctgttcatcttttacaggaagaagatacctgtccctgtactatttcgaatccgagtctaaatttgagtagtcaattgagggtttagatcatgttttgcgataaacttgtacaatattgaaatactcgacagttgatagcactttgctttccaaaatttgttccgtagtctatatcagtattttggtccctcattatcttggtcgagagagggtcactaacaaaataaccaaaatgtaccttttctaatgcgattgtttttaactgcacatccatcttcttttccgcttctttaccgaattattgtcatgaattgtttactccgtgcttcaaaaaacaaattttcttttttttttaaaaaaagaaactttcttctactgcgttgcttggactacttgttttaaagttattacataagtttatttctcaaaatatgtaatttattcttacaactaaacagattactgtcacgataattcgatgaataatctgtttcaaatgctaaagcagatcagcggcacctactgaataatcccgtgtccatccctacttttttttagacacaatttctccatctccctcgaggggagcaagccagcaagatctgaaaaagggttttaataaaagcataaacaattacttcaagttcatgcgtctccatttgctatttgagcaaccattttcaggagggaatccaatagttggcacggtgaagtcagagtctagctttaccaaattgagatatcgcactctcgagcgagtccctccattttagaccacacctaataacatcaagatcatgaatcctcccagatgtgaacctggaatactggaaacacgtgtatttcgtgcacaatgagcaaagttagttttacatccagaaacctgtttcgcggcgatcatttcacaatgatgttcgctgagatttttttatataatggataaaaatccggtctctatatccacaagtgtatatacaaccaaacatttcagaaaaatattattttactataatattctatagcaatagtcaagattcctttggaatataggaattttacaggacttgaggtatgttcttttctcttacagatgggtaccgagctcgaa

SEQ ID NO: 38369 - DNA, 121 bp, Oryza sativa
tatatatatatatatatatatatatatatatatatatatatatatatatgtatgtatccagcgtgcgtgtaacagcacagtggaatacatatccaacgcgaaagaaggagggtaccgcgct

SEQ ID NO: 38370 - DNA, 718 bp, Oryza sativa
  unsure (1)..(718): unsure at all n locations
aattcgagctcggtacccaaaactacctccttccttttttttgtcctccatgaaaccattgatgccatccttttccctaaatctaactgaccagagtgggggacaactgccactaccccgcttttactcttcatggggattgccgatgcagttgcactactttgccctccactctgctccatgaggagagggagatcaacggcatcgacaagacccaaaacttgatattcacttgcaacaccagaaacttgagcatcatcaagaccatgagctcgatctctatcatcgcctatgctctcatggctcccaagcttgacctcctcctcctccaatttcacttgatccagtggcgtttgtggtcgaggtgctaagaggcatgatggagaaatgggattgggaggaagaatgtcgcggttcaagagaaaaggagcacacagacgccttgtcaatcaaggtccgaatggtggtggtagggaaccagaggtggagaagagatagatggagagagggtggtccaaagtgcaaaaggggataaatataccatggtaaagaaaatggggacaaatatacatggctttcaatgaaaatattagatatgggtagtcttagtgaaagtttggtaaaaatcttactcccaaaccacaatttactccatttcttnnnnnnnnnnnnnnnnnnnnnnnnnnnnnnnnnnnnnnnnnnnnnnnnnnnnnnnnnn

SEQ ID NO: 38371 - DNA, 364 bp, Oryza sativa
ctccaaaccaaaagacccactaccctttaaattttttacatatttacacaaaattgccactcaactacccctaactcatctctcacccctctctctccctcccatcaggccgcaccctcactctccactccgacaagctcgacggcggccggcgcgcggttggcggcaaggtctacggcggccggcgcacggcgggcggcggggtcgacggcggccggcgcacggcgagcagcacatggtgggcggcgtgcggcgggttggtgcgcgggcggcgcacggttggcggcgaggatgacggcgggcggcatcagggacggcgcgcggatggcggacagacagtgcaggcggccggcaacatcgggga

SEQ ID NO: 38372 - DNA, 472 bp, Oryza sativa
acacacatattacacctttaattaaaatgtatttttttagaaacaactaaaaataaacttattatatacacttaaatatttatttttatttatcacgaatcttgaggcaatatgacaggcatccggaccatacccccaaggtggtgtccggcgcactacaagatagtttcttttttctttttagaacttacaagagagtgttgatctgcagtctgcatgcacaggtagtgggagattgacgaagaaaaagtgtcatcttccttgtacaatggggccttcatttaatcactcgataattagtggagcattaactaattaaagaacagtgtggtggattgagatgaagtagctcttaattaatttgcagacaggtagcaagctaattaatttccacgatcgatcttatcgtggctccattaaattttgatcggaaagaggagctttttccaagctaagtgcctcaaagagaccg

SEQ ID NO: 38373 - DNA, 683 bp, Oryza sativa
tcgagctcggtaccctgtggactaaccgttgtctttgagctatatattttaagttaggttcacgtcatatgtgcgcatggatgattatcgatggattaaaattgacggcgcaaagtaaagggaaaaaagacggtaaaactagtgcttttgttttgaattaatcgaggtgtagggcgatcaaatttgctagtttatttttagtttcgacgtactattaagaggggtaatgatctagcaaagagatgattttaattgccacattaggtcattatgcatttagacttgtgctcacatttcacacaacacacactaacaccttgtattcactggttttcggcctgaccaagggcggtcagaccggccaccttgtggcggtctgaccggcggtccctggccggtctgaccggccccaagcgggcagtctgaccggcgcacaaggtcggtctgaccgacggcacttgtgcggtcagaccggccccctgaaggccgggatggtgttgctcggggtggccgatatagagccgacggagccgtattcggtcagaccaagttgagggcggtctgactggccaccccatgtcggtctgaccggccaggccgattgggccctctgacagggctacaacggctagttttctagccgttgcaaaatagcacgggctgaccggcctcatacctccggt

SEQ ID NO: 38374 - DNA, 700 bp, Oryza sativa
ctcggtaccctactttccataacattgagtgcattataatgagacatgctcaacaatgagttaagcgctattatgaaacatgtttatgcaaatacctttttttttctcgaaaacgagagaactgcatttcatttcatcaaggggaagaaaacaaaataaaaatatttacaaagtgtgcaaattacctttcaagcacacacttttgactaaggtgctaacaggtttgggctaatttgtgattgttaaagattgttaataattttacctaattaaacatccacatcagattgcataaaggatccgactaaaattgtagacagcaggatgaatgggaccagaattttgaaaaataaatcaagtactcagcatacctctaagatagtatttttgaattcggaacagacaacaattccatcaaaaactggaaggcaccgggtgtttcgataatcaaatccaaccatggctggggcaaaatcaattccaagtctctttgcgacctggaatattcttggtaacctcaggtgtacagtaccaggcggaagacatttctctgaccacacatcgacttgaccacgctcattcttggacatattttagcatttaatcagcatggaacaccacaaaataagcactgatagctacctaatgaaaatcaatagtcataatcaaggaggtctacctttggtacaataccatttac

SEQ ID NO: 38375 - DNA, 963 bp, Oryza sativa
  unsure (1)..(963): unsure at all n locations
agggaagagaagctcctcgtctacgagttcgtcgtcggcgcaggcagcctcgccgccctcctccacggttcgttcatcacatcacctcgccttctcacttctcttcgtgcagcgaaagaaacacggtcttttgcttataaagagattatgggtttggcggaaaaacataagaattttggaggattttaattctataaaaaaaatttccatgaaggtatttgaaataaatgattgaaccctatcttattctttgaaacttctatggaatggacaatcttatatggattttggaggaaatttagtaagagctctaacctcttaaaaatttttcttttgagtctatatctctcatcccattcctgtattttttatgagtccaatcaaacggttattcctatatttttcttatattttgcaatcatttgttttgtatttaccttcctattaaaatcatgcacatttcctatttttttttcattcctgcgattcaaagggctcttattatttcactcaatagagagcatatataaaccagaaaaataagtagtaaacaataactaataaccctaacacaaaataaagacaaacatttattcaaatctatttgtaaatctgcacatgaagttgataaatatccatatggccgctgtctttatgctccgtcacatagtatttagtactccatccgttccagaatataagaagttttaaggttggacacggttattaagaaagtaggtataagtaagtggtggagggttgtgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38376 - DNA, 674 bp, Oryza sativa
tcgagctcggtacccatcgtgtcatcgtgtgtcttgtggttttactttgcagctgaaatctgttactatggtcttgtgcatatttttgacatgtgccttgtttatcatgtagagtgtcaagtgttgcgccatacccatcctcaaagagtccactagagagcagtgacaccattggcagtcccagcacaccgagcaatcatcgtgcacggacatcaccccttcgaccaacaactgcgaggactcactgtgcttaggtcagccaaggaacatcagcttcagcagccaggagccccccagcacaaagttacagatatgagacctggtgatcattgtataccgaagattcagctcagcgagagtcggctgaccttgatgccagatcggacgccttctttcgcatccgtgttagggtatgatgagacatagaagagatcactagatgctgtttctatcctggctgcaaaatctttctttggctagagctgtttataagtgctgatctagccacagccgccgccacttagtagtacgagagctgtgacattgcaggtaatttcaggctgttcttgattatttttgccctgagccatagcggcattggacttgagaggaaaagaaatgctgctgagttgtataggattacagattcggcgtatgtaattttgctgtttttt

SEQ ID NO: 38377 - DNA, 541 bp, Oryza sativa
ccgcgcccgtcccccggtgacgccttcgacggcgctgccgccatgaagcaggttcgcctcgcctccgacctccccgtcgcccacgtcgtgtccctcccatggtagattctaacggtctgagctgtgtgcagcggcagtttggattcaacggccggcagcagtacgccgccgcggcgcagcacggccaccgggagcagggcgtggactcctacggcgtcgcggcgccgcaccatttcccgtcgccgtcgccgtcgccgcgccaccccgtgccgttcggccacgcgaaccccatgctccgggttcatagcctccccaacgtcgccggcgggagcccctacaggaaccaatccttctccgtcggcaactcggtggccggctccaccgtcggcgtctacggcggcccaaggtggataatctctactctgctctaatagaaatcatttctgaattttgagtgcaaagctaagaaaaaaaaatgagaaaggcattgagctgaccattggatcgttgacttgcaaaagggaccttccaaatccgaagg

SEQ ID NO: 38378 - DNA, 728 bp, Oryza sativa
ctcggtacccccaaccaaacagaaaacaagaatttcacctccgggtagggcgggaaaggcggcggcttggaggcttcgtcgtcggcggccatggcggaggaggaggagggggtgggggagaggggatggggaattttcgctcacgaagaggaggatatatgaagaagaagagatggatttggatcaggaatagataagaaaatatggaggaggaaggaaggaagaggagatggatgggctcgccttctttatttcttttttttttctctccatttttttttattgttaagctcggctgtgtcacctgtgtgagaggggaagtgagaagatgaggatggacggctgggatgagtcgatccgccgccatcggacggcgcggggagggatgggtcacgcggatcggtgacgtggcaggggtaggggtaggggaggggagaacgcgcgcgctcgagagctttatgttttgtttgcttttgcctcccgtcccgacccgacccgcgggtgccttttttgggggagctgtggaatgacggtattgccctccgtggtggcctcttttttttggttttttctgtggaagtgggcggtggtcaggcctgtgatttggctgcatggacaaagcggaaatgccctccctcccctgagttgggtgtgtttatatcggtattattgctaatattgttacatgcacagctgaggatgtacaacggtatagtgtggctggaaat

SEQ ID NO: 38379 - DNA, 1255 bp, Oryza sativa
gtcccactgtcatacacacattgcgtcttgtagtccgtgctgcagctggctacagatttgtaacccgctgctcttctctctcatcttttatctcattaaaatatgtttgcagctagcttatagcaggtacaatagcaggctacaaacaagctgcaaacatattttaaggagataaataaggaaagagaaggacaacgggttacagatttatagccagctgtagcacggactccaagacacaatatgtgtatgacatgtgggaccatgtattaatagtgtagtatgtaactattatatgaataagctattaaattggctatagatgaattggagctagtagttagctatactattgaacttgctcttagtgtgctaatcgtcgatttgattccaagtccagtagctcatgagtcatgacgcgttaccggccaatcgtactggatagtactttttttaaaacattttgtaaacgactcttgcgtcgaagatcaacattacaatcacatttatcttgcaaacaaattgtagactgaccggttttggaaaagataagccccgtgacggaatgagaagaaatttacaaggtaaacatcatcgtacaattcgcctaggcttggagggcaagattatagatttatttttacaggaacgagttcccaacttccgtatccgcttggagcacacggattttttttaaaaaatacgttgtgatttcacatgaaagtgcacgattaccatggggattcctggtattctactaaattgccagaagggtttgaactttctgagttacatttattggatcattgccaaagaaacatctgtagtgacattttctttttctaaaccattctcttttcattttatcaacattgacagcagttcgtagcatatgtcaaatcatatatctatctctgctaagagagtaaatagatctgagcattaagatgaaagtacataccaccaaaactgatccaactcaaagttgacaaaataacaaaacatctttagttttaagaagcatacaaatccaacatccaaataactcaagttctaaagagaactaggcactagtgacgcttaggaggtgttggcttgggccttgttgaggatgacaccctcgtacttgacctggaaccacttcatggcatcctccttggtgaccctgtgctggataccaacacgggacttgcacctacggcgccgcgcaacacggtacccagcacgctcaagaacgacgtagaagtccataccg

SEQ ID NO: 38380 - DNA, 997 bp, Oryza sativa
tccgctctcgccgacggagatgttgaggacaagcttctgcaccttgatctcccgcatcgggttcgcctgcttcttctccgacgcctgcgagcacagaaaccaaccaaaagaaaacgcatcaaaaccacgcgcgcccgagcggacagaagaacgaatcgaggagaagacgtcgccgacggcaaggcggcgcgcctctcaccatggcgagatctgggaggcggcggcggcgagggggaggcgggagcggcggagatggggggtttagtgttgctcgggcggcggcggggaaggagctttgtaggagtaggggaggaaaccctaaaattgttgtgctgggtgtttgtatggtgacaattactatattgccccggtggaatggaaaagaaagggaggggcatttacgtaatttcagttaataaaagggattagaaaaaaatttccgttgccgggactcgaacccgggtctctcgggtgagagccgagtatcctaaccagctagactacaacggaagcttggtttctctgtaattctaattttatgtatatgttttgtatatgtagcaatttacaaaaaaaatgtctaatcttctgtttgcttgttcattggaagattcgacctgattatcacaagccgtataaatcgatgaattcttgtcgtatatctgtcatatatgggaagaaccgaagaagcccaacttttcttggcacaaataatatcatctctgtgttgctgtctgataaacttcattttatcggttattagtattactgtttgtaatcatgtattaggagtaacagtttttaactactttttatagtttggtgaatgagccaagacaattactcgggacttggtttcagagatcctaaaacatttcaatgcaacagatggccttaaaaaaaacttatcatagacaggggctgaccataagaaggtgcattacatgtattctacatttctacagctttcaacaagtgaaagagggtttcagagtga

SEQ ID NO: 38381 - DNA, 947 bp, Oryza sativa
agaactccctgtcctccaatggagccaaaagtttgttccttctgctctctgcttcaatccactcacagccacatgaagaaaaaatgagaactgatactcagggaaaattttcattgataccctcaaagtaatattgaaattttttaggcatcatttttttggaactagtaccaaagggttttaagtagtactacaacacaaatgcgtgatgtccttttcatgaaattttcttaaatgtgaggcgtgaaatgggaaactttgcaacccaatccagaaagctatccatttcaaccaagcgaagccgcggcaacatcgcgggatttcgcggcaaaatttgaactccccttcttcttcttcttcctcctgctcccatggcgacgcctccactcacctccgtttccagccacctccgagcccctcctccatggccgcctcccaagaacagcagcccaagaacaagggttaggtgcgacgtcctcgcggcgtccggtcatatcctggaggcggcctctgctccgaggggcgccaagaattcgcggagtcgggcaccgagaaccgatgtggacgtgcagattgagaggctctgtcgggcgggtgagttagaggaggcgttgaggttgctcggctcggatggcgtcgacgcccggagctacggcgcggtcgtccagctctgctcggatctgagatctttggaggccgggaagagagcccatttcttggttcgcgcatctggtgttggaaaagatggaatggatagtgttctcggaaggaaattggtgctgatgtatgtgaaatgtggggatttggagaatgcaaggaaggtgtttgatgaaatgcctcaagtgagtgacgtgcgagtttggacttcactgatgagcggttacgcgaaagctggtgagttccaagacggcgttttgctgtttaggcaaatgcactgttctggggtt

SEQ ID NO: 38382 - DNA, 696 bp, Oryza sativa
gacaggagctggactctactacactgctaagtgttatgccggcttgtgtacagtcgcactattcatttataggaggagtggttcatgggtattctgtgagaactggattgattagtgagacatctcttggtaatgctcttcttgatatgtattcaaattgctcagattggcgtagcactaataagatattcaggaatatggaacagaaaaatgtggtgtcatggacagcaatgatcacaagttataccagggctgggcattttgacaaagtggctgggttatttcaggaaatgggattagaaggtatcagaccagatgtcttcgcaatcaccagtgctcttgatgcatttgctggcaacgaatcactgaaacatgggaaatctgtccatggatatgccatcagaaatggaattgaggaagttcttccagttgctaatgcactgatggaaatgtatgtgaaatgtgggtatatggaagaggcaagatttattttcgatcatgtgacaaaaaaggatacaatctcatggaatacactaataggaggttactccaggagcaatcttgccaatgaagccttcaccttattcaatgaaatgctactccaactccgacctaatgcggtaaccatggcctgcatccttccagctgcagcaagcctttcatcgctggagcgaggcagggagatgcatgcctacg

SEQ ID NO: 38383 - DNA, 595 bp, Oryza sativa
  unsure (1)..(595): unsure at all n locations
gtcaaacaagccacgtaggcgccacatcagccaaaaaccgcggaaggaccttgtttgcctgattttcgtaagttgggggacgggtcgtacccggttttgcggtcaagggacgaaaatcggactggacgagaaatagaggcacccaaagtgaacttattccaaattctgcagctcgtttcagtaggaaggaataagttcactttgactcccttacaagtgacccgaatctaattcatgaccctaaaccacaaaaccagatatctagacccccaaactattgaaaccagtgcaatttaactccctgggtggttttggaggggcggttttgctgacatggcgctgatgtggtggtgttgacctagtacgtggggttgacgtggcgcttaggtggtatttgaataaaaaacatatatgtgggacccgtttgtcattcacacacataaattttgtggggtccactgacatatgggccccacaagtaatcctctttttttggttcctccccttttcctcccattttttctttctttttctttctctgnnnnnnnnnnnnnnnnnnnnnnnnnnnnnnnnnnnnnnnnnnnnnnnnnnnnnn

SEQ ID NO: 38384 - DNA, 537 bp, Oryza sativa
  unsure (1)..(537): unsure at all n locations
nnnnnnnnnnnnnnnnnnnnnnnnnnnnnnnnnnnnnnnnnnnnnnnnnnnnnnnnnnnnnttatatgtttaatgccacttaaccgtctaaaattgttaatagagtgatatatggtgggttagaggcggttataggatgtaaaatggactaaaagtgtactatacctgggaaggatgtccacgggtactggcgggcctggatcataagatgtgttggagatactgatatagtcattaggaaggaatactaacagtgaaacaccgtcacgctacgaaaacaatttctatgagcatcattgtcgtcatcgttgcctagaattattcttgacatcattgcttgtcatgtgattaatccccataagaagaaagaaaacttagctgggcataaaaaatatatctaacaaatgaaggtgtaaattataaatcctaaaaatggaattattagatcccaaattgataaattggagtacaaatggaaatattagaaataattggaaaagcctagaagaaaagatctaattttaagaaataaattcc

SEQ ID NO: 38385 - DNA, 368 bp, Oryza sativa
  unsure (1)..(368): unsure at all n locations
nnnnnnnnnnnnnnnnnnnnnnnnnnnnnnnnnnnnnnccatggagattacagtggcataaccagagggtgcaatttgtggcatcagtcgggtcagaaatagaagaagtaccaggattggaatgggacggtacagagccagaaatatttgaagacccttctctgcgaaagaccccgaggtgcaagagaccacggtccctgagaaggccactacctgttctgaggtgcctagagtgcttaggagccacgactccaaagtccaaagatgagaacaaggagaggttcatggtaatcgtcttcagagggggtaaggaacgtgccaagctcagagatgatgacccccagaaggccgctgaactagccgggcca

SEQ ID NO: 38386 - DNA, 705 bp, Oryza sativa
cgaattcgagctcggtaccctgcagttactcaaggaagttgaagccgatgctattgaaattatgggggattctttgctagtgatcagtcaattggcaggggagtatgagtgcaaaaatgatacattactggtttataatgagaagtgccaagaactgatggagtttcggctggtgactttgaaacatgtgtctcgagaacaaaatattgaagctaatgatttggcccaaggggcaccagggtataagccgatgatcaaatacattagggttgaagttgctgcattaacagccgatcattggagatatgatgtacatcaatatttacagaatccatctcaatcggcttctcggaaattgcgttacaatacgttaaagtatactttgttggatgatgagctttattatcgaacgattgatggggtgttgcttaagtgtttgagtgccaatcaagctaaggttgcaatcggtgaggttcacgaaggaatttgtggtactcatcaatcggctcataagatgaagtggttgcttggtcgtgcagggtatttttggccgacaatgctggaagattgtttcaagtattacaagggatgtcaagattgtcagaaatttggagcaatacagagagcaccggcatcggctttgaatcctatcattaaaccatggtcatttaaaggatggggaattgatatgatcgatatgattaa

SEQ ID NO: 38387 - DNA, 712 bp, Oryza sativa
ctataggccgaattcgagctcggtaccctttacggctcagtatagacagataattgtgccgatattaaggtaatgatatgatttcatggtgcaggtcttttagcctcctatctggaggaagctccattattctacgaatcatattgtaaccaatacattgggtcaatattgggtctataagtcaaggcagtaatcacagattatgttgtacatctagcgaacaaatatttatttggttcgattgaagatttcagtatttgtgaactttactagaccgcaattactacatttttaaaatcagtgctggccctatgtatgttagctaacatttttcttgtgctatagtcatttctatatctgctactattgtttaatatttaatggaacattgatttcataggttagcgttgtttgcagggtgtttcagtgacactgaaaccatggttgcctgagaggattaaagccacaggtacttctgagttgtaacctgcatagttccattctcggttgatctgtgtagtccataccgattaacaatacatatgtgctattccaaagaatccaacccttagtatctctagctatacgtactgtgttattctcttttctgctttgatcataaagtattatttcaatttatttgtgtgtgacgaagtgacatgcacttcaaacaattttacatgagacatgtcatatgttccaatagggcaca

SEQ ID NO: 38388 - DNA, 1971 bp, Oryza sativa
ctttcgcaatggcagggctggtcccgccattctcttcttttttcatggatattctggagttttatgatctccagatggcgcacctcacccccaacgcggtaatgacgttggccatcttcgcgcacctgtgcgagatgttcatcggggtgcgcccatctctctggctgttccggtggttcttcaccgtacagccggtgtcgccgccgtcggtagtcggtggctgctacttccagccgcgggggcaggtgctgaaccgctacattccctgcgtcctccgcaaaaagtgggacgactggaagagcgattggttctacacccccctcgccgacgaagcgcgcctccgacttccgagccagcccccggcgcaggcctccagctggcgggcgacggtagatctgggaaacggctacgacgccgttcttgaccgcctggcgggtctgcgatcccaggggcttacggggccatggtgttcggcgactaccttcgtcgccggatcgcgccgctccaacggcgcgcccggggcgcctgggagtacaccgggcccgaggactccatgaggacccaccaggggcgcacatgggactgggaccctgaagacttcaggatggtggtccaacgggtgctgaatctcagctccgtggaggcatccctcatcccccaaggagtcctccccctctgctgcgatccagagcgcgccaacatcctgaccatcatgctggcggtcggggcgtctggggagcgggccctccgaggccacgatggcgcgggcgggagccgcaggggggaacaatctaccccgggagggggtcgtgcttctgggccccgcgacgggggcccggggggcagctgccctgccgacgcccgggggaagaggaagcaggagtgtaccccttccccatctcctccctgagggggcggggcggtgcgtgccagcagcaggcgcccggagggtgccgtgccgacgtcgcagcccgagggggagcgaaagaagaaacggctccgcaagatgggggggaccgagccatgccgggggaacctcatctcgcccccgaggtggtcgtttagccgacctcctcgcaggttcgtccctgcacccaccgcggccgtattcattctcccatctcccaaggcgagttttcactcacccgtttctttttgtcttctggttttttttttctgcctcagcgagatcccgtcgcgccccctccgccattcccagtccggccggtctgaggccgaggagacggcgaccgcagaggcccggaggcgggaagctgaccggcgagaagccgcggaccgcctccgggaagccgaggaagccgcccaggaggccgtccaggttcgccaggctgaggaagccgctcgggaggaggccagactccgccgggccgaggagtcagtccgggaggcggaggcggcgcacgcacgccaggcggcctgccaagcccccgacccgactccgcccgaggcgacgacgacttccgaggccacccacgacgaggccgcgggcgcaccgctcgggcccgacccctcgggcgacgctcaggacgagccagcttcgggggacgcccccgagtccggcacgtcgatcggcgggccgagccgtgcggcaccctcaccgaggcggccctcccctctgccttccgctaccccaccgagcgcggagcccctcctgcaggccttggccgccgcaaacaccacggtgttggacgggttaagtgcccagatggaggtcctgcaggcggagcgggcggagctcgacgcggcgtgggcacgcgtcgaagaggggcggcgctcggtggaggccatggtggaggcgggccgcaaggcacaccgccggcacgcctcagagctcgaggcccgtcgtagggacctggcggagatcgccagggaggtggaggagcgggagactgccctcatcgtcaccgccgtgctcaacgaggcgcgggacgacctccgcctccaatacgg

SEQ ID NO: 38389 - DNA, 1275 bp, Oryza sativa
cgagctgcagggcgcgctggactcgtccgccggggaggtcgaggcccttcgcttggcgggcgaggtagggcccggcatgcttcgggacgccctctcccgtttagaccgcgccgggcggcaggcgggcctctggggcgggcggaccgcgaaatacgccgccaaccaggggggcctcgcccagcgcctctcagagatggccgggaccctccagcggctccccgaggagctcgaggagacgatcaagtcatcctcgagggaccttgcccgaggggcggtggagctcgtactggcaagctaccaggccagggaccctgacttctccccgtgggcagcgctggacgagttccctcccggaaccgaggacggcgcgcgcgcgcaggtccgggacgccgccgaccacatcgtccacagcttcgagggtacggcccctcggctcgcgttcgccctcgactccgacgaggagggcggtgacgacggtgcggacgacaacgacgacgaggctggcgacccgggcgcgtcggagtgagcccccaggccccctccaatcttaatagcttttccttcttcttccgaggccttcgggcccccttcttgtatagactaatttaatctgcaatcaaataaagaggaaatttctgcgtcaattctgtttgttgtgtgcatgagacgaggatggtctgtgccgcggtccttctgtgtcttggcttgaacaagggctcgtgcccaggtctcagcctcaaatggcgcgggtcggggctagtgcctggggagatccacgtgtcgagactggccaggccgggagcgtggtgaccgagggttatggatgacccgattgtgggcctttgccgattcccccccggagttcactacgccccggggcacggctcggttctgggccccttttggcgattttagccggcccgggccaccgagggcaggatcgagcacgagcgtgctaattcaagccaagattcttcaaaaggaaacaatggcacagacacagtccttaggaaatcgaaaatgcttttattgaaatacggaagagaaaaaagataagtatatgcatgtggtagcccccggccaaccctgcacgcccggggggtggtgcggggttggcccgagcccgagactgacacccgacccccactaggggtagaagcgacgaaggtgttcgatgttccacgggttaggcagctctgtgccgtcgcccgtggccagccgaacggagcccggccgggggacgccgatcactcgatacggaccctcccacattgg

SEQ ID NO: 38390 - DNA, 4237 bp, Oryza sativa
atacaagttcttttcaggacaacatactggctccggtcctaggctcaactactaaatggctccggtcctaggctcaactactaaaatgtgatgaagaaatcaagtcagtgaaaactgcatgtcgtaatcttgagtcaatggttatgcagctgttcgctaactatgaatggagattcacaaatagaattcaataatttttgtgatctttttatgttgtgtgagtttttattagtttgtgtgtacttttgtttattcaggtgtgagtttttgttgaattggtgtaataattggctgtatctctttgagcaaaggtcgggattatattctattattaaaaaaagatatttgttagtgataaggcttagtagttacaatgtaatctagatagcagataagataagatagaatatgttcagagtttgatgtataatattatcaccttgtaaaccacggtaggggtatttcctacctatataaatgaaatcacgggccgggcaccgtttccgccattctttgatatcagatagtaacccaaatcaaaatgaagaaactaaattgctgctatatttacgctaacttctctcaaagacatgttatggcaccctttatacttcaacattagcaaggtattcttgcgaagatcatgatcaagaattcaagatattcaataataaatttatgaggctattttgtttaccaattttactacacccttatttcaaattatagattcgttcgaagtttaacatgtctatctttgaccgctaattttaaaaaatccatgtagtttaacaacatgtaaataatatattgtaaaataaaatataaatcttacgatgttaaactataacaccgtatatcactaattgatggctaaagattagaatatatgatttaaagaagacatagaaagaaaaatgtaatttgaaacagatgaagtatatatatatgaattgtaaaagactcgatcgttcgtaccaggtaccgggacatcaagaatctgcccctgggtgaggtttttgggatcggtgatcccgttgatcttcagcagcgtagattccttgaccccaaacctcgcggcgatcttcgatacgttgtccgcggcacggactttgtaggcaaagtgcgtcacattgttcccctccacctggtcgcagctgcagggaagtgggatccagagctcctgcccgacttccaggaagtcaggattggagatgttgctcgcggcggcgatctcctggtaggtcacgaagtcgtcaaattgagcggcgatataggacatattgtcgtttatctgtatgatgtggaagggctggctctcaggccggttggcaccggcgacgcaggagcagcggaacgggacgataacggtggcgttggtggggatggctgtgtgggacggggtgctcggcgggaggccgttggcgtcgaagaggtcgcggagagtggtggtctcgaagctggagaggagctcgatgtaggtgtggcggcggggggcgtgtagacgatggctgactggcatgttgtcggccaggtgcaggtgaagttagtggccgatgcggacgacgcgaggatgaggaagaggaggaggatagccgccgcggaggaggagaatgatggcaccatggtaacgatagctatgctatatgcaagaggtaattaagtgtttgagatgcccggtaagtttgcggaggtgagcgtttgcttcttcatgagagaggagtgcgcgcggacacaacacgtcaaaaaccatagggcaagtgtaatgtgcctgtggcgggatgaccggtagtagtgtgacgtgtgacggtgggtggcggtcaaaaacaacacaagccgtgttctgcggtttgatgtgtacagaggtcagcctcagaaagatcgagaaaatttgcgatttgttcgtcttttccgtcgtctcatcgagtccattaattctacgatcgaagagccccgatatgattgcttaaatccaagctaaaattttaattttaaaacttacctttgaaatttatttaatatattgtagacaaactttctttttcagcgtaggaatttaaatcacactaacagtacatatataaaaagataataagtcgtaatggtttataataagctttttgataaccgaggtctgatgttaccatccactggacgtctggatctgatggtttttatttcgaaaaattgtttcccaaagtcagtggtcaaaatagtgcagcgtgcaatataaaattgaccaacttttcctagactatactttattcatttattggctctagctattaggctgtgttcgataccatgggttgggaacccaaatcctgtgcacggaaaacggagcggtctattagcacgtgattaattatgtattagcaattttttttaaaaatggatcaatatgattttttaagcaactttcgtatagaaactttttacaaaaaacacaccatttagcagtttgaaaagcgtgcgcgcggaatacgagggaaaggggctgggaacctcctcatccgaacgcagcctgtctaattttgactacttttgagttggggctatctatttgtcaagtggctgatttttcttatctatcagtaacttttttagcactagctcaaatcaacaactcacacttcgcatattatttcccatgcggtgaagccaatatatagtgttctaacctaaaggtagaaaatatatattcttaggtgtaaattcttataaatatgaaatatataagtgtagcgcccgttccgtcgtggcgcctaacgggaaaactatctcttaaaaaccctaattgcgaaatttgtatcttcgcttgttgtctagtgtccgtgccatctcagatctcaaatccccgatctatcgtcgagttcaatcccgaatccaaatccttcccaaatcaattcctccgcaaaagtctaatttgcctcccccgggttcgatgggccgaatctctctcggcccatctcctcctccctccccagctctctctctctctctgtccccctccccctccgctccgcccgcgcgccgcgcgcgcgtgcgcgcgagagccgcgccgagcgcccctccctcgctctgcccgcgcgccgttgttcgcgcgcgcccgcgtggtcgtcgcccgcgtcgcgcctgcgctgtctgcgccgcccggccccgctgccctgccgcacctgcagccgctcggccccgcagccagcgcgcgtgcccgagccgcgccgctcaaaccgccgcgccgcccgttgcttcccgcgcgcgcgtgccgtggtggccgaccgcctggtcgccgccgccgtaagcctctgccactcctgcccgcgcctgccgcccgtgtcgtcgcgccgctccaaaccgtcccgccgtcgtcatcgcctcggccccgccactccgcgcgcaagccgccaagggacggaggcagagccctcctccctctgccgcgacgcccccgctcccctcctccttttcccaaagaagcaaggggcgagccccctttctcttcccctttctcctcctttttccctctcgccggcgtcacctcctgtcgccgttttggccgccagccggagcgccagctcgtcacaccgataatcggctgggacggccggagcaccatccccggggccttgatggcgtaaaggctgcgggggaaaggatgttgagggctgctcccccgtctatgaggacacgccccaacttcacattgcaaacggtgggggaaaccaccatcgcgatctgtcctccccgggaaatgcacggcgggtggtcggtctggtcgaagtgagggtaacctccgaccaccgcgcccaccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgacgtcctcggcggtggccttctgcttggcctcacctcgccggttgccggcgggagtcgccggggccttgcccacacggcgctcctgcctcctctcctcctcccacttcctcgtccgcttagccaaacttttgaccacacggcagtccgcgaggtcgtggagggaggtgttgtgcacggaacaccacttgccggtcgggcgctccctgctgggagcgccagcctccttctttttgtcgctcgcaggcctcccctttcgggtggcccgcgaagcgccct

SEQ ID NO: 38391 - DNA, 481 bp, Oryza sativa
cgacgacgccggccggaacggacggcggacgacagcggcgagcgacggagcaaaccacggcgatacaggcgagagcgagcacaccaggtggttgccaggacaaggggagacgagccaacggctcggattcgccggagggagtgcgtcggcggcggattgcggtagcggcaaccggcggcgagggaagggggaaacggcgacgaggtcacggggggccaattcctggcggcgagagcatctacgcggctacgggaatccgttgctagcgtcggattgggcggagctatgccgagcgaggccggcgacgagcggcgcttccgagctcggtcggcgatggcggcgagcacacggcgagcgacggcaacggccagggcggcgccggctagctacggggaggctactcgtgctactacccgagtctaaggggaggagatggagcgaggagggagaacggggagatgctctaccgtgcgggcgggcg

SEQ ID NO: 38392 - DNA, 924 bp, Oryza sativa
ctcgggagcttttctccaattaggattcaaaatggaggtttaccgaacacaaaaccaatctatctcttattttgttttcttgttagaatcgggctgtgggatttatccttttctaacttaccggacttaccaataaatcaaccaacattctccccttaattaagactaactgacaaatatactaagtaaacatagctccccaaaacaatctatcacaacaacattaagccttattgagacgacaagatttatagtttactgtagtacttaaataaacttaactttacttaatgggtgttgattgatgcttatcctctctatttctaggatattaatcaaaggcagtgacttaatcctatgccgactacatgttatttgaataagttgggaggtaaggcccggtttagtgtccaattttttttcccaaagatatcacatcgaatctttggatacatgcatagagcattaaatatagataaaaataaaaactaattgcataattagaggggaatcgcgagataaatcttttgagcctaattagtccatgattagccataagtgctgcagtaacccacatgtgctaatgacgggtttattaggctaaaaagattcgtctcgcggtttctaggcgagttatgaaattagttttttcattcgtatccgaaaaccccttccgacatccggttaaacatccgatgtgacactcaaaaattttcttttcgcgaactaaacaaggcctaagtctttggttaatggatccacgagcattaatttagtactaatgtactcaactttatttttttatcctggactctatctttcacaacatgaaatttaatgccaatgtgtttaaccgcttcacttgacttcaacctcattattgtagtatattactaattgtttggttatgctatcaaccactct

SEQ ID NO: 38393 - DNA, 22897 bp, Oryza sativa
  unsure (1)..(22897): unsure at all n locations
nnnnnnnnnnnnnnnnnnnnnnnnnnnnnnnnnnnnnnnnnnnnnnnnnnnnnnnnnnnnnnnnnnngnntcgaagtaactccggcgtcgaagcttgcgttcatttctgaagagctgtgtattggttgtggtatttgcgttaaggtatgtttgctgctattatacatacgcatggaactaggatatgtctttgttctgtaatgtatgtttctcacttccgctatgatctttgttgcagaaatgcccgtttgatgccattgagattatcaaccttcctaaggatttggaaaaagatactactcatcgctatggtccaaacaccttcaaattgcacaggtattgatgtttgatttgaggagctgtgttgatatgaacttttgcatttttttaatccaagtattactgtaatttaggtgaaaccatatctttggatagttactgatttagcacttgcaggttgcccgttccaagacctggtcaagttttaggccttgttgggacaaatggaattggaaagtcgacagcactcaaagtgttagctggcaagctcaagcctaatttgggacgatttaaagtatatatttttacctcgtgcccaatttctctgttgctgactgttaaattatgtgttctcatagaaagttgacttccttcctttccttttatactgatacaagtaatgggaatccacctatatttgttgcagaatccaccagactggcaggaaattctgacatacttccgtgggtctgaactccaaaactattttacacgcatattggaggataaccttaaggtattgcattgccacttctttttatccattgtgtttgtccttcttttaggcttttttagcatgtactctgcgacagtaataaatatcttaatttgtcgtttaccatcactatgtgtgggctctgagtacaatagcatcagtgaggtatttgtttcagtcttatttttggttctatagcatcatacatttttctggtaaacttttgtatgcatgcaaacagtaacaacacatagcgtcagcaagatactattgatcttccacttatgcaacctgcattaaattatgcactcaaatattgtccgaatctcaggtattaaatattgctttgatttattacatgtcaaaaaacccttagtagccaaaaaacagatattctggcattggaatagactgtcgctatgtttgatattatcagtattgattgcttcatacttctattaacttacatgcatgctgacatgctctatttctctttcctaggcaatcatcaagcctcagtatgtggatcacattccaaaagctgtccagggaaatgttgggcaagtacttgaccagaaagacgagagaggcgtgaaagctgagctttgtgtcgaccttgaattgaaccaagttattgatcgaaatgtaggagatctttctggtggtgagctccagagatttgcgatagcagttgttgctgtgcagaatgcggaaattttcatgtttgatgagccatcaagttaccttgatgttaagcagaggcttaaggctgcacaagtcgttcggtctttgcttagacccaacaggtaacatattcgttatgttattactatgattatgtaaatttaaactttgacgaatgcaatatcaagttctatcctatgtattttcagctatgtgattgttgtggagcatgatttgagtgtcctggattacttgtccgactttatttgctgcttgtatgggaagccaggtgcttatggtgtagttactttgccgttttcggtccgagaaggtatcaatattttcttggccggatttgttccaacagaaaatctacggtttcgagatgaatctcttacttttaaggtaacctgtgccttttcagatttagatttttggctatgtgatgaaacattgtttttatgtatgttctgtcctttcagattgcggagactcaggaaagtgctgaggagattgagacataccagcgatataagtaccctactatgagtaaaacacagggcaatttcaagctcactgttgttgagggtgagttcactgattcacagattgttgtgatgcttggtgagaatgggacagggaaaactacattcatcagaatgctggtacgccacccttcctccgtaactaccctaatcttcagttcaaaatcaatcaactaaatctgcagttatctttctgatttgttatgaatggataggctgggttgttgaagccagacactgtggaaggaactgagattgaaattcctgaatttaatgtgtgctacaagcctcagaagattagcccgaaattccagcattctgtgaggcacttgcttcatcagaaaatacgggattcatatactcatcctcagtttgtgtctgatgtcatgaagccactgcaaatagagcaactcatggaccaggaagttatcaatttatcaggtggtgagctacaaagggtggcaatatgcctttgcctggaaaggtaaatagatgtttcttctgacaaatataatacaccatttttgtgccttttaaaagttttaagacttcatgacctgtctagttatatatatatatatatatatatatatatatatatatatatatatatatatatatatatatatatatatatatttcacatactatatgctcatttggcttttgtgaccaaatcttctaggtctgcatttatgttcctgcaatgttttttaaattatatttgcatcaagaacaacaatacatagaccgtaattcgtatgatatttcttcctgttttatgtgggatttcagaatgcattaaactacggatacatgcacatggtctttctaaacctgtcactgatggatttcaatgagttctattccttgctcttctcagaaatgccattttggaatctgttttagttggcttagaacacattttatccatttatatcctttgatgtggacctggtgtggctcaatctgttttgctagatgacattggagttagatatttgtattgttgtatgttttacttaagcatagaatgactcaagaaataattatttttcctgtgggcctactgtcatggggtagatcataagaggagggagataaatcaatctgaaatttgtaacactgattagacaatggtcttgaatttggagacttgtagtgctacagatctcagtcgcggtgtgcttttctcataaaataacaatcaaagaatatgtcttgtattatttacttttgtttgcacttttgaagcctctgaataatggctatgaacaatccaattgatgatccacctaacatatccgtagtactttcatgtggctaagcacctaaatgctgtattgcctatataaatattgacttgattgtcagcttattgatacttgcaatgtggtatatgttcagcctgcagatatctatctgattgatgaaccaagtgcctatcttgattcggagcagcgcattgttgcttcgaaggttatcaaaagattcatccttcatgcaaagaaaactgcatttattgtggagcatgatttcatcatggctacctacttagctgacaaggtcattgtttatgaggggcggccttctatcgactgtactgccaatgcaccacagtctttggtatctgggatgaataagttcttatcggtaagttctgaatattaaatattgagaagagatccacaagtttgttgtaataccatctcgcatccttgtctttggttcagttgtaggcaacttcctcaaaagattaatttttcagtagagtttgacattctatatctgtttttagttgtcgaaagatgtcccacttctgtttatttttcagagtatttcatttatgttttcacatgctaatgctttctattgtttttccttttgtgcatgatagcatcttgacattacttttagaagagacccaaccaactataggccaagaataaacaaactggactccacaaaagacagggaacaaaagtctgcaggatcctactactaccttgatgactaatttgaaggcgtacaggttcctacagctctcatttatgctggagtagtttcatatcattttttaattcttattttcacttattaagtaatttcgtttttcttttgccttgctgtgcagaatcttcttgtggagcttcccgcccataatttgcccaggccttcgatgtcctacgcattacttgttcagaaggttactttgaagctaccacagcttgaagcatgctaaataacttggctgcaggagtgaagtggtatcatcatcagttataaggctgagcatgtgatgctgacacttgagttcttttgctggtttgatatatatgatgatgggaaagagagatgttactgttaaactgagcaactttgtcaggatcggaagattgtgaatttttgtgtatttttgcattattgtatcgtggatttaccaactggcacccttaaatcgttggttttataggcataaagtttttgagctgttactcatgttaccaatgttatcaaagttctctgagttattactgttaattcactttatcgagataataacgtagtttgtctttttttttattcagatttttaaaaatctgtagtagacaaaaccgaggtttttctttgttttgatcggatgccagattcatttgcttgtgtttagttttgttgtgtcaacgagaatgattgagttgcgttacatgcagattcatgttgtttgtttctccacaacttacagtcgtggaaaatttaaggttgcaatgtaagtgaaacttaataaatctattatttgcaagaagccaatattagaaaacaaactatgataagaaacctcaaaattaacgctaaaattaagttttggaatttaaattttgtttgtgaccattcttccaagtagaaaacgatagctccatcaaacaccataaaagttattgctcatttaatttcttgtcaaaattaaccttaccaaaattgatattaccaaattaattttggtattaataaaatttgggagcttttgttgcatttggtttgaccccttactaaaaattggaaaagtttttttggataggaaacttttagaattaccaatatttggtatggtagcaaatgataaagttacatttagtttgttaacatattaaaatttgataatgtcaaaacttgataaggttaaaaatggtactctatccgtcccaaaatacaagagattttggtaggatatgacatatcacagtattttaaatccatagtgataggaatgtgtttcatccaaccaaaatcacgtctattttaatatacttaaatggtaggatacgatatatcacagtcttttaaatccatagtaataggaatatgttctatccaaccaaaatctcgtatattttaatatacttaaaatgaacatgctctcggtgcataatacaaaggccttgttccagaggtgaaatgttttggcgtgtcacatcggatatatggacacatatttgaagtattaaacgtagtctaataacaaaacaaattatagattccgcctgtaaactgcgagatgaatttattaagcctaattaatccgtcattagtaaatgtttactgtagtaccgtattgtcaaatcatggtgcaattaggcttaaaagattcgtctcgcaatttatacgcaatatgtgtaattagtttttttttctatatttaatacctcatgcatgtgtcgaaacattcgatgtgagtaggatggacaggaagcttgtggcttgttagctcacttggctcggcggcaaggcccaagcccaagacaacagctgaacaacaaaaccctaggcacacgcaccgcatctctctttgtctcgcgaatcctcgtctcctcgatccccttcggcccttccgttattcgcatgttccgtatccgcagtgcgccgtcgctagccgctagggccgccgccgccatcgccggacttcccctcctcggctcctcctctaccagctacaaacctgcgtttacgatggaggaagaacgagaggtgcaagagcaagtgcctcaggttgcaagcgtggaatcccagagcaaacacatgagcgtgtcttgttggtttggctcgcgaatctaatgagctagctctagctttcaaacgagccgagccgagctgggtttctagctcgttaggataacgagttgagccgagccagctcgttatcctaacgagctagaccgagccgagctgagctggctcgctatccacccctagatgtgacagggttaaaagtttttgcgtgggaactaaaccgggccaaaatcttctcatggtcatgtaagttgggtacgtacgtattccacttttaaaacaacaaggtggctgggacaacatgatattactagtacgagtaattttctttcaacgtatatatttttataaccagttgattagaccaaaagatatcttgagatgagcttcctttcgctctctacttcacacttgttcaatacggtacggacagattttaaccaccggctgcctgcaagtagtaccggtgtgtccgtgtctgctcgactgctctccctctcctccccgtcttcctccctctcccggtctccccttcggttgccgcgtcaccaccaccaccaccgggtcactgccacgtgggccccacacccccacctccgcgacctcgcggccggtgagccgcactgcgcctcccctccgctgggtacaaaccgagtgaccgatctaccacctccacccaccgccatcccccccaatcccccccacacgccgcgagatctcccgcctcctcctccacccgccatggatctcctccgcgaccgccgcctcggcgcgctgctggtggtggtgctggtgctggtgagcggcgcggcggtggaggcgtcgatccacacctacgacagggagccgttccgggaggtggggaacgcgttcctcctctccgggggcagcgagggcgtcgtcgccgacggggccgacctcgccgcccccgcctcctccttcatcaagtaaagtttcccatcccccccgcaccacacctccgcgtctcggtggttggaaactagtatagtagtaggttctcgaagccgctgccaagggtgagaggcatgtgctgctggctgctcggtcttgaatcgcctggggattaggcgtcgccggcgctgggaatgggaaatggggggcgaggcgtcaccgctggaggatcccgcccgcgcgcacggttttgctgagtgcttgcttgattagtggcaatttaacttttgggatttttcattttggcaagacattagtgctcagtttgtgatttatgaccaaatttataattgtgttgccgatgaagtaaaattcgggttgcttagatacacctaacattgaaaatgataaaatctgcaagttgtgacccacacattgaactcggtgctcaccatgtagttgtttgcagtgttttgtgtcaatattgttcactgcagttcattttagttttatagacttttagttcagctttgaacttcttgtgctgataagcagggctgtgctaccgccgtattaaaccgatgcaggttccactattatcattttgagtaacatttgccatggattaggagaattacatagctagttagctactgccaatgtgaattacggagcatgttgacaagctgatatgtgggctcagaaaatcatttggttgatgctgtccttgtgcttactagctgtttctatctgttttattgcgtccatcaggctttattttttgtaggaatatgtatgggtttaatcttttctgggatctgtatgtgttagtttaccgatggaaagaactatgctccattcataacaattgtataatttagtattaaccagatgctgggttttcttactgtcaggttcacgaatgttactttctggagaactccggaatcagctgaatcacatgcaaaaatggcacacagtacaggtctggtacaggccattttatttgaagcagctgacagggataacattgggggatctgcctatggtggacagaggtccatatgttgtacccctgaccttgctaaactagagggctgcaaacaaggggaagtaatcaggagaccatcctctgatgatcctgattggccttatgtgctagatacacacttcagtggtagtcacctttctgtgaagttagaagatgaggtagttcgcattaccaagacaggcatgtacaacttgttcttcatttcctgtgatccaaaactgagaggccttagtatgagtgggaagacagtctggaggaatcctggcggctacctaccagggcggatggcacctttgatgaaattttacgtttttatgtcactggcttatctattggtcatggttgtctggtcgagtcagtatataagattctggagggacatcatgccaatccagaattggatcacactaattattgcacttggcctttttgagatgacactatggtactttgaatacttaaacttcaacagtagtggtgtacggccaattggaatcacaacttgggtggttactgttggagccatcagaaaaacgatttctcgcctattgatcctttctatctcaatgggatatggtgttgtccgcccaaccctgggaggactgacctctaaggtgttgctccttgggctgacatatttcctggcttctgaattgctggatattgcagaaaacgttggaacaattaatgacatttctgggaaagcaaggcttttcctagttcttcctgatgcctttttggatgctttcctcatactttggattttcacttctctctcccgcacacttgagaagttacaggtaagctatatttgatgtaatttttcttgtctgcttttataatgatgattactccctccgtcccaaaatataacaacttctacaccaacattctcttctcaaccaatcacaaccctccaccattcaattttctcacctacctccacttctcatccaatcacaacccaaacctatttaattctatctactttcttagtaactgtatccaactctaaaaatgcttatattctgggatggagggagtagcattttatccatgttttctcttttcaataaagtcataacatctgatgttttggtggtggaggaaataagtgcttgcaattcttttctgatgcgtaactaactgtgatctggtggagttactagtgtatgaagaacctatgatagtgatgttaatatcaaaattctaatggtgttatgtgtgctcacaaagaggacaagtgctttaaacagtgtttataatttcataaccaagtctgttgaaccatgccaaaatagaagtatgtattgtgttgcttcttaatcatcacctttttttattgctcatcaggctaggaggagctcagtaaagctggatatatacagaaaatttactaatgcattggcggtatctgtaatagcttcagttgcctggattggttatgaggtatgcaaatttgactttgttaatcaatagtgcatattggctcactgacctatgttcctggattggttaatcagtaatgtggtgcgtattagtctcttaagttcctgtaagctttatgaacatccaagtacgtcattatcacatggcattccaaaattgtgccctctgaaaacaacaaagtcttctttataatcaaaatttatctgctatttttagaggacacctctatcagaatgtcttctttgcactttagtgcttcactatttttatgatgtcctgataaagcacccatggaaaatttggatgattcattttttttcataatacttgggttctaagcctgatcataaacttcttctctgcatgagtgtgaaaaagaatcatggaagacattactcacttcatgttctgcaattttcttcatgctgatatgagagatggtttcattcatctgcagattttttttcagggaatcatctgttttatagcattatagctgtgataaataacctgctctgctcaacaatggcttcattttgcaggtctatttcaaagcgacagatccctttagtgagaggtggcagagcgcatggatcataactgcattctgggacgttcttgcatttgttttgcttcttgtgatttgttatctatgggcgccatcccagagctcacaaaggttaaatctttgcctcttcaatgactggaaatgccatagtgaaagtagtagtgtagcttgaaatgacttgaaagtatctgtgttgctacttgtaataaccagcttatctactcaaaatgccgatagctcgcctggctgcctgccatcactagaaagtagtaatgtgtttttatacggcacaagaaggttatctttgaaagcgctctaaaattgacatgtcaaaccttgtccagatacgcatattcaggcgaagctgccgacgacgatgatgaagaatctcaatctctgacgaaggggaccgacggtgatgtagggatggtaaaggttgacaaggacagaagtggtggtgtcagtagtgctttcagcttggaagacgaggctgaggaggacaaaagagagtgacctgctggagcaagaatgctccaaggttcctgagctttcttcttctttttggtggtgatttgatcttctcttttgtaccttctcagttacacaggtcatgtagaagcgcaccattttatccattcctgcgaggatagtatgttcgtggtgttccatgtggagtttcacataggccaggatggtgcacattatttaaatgactacacattcacaacagtgtacatatctgtttttgttaccggttgtgcattgcctgatgtatcatggtatcatgtatgaaactggtgaacgcagtgtttgacagatctgtttgcctaattgactggaagttgcagatgaaaaatagccaaagtttttaatccaaaactccagttctcctgcactagcactaaccatccaattacttcaatgcttttggttccaagacctggcatcaaggtatttaagccataacagttcaatctttctattgttaaagcatcagcagattctcgtgagaagatttttcaatagcggattctatgcacgggatagataaaatcgtaataaaacactgttcgttgtcgtgagaagattttttgatagctggattgtatacatgagataggtaaaggcaatccagatcctctgcaggcagtattgctcactgacatgtggatcctacatatccttaggcccacatgttagtgaagagtactgcactgcagaggaccttgagggcctgtttgggggagctttagattctgagaagcagctgtttggtagccagcttctgaaaatctagaaaagctctgaaactcagcttctccagcttctgacttcttagttcatttttcagaatatgtaactacagattctcagaagctatggactgtttgggacagcttctagcacccaaaagctgcacctgggacaagcttgtttgagtcactcaggtaagagaaacaatccattttttttcagattttaagaaattgtagttataaattcagaaaataaactagaaaccagaagctagaaaatctagcttctaccgtatcctcaaaatgtagctaccaaccagttatttctcggaatcttaagctctccgaacaagccctttatcataataaaacactgttgtactctctagctgaagctgtgcgtgcagccttgagtccttgacagctgacgttaaacattccaacggcagatggcatcatggcaaacaggcaaagagccaaagatgcaggctgagcatataaaacccttgctggtcaagccgcggcatgactgacaattgcacaaacatgcgtcaaagaagtacaaggccaaggaaagatgattacaagtcactggttaactcgagaattgatggctgtgacaccgttcttgatctaggcacaagattcttcacttcagccaagcaattttctcatcaagaacgaaagagtacaaggatggcatgacaaactctggattcttacagagtaaaggctttgtctgattcttcctccctctgtagaacggtttgttctatgttgtgagttatgacatgctttcataaactcctccctatttacacaaatgaaatcaggtgagctccccttctaacttgggttcaaaatgagaacactgtaagcggtttgaacaacacaactaggcatctacaagccttaccttctgcaattctgaactagagtctagaggtcatgagttgacatgcttgtctaggaaagcgtttgccagatttctgaagctggtattagcatctccagccacggcatactctcttactgccttaagtacttctggtttcagaatatctttctttgtcgaagggttacacagataatataaagccccaagtgcatagttcacctgtgaaatcattggaatggaattattcgtataggagaaactacagaaaagtgaggaatcaataagaaaatctattttttcaaaagaacaaaacattcatttcagtaattggatagtgttgaagttatggtttcagaaatactaaccgtattcttcactgggctagataagcattgtatgaccaacggaattccaccgcaatgagtaatgactgaagcatttgctggatctgcatgtatacaaatagaccaataagattttaaaaaaaatctatgtttgctggaaacacaattaaaaagtgggaacattaaaagggaaaattgggagcttgaagtattgcattgctcaccggcacaagagttacagattccaccgatgccaaattcgataagcctttcgtttggctccgtaatgcagtccaagaacaattctaggatatttagctgagaaagcaaaacagatagacaagttactgaacatgatcgctaattcaagtcaatccttatagcacatgaaatctgcacaaactgttcctaaagaacaagtgtgcgagataacaacctggcgcataaaggtgtagttataaggatcatatgcgaaattcgccaaatttgcaacaattctctccttggactctgcgataacaaaaataaaatagaatcaatgaacaatgtttaataagcatccaatgccatgtaaactctggcgtccatgaaccgatgaacttattctactcgacagtataatcccgaattatattttcatttttaaaaaatgaactagcttatgctggcttttatcaataggagaaaaatgcagaaacaattcggctgctatggacaacctaacgacggacggtcatctcatcatgaattgggtttgcaagacgagaaatggaactagctgaccttcatccgtggcctcctggaactgggtgacgagatcctgacgaggcggacgcaaatcaaacggagaaaaaaaaatcagctgatcagcgcgaggattttgcaggataaaccagtcgaatcttttccatgagccaaaaagcaaagcaaaagtgagccaacctggaggtgctggtctctcggggtgccgtggcgtccggtccgctcgacctgccgctgcgcgttcgtgaacatcgatccccctccgacccggcagagagagagagagagagagagagagagagagagagagagagagattcccgatctgctcaccgcgccgccgtggttgggggggagaaacgctgctggtggtggtggcggagccgatgcccgcgggaattgggggcggtggtctcgacgagctccccacgcacggagagcctcggctcgcccagcggaagcgagggggcacctctcgccggagtgatgccgccgccgccgtgtttcgtcgagaggggtctcgccggaggggggatttgccgccgccgtgtttcgtggaggagagagagaggggagagcggggaacagctcaatccgggccgtacgacatcgatctaacggtttcggatggggacacgtcatgcattgaaacacagtttcgggctcttttttggaacgaaggattttcatgggaaatttatagggtttatactgctatatacgtactgtacagctcatatacggttagatatatacaaccataccatagatcaatataagagaagagcatgttcatatgtattgcagctgtttaccaccattgatcaaattcagttatacgtgagtcggatagttgggtcatatgcatagtaattttcgatgtaactatggaattattttatatttttccaatgaagctctttggttgaaagatctggctacaaaatttttattggaatcctttctttcctccaccttttaacttttttaggatttcaaacaggagctcaaacctcttggttttgatttcctttgaaaagtccaattcaccgtgtctcttcatctctcttctcaactctatcttaataatacgagtatctaaattccccatgaatttcttatgaagtatctaaatttccttcgaattccctgtgaagtatctaaacaaccgttagatatattcatgtgtcataggtagtgggccgaggggtcgaggccctagggataaggatagagtcggttggataggattagattggatcctccctccatctatataaggatggtttgtatcgttattctagtcaagcaatgaatcaagattagtctctcccaacctaagtccccttctcatccctagcagccgtcgccgcccggctatcctcccggcggtgtttacccccctatgaatcctaatccataacatcatgtgttttcaattcccgactttctatttctgcgtttttactatttatgtgtttttttcaatttctgcgttccaaaggagccctagcagcttagcaactctgatctttccaacgttgaagtatcagtgcatcttgtaatggattttgctcttcctttttttttactaacttcttacaaaatctactcttccttgcaatggaggacaaaacaatatttactgcaaaatcaaggcaacgagtagcatagtaaagctctcgtgtggttgcagcagtcacactttacaaaccattgtagtattgaactggtaacctagagctggcaaaatttgggaaaagaaatacagctgatgcagttgtacgtgagagacttctgagcacagctggggcaaacagattcagatgttagcttttgagcaaaccaaatactgttaggttcaagaactcagggtcttcttgttggtgtcttctcaatctgtgacgcggagtggctgttcattcttcacaatcaactcaacttgattctggtcagcccatacagctgcatccagatacccaagctcatataatttgtctagaacctcgtcttcggcgggttccagagcccagttaaacagctgtaattgatttgagaattgagacagtgtcaaagtgaatcaaggtgagtggtaaaaattgtgcatttcgaaagtgactgacctgtcgggggctagctctgttctccggattgcagtctggactaataccaatcccttgcaatcctagtcgactggctgggaaagcacaaattcgaacctgcaattgtaggcatagtgtcaagaataagcattgcaaaacaggcagcatggcacattgtcctgttgtatgcatcaaagatgtgtacacaaagtagtacaacgcaactggttctgctaatggatatcgtggggggcctccctcactgtttccggtaaaaaaaaaactcagagtagaatatttttggagacagagaagccctcaactcacaagtgtgatgcatcctgcatgagacaggccaacttgcacacgcccattcagaagaagcggtttcagaattgcacattcaaatttcagtacagttttttaaaacagattgctcagttatggaaaaggaaaagaaagaagataccccaaattcaggttatacagttatcttcactgtaaagtataaagagagcaacagaaaatgtattaaatttgagaagaaaaacacattattatgtactcagcttatgatcattttagtacatgaacacatcacagtgcttgcacctactacagaacaaaacatgtctgaggtgtccctatgttgcattgttcaaaatcatagtctaaccaagacagacatgtcatacggttttcaattgtaaaatcaacaatcagtgggggaaatgcttttcatacatgtgcagaaaactcaatagttctagtgatcagaataattttgcagaaccaaaagaagttatgacatactgtttcggaagcagaagttggtggcataaacaacgtaaggcccccatcaatgcacagcctgttccggaagaaagttgcaggcctgggagctaaatatctgaaacaagcacacccaattattcttaaacttagaacacaaaatatagaagatacatacagtacgagtgaggaaaagttaacatgaatcttacccaggaataaaagaggatgtaataactgcactgattacatcatcttttgagtcaaattggtcaaccagtaagcccctaggcctccaggacagctgagtaatagcaactgatgagaagaagttaagtgttcttaattattaaatccagttacttgtcagaaaataatgtagcagaaaatacacacagcaaatatgaataagcaatggttgaacagtatgaagcttaccacggatccttccgttgcacctaatgtgcacatcatctgggagaaacctgtctagaacatccttgagtacagcctgctcaagtgcacaagattacaaggttaaaaacatatcattcaatcagccagcacatgaactatttagtgacttgagtgccatatatgtctgtcgccttcagcgtattttttaaaggatacaccaggttactcatcacagttttctcgaattattacagtctaaacaccaaggtattgcaaagttgaaacatagttggcaaattggtcataaataaaccaatgatctatcacacatatagttgggtataatttacacaggaagcaaactcacatgttggccgcaagtataattaaaagtaaacaataaatggaaacagaaaacttaccccaaggcgaaaggctgtcccattgctccgacagttatcagctagatccttggtcacttgcaaagcatctcgcatcgtgttcccagatgcaatcactgcacagattatggcaccagctgatgaaccagctaacggagttctttcctaatgtaagtcccagataaagaaaccactataagaaaacttgctaaaaaaaaaagcagcagcatacatacaaaatgtatcacacgtaagtcctaaaatcacaagcataggaatgcagaatttccatgcataaaaatagcaggcaatgttaccacctagacagtacagtagcataaaaattgagagctctagccagccatggcaccaacaagctactcctactactcctactaagctaaagagaccaacacggaaattcgactgttgttagccacaatttcatctcgaaagtaacccgctcattggctaaagagaccaatgtgaattggattgttgttagccataatttcatctcaaagaaacaagccccaatagctaagcagacaaacgtaaattggattgttgttggccacaatttcatctcgagagagaaacaatctccactatcgtaggcacacggatctcacaattcatctgagcagaagctcctgtctcctactgcaaaaatcaagtacgcgttcgcgtagaagaggtaagagagatggggggtggacgcgcaccgtgaggtagcccctgtcgatgaggcactgcgcgacgccgatgtggtaggggaagagcagcccggcggcggagaagctgaacccggggccggtcagctcccgccgccgccgctccgcctccacgtcctcgggccgctgctcccacaccaccccgtccttcgcctccacctcctccaccgccgcccccccgcccctccccgcgcgcaccagcagcgccgccagccccaggaacacctcccccgtcctcaccgcgagcgacctcttctcggtcccctcgggcagcggcggcggctccgggtcgcggcccgcggcggcgcgggcgagcatgaagcgacggaagccccccggccgcgcggaggcggaggagggaggggtggaggaaggtggctgcggcttgggagggaggccggaggcggcggaggagaggagggaggaggccatgggggctcgccggcggccgccgacgacgacacgtgtgcacgcgcggcgaagcatctgctacgtcgttaattcgtttaggtgcgtggaaaaaataattaaaaaatcgatgtagttttcttgtttctgtccttttgttttcgattttattttccgtgggcaaacgaaacgacacgtgtcgctgcccaagtcgatgtacgtcgtagctttggatagtagaactccgtatgcaggaatttttcgtgtcgtggcattggtatggctctgatcggaagtagtatttagtttcggtatcacctatatatttttcgacaaattttctcctaaatatttgacagatataattatagtataatcgtaatataatcggcacaggtgataaccagaggagacgtggtgcgcgttcaagaagctggatcgatttgtgtcgcgactccgtccaaatcgttgtttatcataaccttttgaaagatcgggaaccctagtgcacatcacaccctaattcgatgatgaagctgttgccctccacgctcaagctgtcattgtcctcaacgtcaaagggctggtgcggtctcttcctcgtcgtcttcggcaagtacgcgctcacggatcacgtcctcgctgacaactctcacctcaaccacgtggattgggcacagatggactgcgtcgtcctcggctagctataaggcacgatctccgccgacttgcttcaggaagtcatgttggccacggctacggctcgctctgtttggtgtgatctcgcccatcaattcctcggcaaccaagaatgttgcaccatcaatgtcaacgccgagttccgcaacttctctcaaggcgagctctccgtcaccgactactgtcgttgcctcaagtccatggctgacacgcttagcgacctcggcaaacccgtctccgatggtgcactcgttctccagctaatcaccgggcttagtccccgttttggcaacatgcattcacttttgtccatgtagaaaccattcccatcgttcatggatgcacgctctcagctcccgcttgaagatatcatgaagggctctcaaccggcagaaactgcttccgtgttcgtcgcagacaccgtcagcggcgcctctcgtcccgctagcagcaacaacggttctggtggcgttccccagaactcgaccaacggctccgtctccggcaaaaacaactcgcgaaaccacggctgtggccacagcaactccgatggctccggcggaaacaacggaggtggctagggcaacaccacctacgcaaacaaccaaggccggcccaccacctcccccatgaagcaggccgctgttccggcccagcaccaggcccagtggccgtccccttacaattcctaggccgggacaattcagatgtggcctgccctggtcggtgaggactttgatctgtgctctttgtctagctcttgttgatcttctcataaaaagggtaaaagatgaccaataaactaaatagtgaactttcgatccaccgccgcaggacgcctgacatgatgaaattgacggaattgctcgatagggcaacggaaagagattttagatgctaataaagtgaatgatgaactttcaatgctataaagccaaaaacgaaaacttttgttactataaatacaattttgccttaaaactttattgtacgtactttctatatctaaagtaatgaaagaaacaatctttctcgaaagcacattgggccacgtagtgttaaaaataatggccatcgaatgaatgcatcgagaatggatggccatccgatcattaacgacatacatgcggtagaaaaaaaaaacatgccgtatgcacttccctcccgagccttatagtgtctcctggcaagaataaaaagaccactgtatgtgaaagacaataagttatactagtttatgatgactataaccatcctgttattaatggtgtggatgaaatcttatctataatgtttagaatttgagtattagtttgtgcaaaaaatagaaatgctaatcaataacagaaaattttaaacagtttgctattgtaagatatacttgcaaggatgattttgtaggcagtggcatagtagaaccctttgtgtcattgaaatgaccatatgtgttattttgagcaaaggcatgatttaatgttgtcattgttcttacttttctttttaattcctacaatatgcatgtgtacagccctctggaaattctgcaacccaaaagccagaaccatgtcaaatgctccctcctgtgctcactcagacgatcttttaatccttgagttgcatgatcttcatgataacaactgaagttaacttacttttatgaagtaatttgttaatgtatataatattgtacgacttagtattataaattgcattttatcttattttttgttaaataaaaacacattatatgaaattacattcttgatgagtgcttttttttttcttctagcagctgaacttccagccgaaggcacgtgaaccttcttgattcatcctttttttttttcttttcatgcaaccattcctcccttcactttcaatcctatgtgccactgtgccagcttcattcaccatatcaatccaacagtttatatatttttcatgatgtggctcattctggagcgacaatacattttcattcgctagcggcctgccaacgacataaagattgctatgtacacgatccaatcgtccaacacgcatatgactaagtttaatcaatggttaccatgatttgaacctctaccctttgattaatttatggttatacggcttcagtcagtcttatgtggatagcacaacttgatcgaatgcatagtgagactctcgatacaaacacacgaagaagcaaaagatttttctttgtgaaagatcaccaatcttaatttggagccctcttggtcgacttgtgtaaactcattcagcatttggtattcgttcaagaaaaaatttaattcgttcaccatttggccaccatcccagaggtctcactttggagaccaatccccatcgggatcgtcgccaaattgctacaggtcccaagtcaattctctctcgaggattggcctggatccgatcaagattaggcttcctatgacagcgtttctccagcttccaggtaaataaatggacgtgcctcattcccctaggacgtcaacttgatcagccactgttgtcggttcagtgcccttaaaacttaaaaaaagaaccgatcatttcattagattaaaccctccatcaacattggttaactaatgcaagtactagtattagtatacaataatatctctcacattttgtcggcaagaaaattgcaactggagaattggagggttttgttcctctaactacaggattgtcagtgtcaggacactaaacacacggtcgtggccttttctggaaaaccggaatttcgctggattttggtagtacggattttacgccaaacagcgcaatttgttcctaaaaaaatgttaatttcatttcttgaagtcactcgtcagtacagcatgttgtcttaggcagtacagcatgctgtcagttcagagctccaaaccttaaaacacactagtatttctttaagcaccttgtcagtacagcactgcactacaacatcttctcagttcagccacatactccgtaaagcctaaactgactggctgttttaagtttaaaaaccattgcaatatttgaaataaatgttaagcatctcgagatctgcaattcgattgatctttaatcttttgtcagcagagcaatttgtggcttgatccgggatcgggtgttttgtagtaattcttctcgaagctggaggtgttttgtagtaattcttctggaagctcccgtgatccgaagctggaggcattagaaacagtttagccctgtttagttcacaaaacaaaaatttttacactatcatattaaatgtttggacggaatattaaatatagaaaaaaactaattacacatgattgcgtgtaaattgcgagacgaatcttttaagcctaattgcatcataatttaacaatgtggtgctacagtaaacatttactaatgatggattaattaggcttaaaaaatttgtctcgtaattttttgacgaaatctgtaatttgttttgttattagactatatttaatattgtaaatgtgtgaccgtatatccgaaaaatttcccctgctaaacaatgccttattttctaatgagcaccgactcaccgacaattctgatcaaacaagtctctgaaatgagatcagaatcaaaagcattggcaatgcaacagtcatgtttcccactctcaataacaagaagcaactgaagtttatttatttttatttgtttttgctttgaactgaagatttcattcgaatccaactatagttttgatgatcatatatacttcacaaaaagaagtaaacaaaggtacaaaagcaagatcaaaagcagggtagatttgacttgaaaagatgcaaatttgggccgaatttatctgtccctgctattaccagcactgataatttcattttcttttcttttttactgtaacgaacgagagagaacgaaagagctaggcgcgcgtccaggccaaggccggcggcggcggcgccgccgccgccgcgtcaccgggcggctgggtagtctaacggcagcggccgcacctcgtcggagagcgggtccttgtggcggtacccgtag

SEQ ID NO: 38394 - DNA, 18535 bp, Oryza sativa
catagacgacgaggttgtgatccttgtacttgtggagcgggagggagaagtccatgtcggtgaagacggcgtcggcgtcgacccaccagacccactcggcgtcggggtgggcgagcatggcggcgcgcacggcggggatcttggcccagtaggcgagcatcctgggctggagcagcgcgttgttgtagaggagctcgacgccgtggaggcggcagtagtcgaccttgttcttgaggaaccggaagaggaggtggtcgccgccctcgccgcggcagggcggcgcctgcgagccggacaccatcaccacccgctccctccccgccgccgtcgcgttgagcccgcgcgggtaccgcagtcgcatccacgccgcccgcctcgcgtcccacccggtgatccccccacgccgcccgacctccacggcgtacgacaccctcgagtcgtcgtagaacgtcctccccgccgcgcccggcccgccgcgtacgccgacatcggcgtcgtcgccgcggaggcggcggacgtggaggcgaccgacaccgggagggagcggaacgcgacgaggttcgtgacgggcatgggcgacaggaacgacgccgtggccagcagcacgagcaccgccgccaccgcgcccgccgcgaagacgagcgcgtcgtgcacccgccccgccaccgccagttgcccgtgctgcgccctcgcccccgccaccccgccgccgcccttggatgccgccgagacgccgaacggcgcggtctccgatgccgccatggccggtctcgcctcgccgaaccgaactcccactctactcgcgagcggcgcgctcgcggtgtgtgtgtcactgtgtggtgttttaaagcggaaaaggccaaaggcgtctctctcttttgtagtatagcggaggcagcggaaagcggaagcggttgtggacttgtgctgctgcgcggggtgcggggttggttgttgttttgggtgtttttgctggggtttttgggcgttttcgcggtgattgcgtgcgggtgaggacgcggctcgcggaggcacggcggcgaggcgatggatctggctgtgtgtgtcggccgtggccgcgcgcgtgggcacgtgacggtgtcgcggggtgtgccgtgcgcctctaaccccccggccgagtcacctcactcgttttttcgcacacacgctttttcaaactgctaaacggtgtattttttaaaaaatatttatatacaaatatcttctatctattatatactaaaagtccattaaacttcttataaacgctctcaagccgccacgtggtctcctataaacgcttctaagtcgtcatatggcgttctaataaattagagaaattcctagaaattctaagaaaaaagcaaaacatctgtccatccgttttcacttaaattggtggacccattatttcaagccgtcagattagtttaaaaaaaatctttccacatccacctccctcctcccacacgtaaccctctctccccttttgtacatactctgtcacgtaccatgtcaaaaaaaaatctaaaatcttcagatacgtacgtgcagcccacatatatctccttttctctcaacaccctattggcctattttatagctagcaattcaacataaacatggtgagttaaatggtcacaatttaatttagattgggagtaactgataacttaagatcaataaaaatccaaaatattctgaaaaaaataaaagttaaacattgaaccattgatttacgcatatacaggtgaactattattttcaatcattagattagatcatactaaagtaattaatttctctctcctaatctcatgcgtatttgcaagagagaaaaataaatatatactattctcccggagaaaatatacgtatgtttatatgcatgtacaggagactattatttgcaaaaaaaaaacatgaatatgtacgtacataaaaaaaatattaaccatgtccttctaacccttaaattagaaagtttatacatgatcagtctaccctctgctgtggctcctttcgatctctccagtttatttcctagggtcgttgttgactaggctatatcttatatcttatatttgtgacagttaatttattattaggagccaacgtatctgagatcgttgatatgcttacccagtccaaaatgaaaatattggttaaagggtagtctaaaataaaacattcataataaaatatggcccaaagtaaaatttgtgacatatatatagcaaattctgattaaaaagttatcatatggaacaatattctagccaatttttatatctttcttatccaaataatctcaacaattactccatgttttttaataactgattgtggatattatattcatttacaacccactttttctatagaaaaattataaatatgttaactatcttttgaatgaaaaatattacatggaaccacattctatcacttttcatattattatacatagcattaacaattagcacaaataaacttgataacatatattgttccatcatatattaccccacgaacatgcatagatgaattagatcaataatacgaagaaaagaaaaatatcaaaactcatattacctcgtatgttcatgaattattactactcaagcagatatttttccacgtgtttctcaccattgaagctattagattatttgaagtagtatcgaatgatcaactctgcttattttcagaagagaaaattatatctgtaccactaaaatttagtagaccaattaacaccataaacaaatgtcaactctattccataaatggactcaaaacttttaaaaaaaatgtatcactttcatcttatctatgtgtcattccctgaagggcaccaagcattgataacatagtttgctacactactatacgtatggtgggggtatgcatatgactaagttgaggtgacccagtgagaggctactattcgcaataaagttcaaatggcttacttaccgatgtgattctttaactgatagtgaattaggtattaaaattgtgctccacactaatcttgaggagaacaactatgtcgatacgggacacatgtttcaaagtataagagaagaaagccttcgtggctacagtcgacttcacccattagaggggcatttagatcaaatttaatggttttatcccatgaattggtaggagtaatatttcaaaatatttatgcatatatttaaacacaagcgagacatgaacaatttggtatgaagtagagatgatctttttgttgtgtctagacatttatttttatataattataggtgatctatggtccttataattaattaatatggtgagataggatttctttagcattatttttataaataataaataaacgtttcttataattaatatggtgaagtatgacttcttttagcaatcttttataaataagttggccgcgcatttgcgcgggcttccttcctagttatatactaaaagtccattaaccttcctacaaacgctcttaagccgccacttggcgctcctataaatactcctagatcgccatggcactgtttaatctcaccgtcgattttcacttaaattggtgaacccggtattttagaccattagattagatgtattattttaaaagtaatacttttcctcctgtcggtgacatggggccgagggtatcgtgactagaggtttgggtagccgcggtcacccacgtggcctgaccccctcgggggggtcgggcccgaggatgatgtggccacccctccctctgtctccccgaggggtcgggccacccctgtttcggccccgagggctagggcgccccgaccccctgtgattttggcgccacatgtatgggttaggtgagcacagaggggctcacctaaccgcatttattgcgggttggacgagcgcgccacgccgcatttaatgccgcgtagcgcacgcttatccggtccgtgaccggtcgcagtgtgtgaccggtcacagaccggtcagatcgcgggttaggtggcaacaggcggcctgtcacacgcctcgccccgtcccgtcggattgatgagagcctccaggcactcgtccctagccggagccggcatgctaactcctggagttggtatgtcagtcccggccagattcgttccaggcttcatcgcaaccatagcaaggaagtcattgtatgaagaaaggcagacgtgcggcatgctaaactgacgcgcggtggacaagagtgaccggtctgtgactggtctgacgccggtcacgtcataggcagacaaccgtgctcccacgttgcatctgcttccggcggagtggaggtaggtatgacccatcccatcggagggtcattcggacagcggccattgcaaatctccacccattaatgaaggaatgacagggttatcccctgtgtcaggcgagtgacggcactgggcctcactcaaggacaagctgtgatttagcttccaggcgaaggtgcgagccaagtttgggtcaagatagggtgagtccccacccaaaagaagagtaggtagaagtggtgcatgtggtatccccttgagatataaaaggaggaccttgcccaccgaagtaaaggacggagaagagaaaggggggacgactcggagaatacctgagctcatagaggagagaaagaggaagaggggttctagagcctgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggccgaaccggcaaagggggacctgcgcggtctcccggtgaggagccccacgctccgtcatctggcgcgccaggtagggggcgcgtgtgtctttctaagccctcgtcctctttcgtgtgcgccaagcttctcccgctcagcccaatggccgaacgggcagtggcgcacaacctctctccgagcgctagcggtgacgacggggagcagaacccgcgccgccgagctcgtactccaccgtccccctctcgccgaagtcttgggcgggaggaggcgctcgaggaggtcgaaagatccgcgacttcgccgcccgcgggtgatggagaaggacggcgagacggggaacgtcgcctcctcgtctacggcgatggcagcacgccccagggcgcgctctaggctgcgggcgcgctcctgcgtcacccgcccgtcgtccccgatccagagactccagcccaacgttggctagacgacatgaccaacttggtcatgacggcgcagcagcgcctaggtgccggcgggcggtcctccgccaccaaggcctctagcgctgctaccgccggctccgtgtcgtcgaggcggagggcgcggcgagcggcggccgttacccgccgttcgtccgccattccctcgtcaacgcctccgacccaagaagatgtgcgtggggggccggatgcccgcctcaatatcgagcgccggcgcaatggtcgtcgtgctgcccacgcaacggaggacgcttcctcgtccggagcgccacttcggtccgggcacgggggccagcccccccgtgtccccggttggcggtgccggctgtcgagcctttgtggcgagccttcggaacgtccgttggcccccaaggttccggcccaccatcaccgaaaaatacgatggaagcgtcaaccccgccgagtttctccagatctacacgaccgggatcgaggccgctgggggtgacgacaggatcatggcgaatttcttccccatggccctgaaaggtcaggcgcggggttggctaatgaacttgccacccgcgtcggtccactcttgggaggatttgtgccagcagttcaccatgaacttccagggcacatatccgcgcccaggtgaagaagcggacttgcatgcggtacagcgaagggacgatgagtctcttcgctcgtacattcagcggttctgtcaagtccgcaacaccataccatgcatccccgcacacgcggtgatctacgcgttcaggggggggcgtgcggcacaaccgcatgctcgagaagatcgcctccaaggagccccagaccaccgcggagctttttcagctcgcggaccgtgtggctcgcaaggaggaggcctggacctggaactcctccggtaccggtgtggcagctccggccgcccccgggtctgccgctcggtcagggcggtgggacaggaggaggaagaagaggtcggcccattctgacgacgagggtcacgtcctcgctgtcgagggcgcttcgcgggccacccgaaaggggaggcctgcgagcgacaaaaagaaggaggctggcgctcccagcagggagcgcccgaccggcaagtggtgttccgtgcacaacacctccctccacgacctcgcggactgccgtgcagtcaaaagtttggctgagcggacgaggaagtgggaggaggagaggaggcaggagcgccgtgagggcaaggccccggcggctcccgccggcaaccggcgaagtgaggccaagcagaaggcccccgccgatgacatcgatgatggcgacgatgacctggggttccaggagcctgaggccaccatcgccaccgtcgatgggggagcgtgcgctcacacttctcgccggagcctcaaggccatgaagcgagagcttctggccgcggcccctacccatgaggcgacgcggcgggcgcggtggtcgtaggttgccctcaccatcgaccagaccgaccacccgccgtgcattgcccggggaggacagatcgcgatggtggtttcccccaccgtttgcaatgtgaagttggggcgtgtcctcatagacgggggtgcagccctcaacatcctttcccccgcggcctttgacgccatcaaggccccggggatggtgctccggccgtcccagccgattatcggtgtgacgccggggcacacttggccgctaggtcatatcgacctcccagtcaccttcggtggttccgccaacttccgcacggagcgggtgaacttcgatgtggcggacctcagtctgccctacaacgcggtcctggggaggcccgcgttggtgaagttcatggcggcggtccactacgcctatctccagatgacgatgccgggccccggtggccccatcaccatccatggcgacctcaaagtcgcgcttgcttgtatggagcagcgcgcggaccacctcgccgcggcgtccaagcccgcgggtggtgacgagaggctcagcacctccgtccctgccgccccgaggcagcggatgatcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgcctggagaccggcagacatgcccggggtccccagggaggtgattgagcaccgtctcgccgtgcggccgggcgcaaggccggtccagcagaaagtgcggcggcaggccccggaacgtcaagccttcatccgcgaggaggtggcgcgacttctggaggccggattcatccgtgaggacatccatccggagtggctggcaaacccggtcatcgttcccaaggcgaacggcaagcttcagatgtgcatcgactacaccgaccttaataaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgacgacttggttgtgaagacgcgcaaccaagagaccttactctcggatctagcggaaactttcgaaagtctccgctccgcccgcataaagctgaaccccgacaagtgcgtgttcggcgtgcctgcgggcaagcttcttgggttcttggtctctgcccgaggcatcgaggccaaccccgagaagatacgagctatagagcggatgcgcccccccagcaagcttagggatgcgcaatgcgtcaccggctgcatggccgccctaagtcggttcatatcgaggctgggagagaaggcgctacccctatttaagctcctcaaacgctccgggccgtttacctggacggaggaggctgagcgggccttcactcagttgaaggcgtacctcagttctcccccagtcctggtcgccccagagccagatgagccgttgctactctacctggcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccaaggcccccgacggtcagagctggccctctgcccgcttgtccgacggtgccaggcgcccccgacccccaggatggccccggggccactgcgggaaggccgcgcctgtcgccctctgaccccgaggttgtcggcgcagaagtcgagggcgccccgcgtggcctctcggatgaagagcgccctggagatgcggcccctggcgaagaggatcggccccgccgaaaggtgcagcggcccgtctacttcgttagtgaggccctccgggacgccaagacccgataccctcaggcccagaagatgctttacgctattctgatggcttcgaggaagttgcgccattatttcctggcgcatcgggtctcggtggttacgtcttaccccctcggccaaatcttgcataaccgagagggtactggacaggtggtgaaatgggcaatcaaactctctgagttcgatttgcactttgaaccacgccacgcgatcaagagccaggccctcgccgactttgtggcagagtggaccccagctcccgagcccgtctccgtcctcgaggccagctcgggcccctcgcagctgcctcacaccgcctactgggtgatgcagttcgacggctccctatctcttcagggcgccggtgcgggggtcacgttgacctcgctgaacggagacgtcctcagatacctggttcgcctcgactttcgggcgaccaataatatggcggagtacgagggactccttgcgggactcagggtggcagctggactggggatccgccgcctcctggtgttaggcgtctcctagctggtcgttaaccaggtctgtaaggagtaccggtgctctgacccgcagatggacgcttacgtgcgccaggtgcggcgtatggagcgccatttcgacgggatagagcttcggcacgtgcccagacgggataacacggtcgccgacgaactctcaaggctcgcttcctcgcgagcccagatcccaccgggcgcctttgaagaaaggcttgcccagccgtcggcgcgacccgaccccctaggggagacggacgcgcctgaacggcctccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccagcgcatctccaagcgctacgtgctggtggaagggaccctctatcggcgcgcggctaacggagtcctcctgaagtgcattcctcgggaacaaggcgtcgagcttctcgccgatatccatgaaggcgagtgcggagcccactccgcctcacgcaccttggttggcaaggcctttcgccagtgtttctattggccgacggctctcaacgatgcggtcgacctggttcggcggtgcagggcgtgccagttccacgccaggcaaacccattagccggcccaggccttgcagaccatacctctttcgtggctgtttgctgtctgggggctcgatatcctgggtccgtttaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcatggatcgaggagctgccagcggtgctctgggcgaaccgaaccacgccaagccgagcaaccggggaaacgcctttcttcctcgtctacggcgcggaggcggttctcccatctgagctcaccctgaggtcccctcgggccaccatgtattgcgaggctgatcaagatcagcttcgcagagacgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtgtcaggtctcgggctcgggccaaccccgcaccccccccgggcgtgcagggttggccgggggctaccacatgcatatacttatcttttttctcttccgtatttcaataaaagcattttcgatttcctaaggactgcgtctgtgccattgtttccttttgaataatcttggcttgaattagcacgctcgtgctcgatcctgcccttggtggcccgggccggctaaaatcgccaaaaggggcccagaaccgagccgtgccccggggcgtggtgaactccgggggggaatcggcaaaggcccacaatcgggttatccataaccctcggtcaccacgctcccggcctggccagtctcgacacgtggatctccccagtctaaagttataaaaaaccacctaatgttgcactattaatcagcgaagcatctacctatattcatactagtggaaccatgaatagagtacccaccagttggggttttgtttattctagggtgaacaaggtaataatatcaatagcaataataatgtcttaacaaaggtaaataggcatggctaaataaaacagtgataacgcgggaatgtaaataaagcggtaatgcattaatttaaatcaaaataattttataaacagggattcaatatgctcaaggatgatgtgacttgccttgctcgctttcccaaacgtcggcttcaacttccacgaagggcggatcttccgatgctgcagcgtctacacgaccaacaaaaaagaaaaggcttttactctaataaactccatataacaagcagaaacaaagcacaaaaatgggttcttgacttcttaaggaaaaattagagacttgaacggtctaattccgagttcaaatggccaagttatggccatttgaagtttatatgctctttaaatgaatatttgcgaatttcttcatttaaattttaatttaaaaagggtttattgcgtcagccgaggggagggggcgcgcggaccgggtccatgggagtggggcccacgcggcagcctcacggtccacggtggaccgggtgcacctggctcacactggccggcgccgtgggtcccacgcgtcagccgcacccgagggcgcgggcggctgacggccgggccccacacggcagctgctaggcgcgcccggaggcggccacgccggcgtagcggcgggaggcggcgcgcccgcgcccctatggtcgtcggcggcggccataggcacggcggagcggaggccgagagaggggaaggaaagggggaaacgaagcggcggtccacggctcaccccgggttgacggcgacgacggaaacggcgaccggagcggaggaaggcggcggcgcggctcgggtggacggggtcgacggcgttccggcggtcggcgagcgaaacggaggggtggacgaggtcggcgaggatgcggcgaagccgaaggaggcggcgccgaggtgggaggtggtccggggcgacgacggcggcggaccggagctcgacggcgacggcggagagagagagcgacggcgcgagctatattccagcggggagagagggcggtgagtggcggaaacggtggtcgggagctcagggagggtttatatagggttgggagtgagagagggcggccggaggagggggaagtgggcgcgggagacccggccgccattaatgccgccggcgaggttaggggaggggtttccaaacgaatccgagggagagagagagggaaaaatggggggaaagggggaggggatcccggggaataattccccccactttattgcgcgcggggacggcgggaggcggcgggattcgcggcggcggcggcgctagggcgcgggcgaggcggcgggagcggcgggaggaaggggatgacgggtgggccccacccgtcagcgagggtggcgggcgggcccgcccgtcagcggcgcgcgcgcggggagaggccggatgggccgcgggggagaggagagagggggagggagatgggccgagccggcccaagagggagagggagggaaaggggactttttagagtttttctttttataaaatcattttaactttgtttatttcttaacaattattatatgtgctctgaaaattccactaaaatttgagggctccttttagaccaaggagaatttaacaaaaattctccgggccacatttgaatttttcttgtacgtattttaatgtttgccaaattcttttcgaattttaattaattctattattccttttagaaaatgatttttatttcgggatgaatttatcaggacgtgacaaatccacccccttacaagaatctcgtccccgagattcgaggaggctagcaagaagataggttgggtggtcttctcttcttgcctgacttcttccgctccgtcttctataacaaacttgcctagcacaacttctccactctggaccgcttggctcgatctcctgttgcagatggaatcttctcttcacctgacttttccctggttgcacctctagctgacttcgactgggctgcggcattgaaggatggggcttcagttccagaacttcttataactcatatctttggagtcaacctcatacaagttaccaattcatgtcatgcgtcaacactagcttgtcattactaggataccatgtttgtcatttacttctaacttgccaccaactgcctcatattagctttcctggtctccgggtgctagctacttctgctatttgatgcaagggtcgataactttgcctttgaattatgtttctcaacagaaccaacttatcccacttgacgtgctttgacgtcttcccaaatggctttactgttggactagttatggtctgatcgtgatcctgccaaatctgaagcttcgttgttagatgtgattttaatctaacatctgtagattatcttcgaacatatcacttggttcataactgggaatagctctcacgaacaaacaactcggattcactttctttatgttcagtttactttccactattctcttcatgttgtcatcttttagcattcaacgtcttcctttacaccttcgaccttgatgagttccttcccattggatcatcttccaagacatggcattgcctggtaaccggtgcctgcacttttcactccgtgtagcatctgataccgagttgaagatttcactccttgctttcatagaaacacttttacctaggtcatcttgcttactcataaattttttttttcctcaatgtcaaggtgactgttgcagggtgatcagaggtcttcctcgagcgatgcaaagcatgtttctatttatcctttatcaatcacctttcggcctacttcttttcctgctagagaacatctttgccaatctctttgatcaatcatctttcgggctatctctaacaggtggtactctttaaggtgggtagcggacacttctggtggcgatgaggtcctttggcctactgcctttcggtgaaaccttgaagtagttcgtcaaaagctgtgctgactgtcgttgcctttgatccgaataagacacatctgaaactcctagtccaaacaaatgtctctttggttaatcgcttgattttcttttccatcatcaggttggttattaactcaaggttagaatatagttcctctgaaatgagaccctatttctcctttgtcagtaaacaattacacacataatcccatatccacatcttccaaaagaatcctaataggacttgtctgtattacacatttctcccttattacatgaatacaaggcactaccttaaacaaaaagggaagatgcttaacatcggtacattgtttctactatgggttatgattgacacgaggcctcagaggtatggcgtttgctccagtgaccacaggcgagtgacttgtcttcttcttgcataatggccagagtgatgacgcaggttacgcttcggctgtggacaatctctggagaaatgacctagttctttgcagttgtaacaaatcaatgtcttctttactgagttgtccatctaggaacgatcattctgacttggagttggaattggtggttggaaatccttgctaatattggcatcagtggtaccatagttgctatcaccattggagtctttctcagtgtcaaaattgctagggttgtcattctgggtgccttcattgatactatcgtcgatatcttggtgaatgctgttgacattgcacgcttgatctaagtggtcatgaatggggcaagaaccatggttgttggtggtatcatcagcattagtattgctaatgttgttgtctgcaatgtgtccatcttcttggggtaggaactcttgatgcgcaacagaagctccggtgatctgaagtggctcagtgcgctgtctttggttaccacatggaaatactgggacgttggcaatccttctcttgcagttcgtcatccgattatgctcactttcgagttgcatggctttgtccacaagtttctcaaaatcttcataatcctctaggagtagttgcactgcaagctcatcttttaacccctggagaaacttctcttgtttgtcttcatccgtttccacatcttctggtgcatagtgagccaaacgatagaactcgtgcaggtactctgtgacggtcaaatctccttgcttcaggtagcgaaactctcgttttcttagtgtgatcattcctacgggaacatgtgatctcttgaatacagatgaaaactcgtcccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttttgagaaattctgataacttgcattgttgctggactgtaggtacttgaacgttggttgcccctgctgggttgttccaattctgtaatagttgaaaggctgttgccaacatgttggtttggttaaccacaatttggattagcactgatgaggtttcgttgatgcttttctcattcccattggcttgggttcttgagtcatcggatccatcattcccatagcctttgttaccagtgttatccatctgtcacaaggtagaggttgagagggggagcatataaggaaagaatagaccagaactaggggcaagaccttaaaggaactaactctttttgttgatgtgttgtttgttttgcttattctgcaagttgattaagcaaacaacctagcacggttacatcacaacccactgatgcaaaccacgcgctacacacacaagcaaggaaacacacaactaacgactctaccctagagggtggcttaggttctgcgacgggttctccaagatcttcactgcttcctccacttcgctagcagatcctgcagtcttccggagcttcggcaaacaattggcgacatcttcttcttcgcaaaactaaccatctagtactagttgaaatttgaagaaggaaggagtaaatattttgcaaatagcacaggggaaaggaggaaaaaggggctttcgcaaatagtttcatttataaaatatgtccttaggttttatccacttggcttatcctacagtcgagatggctctgataccagcttgtcgcgaccgagaaaaatacattttcccgaacgctagtgtattaatccccgtcccaggaaaagccggggtacaccacacaaatatggtacaaaaggcacatctttattatatcgataatatttacattattacaaaggcacttaaggcctgacaataaaaaataaacagcagcggactaacgggcctacggctctatcttcacaggcgctcaactggggtataagccaggactccacctaagacttcttctccaaagcttctcttactgaagggggggaaagattgagcaagaatgagtacaaccacagtactcagcaagccacaccggcagatgcatgattaatgcaagggggtacaaggggtaataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttggtaagcaaattttaaggattaaaacactaacttgggtacattgctcggcgtgcccataaccgagggcgcggctattcgaatagattatactctgatcagaggtgtacatctttacccacaagacacatcttcctcacgtgtaaccacgtgccacatatcaccatggtatacgaacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttccaacagaggcccgagcttaatccttatattggccggggtgctacttcccacaactggcatgcacccaaaccccaccgaaaaacaggttttaggggctttgaaagaggaagagaggggtatgtccaattccaacataagccaaccattccatagtgtccagatgatatgaatattcccaaagtctaaagttataaaaaaccacctaatgttgccctattaatcagcgaagcatctacctatattcatactagtggaaccatgaatagagtacccaccagttggggttttgtttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgtcggcttcaacttccacgaagggcggatcttccgaagctgcagcgtctacacgaccaacgaaaaagaaaaggcttttaccctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgaggggagggggcggggtgcag

SEQ ID NO: 38395 - DNA, 5028 bp, Oryza sativa
ttatttcgggatgaatttatcaggacgtgacacgtaccctcgaagttgtggacgatgtggtcggcggcgtcccggacctgcgcgcgtgcgctgtcctcggttcctggagggaactcttccagcgctgcccacggggagaagtcagggtccttggcctggtagcttgccagtacgagctccaccgcccctcgggcaaggtccctcgaggatgacttgatcgtctcctcgagctcctcggggagccgctggagggtcccggccatctctgagaggcgctgggcgaggcccccctggttggcggcgtatttcgcggtccgcccgcccagaggcccgcttgccgcccggcgcggtctagatgggagacggcgtcccgaagcatgccgggccctacctcgcccgccaggcggagggcctcgacctccccggcggacgagtccagcgcgccctgcagctcggcgatggtgtgttcggcggctgcgaggcgagcggctaggtcgccgtcgcccgcggccgccccgccgctatgcgctctcgcgtccagctccttcgcccgcgcctcgagctcagcggcccgctgatcctgtgcggccctctcggcgcgggcgccttccagattgcggcgcgcctgctcctcccgcgctgcctcgcggaggaacaggctgtccgccagccgctgcgccgcggcctcggcctcctcgagagctcgttcccgctcggtgagcgcgtcctcgcggaggcggagtgcggactcctcttcagcgcaggcggcctcgtgcgccgccagtgttgcctcccggatggcgacggcggcctcgcggtccgccaggtccctctccttcgcgcgggcgcgctcctccagcaccgtggcgcgagcctcaagggcctcttcgcgctgccgggacgccgcctcgatctccgccgcccgccgttcccgggcaacggcagcatcaaggactccccgggcggcgtcgagcttcttctctagctccgccgcccggctcccgtattggaggcagaggtcgtcccgcgccgcgttgaacacggcggtggcgatgagggcagtctcccgctcctcctccacctccctggcgacctccgccaggtccctacgacgggcctcgagctctgaggtgtgccggcggtgtgccttgcggcccgcctccaccatggcctccaccgagcgccgcccctcttcgacgcgcgcccacgccgcgtcgagctccgcccgctctgcctgcaggacctccatctgggcacttaacccgtccaacaccgtggtgttcgcggcggccaaggcctgcaggaggggctccacgcttggtggggcagcggaaggcagaggggagagccgcctcagtgaggatgccgcacggctcggcccgccgatcgacgtgccggactcgggggcgtcccccgaagctggctcgtcctgagcgttgcccgaggggtcgggcccgagcggtgcgcccgtggcctcgtcgtgggtggcctcggaagtcgtcgtcgcctcgggcggagtcgagtcgggggcttggcaggctgcctggcgtgcgtgcgccgcctccgcctcccggacggactcctcggcccggcggagtctggcctcctcccgagcggcttcctcagcctggcgaacccggacggcctcctgggcagcttcctcggcttcccggaggcggtccgcggcttctcgtcggtcagcttcccgcctccgggcctccgcggtcgccgtctcctcggcctcagaccggccggacttggaatggcggggggggggggggggggcgcgacgggatctcgctgaggcagaagaaaaaccagaagacaaaaagaagcgggtgagtggaaactcgccttgggagatgggagaatgaatacggccgcggtgtgctcggggacgaacctgcgaggaggtcggctaaacgaccacctcgggggcgagatgaggttcccccggcatggctcggtccccccatcttgcggagccgtttcttctctcgctccccctcgggctgcgatgtcggcacgtgtcgcgaccgggaaaattgccttttcccgaacgctagtgtattaatccccgtcccaggaaaagccggggtacaccacacaaacatgatataaaagacacatctttattatatcgataatatttacattattacaaaggcacttcaggcctggcaatcaaaaataaacagcagcggactagcgggcctacggctccatcttcacaggcgctcaactggggtataagccaggactccacctaagacttcttctccaaagcttctcttactgaagggggggaaagattgagcaaggatgagtacaaccacagtactcagcaagtcacaccggcagatgcatgattaatgcaagggggtacaaggggataataataggggttaagttttgcagtaaacaacatttaaaagtcacttagttgcccaaagctattttgtaaacacgatcctagagctatacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaataggttttactctgatcagaggtgtacatctttacccacaagacacattttcctcacgtgtaaccacgtgccacataccaccacggtatacggacggaagacgtgacatagttcccaacccatcctagccataaacaagagtaccgacccaaccccacctacgaccggaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaatcacctaatgttgcctaattaatcagcgaagcatctacctaaattcatactagtggaaccatgaatagagtacccactagttggggttttgttttcctagggtgaacaaggtaataataacaatagcaataataaggtcttaacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacggccgcgaaccacgcttcgggaacctccggaacgacgaagactacgcgaagcacacaagcaaagctacaagcctaaaaagaagcaataacaacacataaaaagaaagcacacagttctttaggttataacaaacattaagagacttgaacgggtcgattcggagctcgtatgaccaagatatgatcatccgaagtttaatgctgttatatggagatttgcggattattgtaattaggttttgcaactataaaacaggtgtaagcgctagcctggaaaagacaggaaggctgcgccgttgacatgcggaccccacatgtcaacctaaaggaccgcggtagaccgggtacacagagacggtccacgggtcgacggaagcggaccccgtgtgtcaaccgaggcgagtggccgacaaacggactccactagacaccacacgggctgcacacgtggaaaccacgcggctaccgagcgggcacactaacacggtcaccacacgtacaagcgaacgactaccgacaccggtacacgggtaccggggtcgacaaccgcacaacgggtacgggggacaccgaaaggacgaggacggggcagcgagggagagggaaccttaccaccacgcgacgaggcgtgggaacgacaacgacgaacgggcgcggcggagacagacgggcacaacggagacgaacggcgaggggacggcttcggcagccatccttggacgaaggcgagacgcggccggcacgaggcttgacgacgcggagccgaggacgaagacgatgacggggctgcagcggcacacttgacggacgcggacgagacggacgagaacggcctgacggagggacgaacgccacgacgaccgggaacgacgagaggacgacgacgacgacgacgaccggggccggcgaggaggcgatgagggctgccggcagcggctgcacggaggcgaggatggcgcggaccacgccgctgcgatgccgacgacggaggcggcgccgcgagacgacgagccgggcgaccgatgggacgtcgacgacgagaacgatcggagacgacgctgatggaccgcggaggggtttggatggaggggaaacgatgccgaggacgaccttgccgctgcgatgccggaggtggtggaggtgtggccgaccggtgcacgggcgaggagggacgggcggccgaacaactccggcgaggcggatggagaggttcgcggcgatgtgcggcggcttccgggcgaaaccgaggggtggacgaggtggagggctacgtcaccgtgccgagggaggggacggcagcgccggctgacgcacgggcatggcgaaaggggcagccggaggagatgccgccgaggaggaaggagaagccggcgcgggcgacggtgttccggcgaaattcgggcgaggaggaggtgat

SEQ ID NO: 38396 - DNA, 7928 bp, Oryza sativa
ggcaaaggaaggcggccggacttggcgcgtccgttcccggcgattgggggcgccattcaagggggaattaagggggaaagagagaggagggaaaggggtttaattccccctaatcaatttgggaatcccatgcttgaatcgcgcggatttgagggaggaatggcgctagggttcacgggagagggagagaggacagccgggcgggaggaggacgatgacccgcctgacgcgcgggccccacgcggccggacgcgcggtcagcgcacgctcggtgcgcgtgtgcacggccggctcggctcggcctggcttgggcgcggcttgggccgggcggccggcccaggaggagaggagggggaggcggcctgggagaaagagggaggaggagggagtgggccgggaggggaagaggggcccaagaggaggagggagagaaggagagggaggagagggagacttcggccgcgggccgaggggagagaaggaggactttgggccagacttggcctaaagggggggagagagattatttttaggtttttctttttaataaactctaataattgtttttgttgcttaataattatttccggtgctctgaaaattcaagtaaaatttgagggctccttttagaccaaggagaatttaacaaaaattccccgggccacattcgaatttttcttgtacgcattttagtgtttgccaatttcttttcgaattttaattaattctattattccttttagaaaataatttttattttgggatgaatttatcaggacgtgacagcacggcaccctccgggcgcctgctgccggcacgcaccgccccgccccctcggggaggagatggggaaggggtaccctcctgcttcctcttcccccgggcgtcggcaaggcggctgccccccgggcccccgtcgcggggcccagaagcacgaccccctcccggggtagattgttcccccctacggctcccgcccgcgccatcgtggcctcgaggagcccgctcccccgacgccccgaccgcctgcatgtggtcaggatgttggcgcgctctgaatcgcagcagagggggaggacaccttgggggatgagggatgcctccacggagctgagattcagcacccgttggaccaccatcttgaagtcttcagggacccagtcccacttgcgcccctgatgggtcctcatgtagtcctcgggcccggtgtactgccaggcgccccgggcgcgccgctggagcggcgcgatccggcgacgaaggtagtcgccgaacaccatggcccccgtgagtccctgggatcgcagacccgccaggcggtcaaggacggcgtcgtagccgtctcccagatctaccgccgctcgccagctggaggcctgcgccgggggctggctcggaagtcggaggcgcgcttcgtcggcgaagggggtgtagaaccaatcgcttttccagtcgtcccactttttgcggaggacgcagggaatgtagcggttcagcacctgcccccgcggctggaagtagcagccaccgactaccgacggcggcgacaccggctgtacggtgaagaaccaccggaacagccggagagatgggcgcaccccgatgaacatctcgcacaggtgcgcgaagatggccaacatcattaccgcgttgggggtgaggtgcgccatctggagatcataaaactccagaatatccatgaaaaaagaagagaatggcgggaccagccctgccattgcgaaagagaggaagaagacggaccgccccaggtagtgtggcgtcgggcgtccctcgcccagcgcgaccacctcccggccggtggcagattccggcatgaatcggcgcggcagcccggcctgcctctcgctcacgatgcgggaaggcggcagcacgctaccgtcgagcggtgcggagccccgtgccatgatgccggcggaggaggagcttgagagcgagtgagtgcggcaagggtagggcacaggaaacgaagagttagagctcaagtggagaaggcaaggggaagaatggcgagaggaaggaaacgaatctcttcctcggcgtctttatacccttgccaacgctattcccggctcctcgtttcccgcgcccactacctcgccccctcgtttctcgcgcccacgcctccactaacccaactcgctcgtttgcggcgcacgaggcagatgtgcggccgtagcagttgagatgggacagatcgtgcgcgcattaaccacgctcgccaaacgcgaaaagcgccatcatcacgtctccaggcgaaacgaaccggctcgtcccgattcgcgcgctgctcgagtgatgtagcggtcttaaagaggccgctcattattgtcggtcggttttcccttgccgatgcgcgcgacttgcgaccgatgggttcctacccgcctgtagggaccggccccacctgtcaccgggcctaaggagtggcgtcacgcccgagcgcttcccacgaaggggcaatcgccctggcgtaacgccgggggctactgtcggtgacatggggccgagggtatcgtgactagaggcttgggtagccgcggtcacccacgtggcctgaccccctcgggggggtcgggcccgagggtgatgtggcctcccctccctctgtctccccgaggggtcgggcagctcccgtttcggccccgagggctggggcgccccgaccccctgtagttttggcgccacgtgtgtgggttaggtaaacacagcggcgcccacctaaccggatttatagcgggttggacgagcgcgccacgccgcatttaaaggggggcctgcgtggtctcccggtgaggggccccacgctccgtcacttcggtagcctcttttctggcatcctcaagtagaagtgccttgttgatcatatgctgaaaagtggggaagtcatgagcaagcaactggagtctcattccaactgcaattcccttcaagaacttcctgatcttcttcttgtctgtgtccacttcctcaggggcgtaccgagccaacttgttgaacatacttaggtactcattgacactgctgttgccttgcttaagtctgttgaattcttctttcttcatgtcaatagtgctttcaggcacatgagctgcacggaaagccgtagcaaactcatcccaagcaatgttagtgggttcagggtgtgcattgcagtaattttcccaccaatctgcagcaggtcctcttagctggtgagaggcgtagagtgtcttctcaacaggagtacactgtactaagttaagttttctatcaacatccttcagccaatcgtcagcctcgacgggctcgacggtctgagagaactctggcggacgagacctcagaaagtttgtcagcttggatctattgttgctcatgtgagggtggccatttccatgcgcattatgctgataaccagctacggctgcggctaatccttgcaagatttgtgtctgaactgccattaagtgctgcatgttattttccacatgaggtggggaagggaggcgttcttctccagaattgtgactggcggtgtggtgagagcggtgggactgttccatctctgcattacgggaagctgtgtgatgcgagcggttgctgcggcggggttgctcaacttctgcgttgcgggaagcagttcggtgcgaacggttgctgtggtgagactgctcattagctgactcatgatttgcttctgtcacaactctaccttcttcaaaaccgaagcgggctggcgcacgggctgcacggcgggggcggctagccatctaaactcccagaagagggcgaggtaagaatcaggtaagcacttaggagggcaaggagtaaagtaaatagcaactcagatagcacacactaggcataaactgaatttttcaaatcataaaatcacctagtacaacaggtgtggacaagtcacagagctacgccgagcttgactgtgcgcacaccacctaggagaaccagactaccaaacaacacccacaacaaacacacgcacgcactacctcgccatgactccgaaagagttggcggcggaacaaaagggcctaacacacggacagctgctgaagactgcctcctctactcctcgtcggcctggctgcctcctgtagtcggctcctcagacgaagaaacgtcaatcggctgacgcgaagggaccggcggaacctgtcgagggccgacagcagcacgggccgctggcggtgggggagctgggtaatcgaatcggaacacggtggaagaaccaacaacacgcttccgcgcggtgtggataaagcgtgggccacggtgggaggaagcaactggggtgtgtccgggggtgtaggaggggctaactgggtgtgggtagggggagtacactggtaagtacggcgcacgcgagctgggggagcgcgggccactgggagtgcgggcagagccgcgggagctgtgggaggacaggtggctggcgtggcagaggcggcctgagtcccaggagacagtgtcaactgaggtgacaccctcctcggccagacgggcctccagagcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgcgtggccagaaggaaggcgtggaagctgccggaaggctgagcccccgagacggtggctgtagtcgtgggccaagcgacgaagcgcagtccaggagaggtcctggtacgcgatctggagagtgggcctggccacagtgaagtggtgtgggcgaaggccaactccgtgtatacctccacgagggtaaaggtacacagagagctcacagtgagggggaacacggtccacggagtaccccgtgtactcggggcacgagaagccaaggaagcgggcgaggtcacgaagctgagcgacgtggtgaccctcaccaaaaccgtgggaactgaagcaaactattgaaagagggagccatctacaattttgaaagagggagaaaagatcagtaaccattttagaaacaaactattgaaaataaggaaaccaaaagaagccttagcttttcgcaagtagttttgaacttagtatccttagggtcgtcctaaatgtcgggtttcgccctagggccaagcctgtgctcttataccatctcttgtcacgccccgaactagtaccgaccggaactagcccgtgacgctctaaattaacctgttaatcgataccagtcccaggaaacggtgctggtatcacaggaagacggattatcacagcaacagaggtctctttattatagagtagaggtacagtcatgttgggctgtggacagatcccgagctcacaactgcattacaaaagggaagcggaagccaagacatggaccaaacaacacaggcgcgacttgggaactaggccgaaaccctaaaactcatcgtagccggcttgctcctggaagaactcctcatcagcaggatccgctttatcttcttcagcaactgggggggattatttatatagagcaagggtgagtacgggagtactcagcaagccatgggaaataagtgtttaatgcaggcttcaaggaaaggctgttgtttttgcaattgattttatttgaactcttttctaaaaacgactaagtgagtgcttctcaaacgacacggatgagacagtgcatctcgtccggtcggagtatgtgcaatgcatcagtctttagaattgaaacaaggttggcacccggccaacaacttttcaacggccacccgggccaacaacttttcaaacggccacccgggcctagctgatcccatcagctacagatttttcaaacatcgaaccccttttcacaacagcaatttcacaagcagtagtcaaacaaaactacggtagaaatcacctcacatccgcccatgaccgtgggcacgactgttcgaacagtttgttaacctctgcagagggggtacactttaccctcacgacattactaacccggatcaccagcccgtggggatcagccacgtcgggagacctccaagctttcatgacaaggcatttcgaaagccgacacaggtttaccatatgccgacgagaggggtcccagaccaacaacaggtttggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatcaaattccaaggaaacggtccttaagtgcaagagcgggaaactgtacacccggtacattccccggtccgcggttttggaaattcatttagttcgcaagcaccgacccaggtgtcgggttttccaagtcttttgtaaaacccaagttttacccaagatgtttatcatattttaagtttgaaggcgaccgtcgatactcgcacagagtgcacgaataccgaggcgcaactgggtggttacaagggaacatggtgtaacgattaacaaaggaaggatcaaatgcaacaagttaggtatgcccactaatctgcctcgcaggcggggcaaacatattacgtgcaatcctatcaatgcatgatattttgcaagcaatataattaagttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaagaataaagccctattaatgacctctaagcatgccattagatagatctcgagatttgaggaattttggaagttgaacggagtcaaacggatttacggttgggaagatattgaatttctaagattattggatttttggtctaaaggaaaaaggatttaattaaatcctttttggaaaagaaaagaaaagaaaagaaaagagggagggaatatagacttttcctcgggcggctagggcgcggcccgagagaaacggagcggtccggctgagctaaatgggccggccggcctaaggcggcccaagcgcgcgcgcgggaggggaggagagagagggccggtggaccgggctcaccacgcgtggtcccgggtgggacccgcttgtcagcggctcggctcaccgtgcggagggagcacgcggcgcggcgctagggtgggggagggacgcggtgcacgcgcgcggttcgcggtggatgcggatgcggcgggcccacgcgcagcctcacggctcgcggtggaacgcgcgcacggggaggggctgaccggggtcggctcgacccggccttggccgagctggcgctgacgtggtgcctacgtggcgcctacgtggctgccacgcgggccggcgggaggtagacgacgacgccggccggaacggacggcggacgacagcggcgagcgacggagcaaaccacggcgatacaggcgagagcgagcacaccaggtggttgcacaggacaaggggagacgagccaacggctcggattcgccggagggagtgcgtcggcggcggattgcggcggtggcaaccggcggcgagggaagggggaaacggcgacgaggtcacgaggggccaattcccggcggcgagagcatctacgtggctataggaatccattgctagcgtcggattgggcggagctatgccgagcaaggccggcgacgagcggtgcttccgagctcgggcggcgacggcggcgagcacacggcgagcgacggcaacggccagggcggcgccggctagctacggggaggctactcgtgctactacccgagtctaaggggaggagatggagcgaggagggagaacggggagatgctcta

SEQ ID NO: 38397 - DNA, 2244 bp, Oryza sativa
cagggggagatgggccgagagagattcggcccatcgaacccgggggaggcaaattagacttttgcggaggaattgatttgggaaggatttggattcgggattgaactcgacaatagatcggggatttgagatctgagatggcacggacactagacaacaagcgaagaaataaatttcgcaattagggtttttaagagatagttttcccgctaggcgccacgacggaacgggcgctacagaccaacccccctaacaagaatctcgacccccagatttagcacctaagggagcagctccgggaactcggcgcggagaagatcttctcgctcccaggttgcctcatcttcagaatggttgctccattggactttgtagaacttgatggtcttccttcgagtctgacgttctgcctcttcaagaaccttgatcagtctttccttgtaggtcagattcttttccagctcgatattacccagggaaacttgctcttctggaactcgaagacattttttcaactaagacacgtggaacacggtgtgcacatctgcgagaccttcaggtaactcaagctgataagccacttcgccacgtctggcggttatgaggtaggggccgatgtagcggggtgctaacttgccggacatcccaaacctcctcataccacggagaggtgatacccgcaggtacacatgatctccttttccgaactcaaggtcacgcctccgattgtcagcgtaattcttttggcggttctgtgctgtctttaaacgttctcggatcagcttaacttgttcttttgctgccttgagtatgtcaggaccgaataccagcgcttcgcctacctcattccagcacaagggggtgtggcactttcttccgaacattgcctcattcggcgacatctgaatactggcctggtaactgttgttgtatgagaactcagcatacggcaaacaacgatcccaagtgccttcgaaatccagggcacacgcacgtagcatgtcttctaggatttggtttactctttctgtctgaccatcggtctgcggatggtaagctgtactaaaatttagatcggttccgagagcttcatgcaactgtttccagaaccttgaggtgaactgagtgcctcggtctgacacgatcttcttgggacagccgaatctacatacgacatgggtcatgtagagttctgctagtttctttccatcaaaggtagttttcactgccacgaaatgagctgatttcgtgagtcgatccacgattacccagatggagtcgtacccgctaggggttcttggcaaaccggtgatgagatccattccgatttcttcccatttccactcgggaattggtaggggctgtagcagaccagctggcctctgatgctctgccttgactctttggcaaatgtcacacaaggctacgtattctgtgacatctcgcttcattccagcccaccagaagtatgccttgatatcttggtacatcttcgtacttcctggatgaatggagtaggcggactcatgagcttcctttaggatgagatctcttaattccttcttggccggtacacagatgcgtggaccgcaccaaactgtgccttgatcgtctatggagaaattggtgtctttcttctcctgtattctttttattaactcttttatcccttcgtcgtctttctgagcttcccggatttgcgactctagggtaggctgtactgtcaagctggcagggacacctgactgtaccacggtcagcctcaacttctccaattctctgcacaggcgatcttggtcaggccgtatttgagctacattgcaataggccttgcgacttagcgcatcagcgaccacgttggctttaccggggtgataatgaattccaagatcgtaatccttgattagttccaaccatcttctctgcctcatatttaactcagtctgagtgaagatgtacttaagacttttgtgatcggtgtatacttcacatctgttcccgattaaatagtgcctccagatcttaagagcatgaaccacggctgccaactcgagatcatgggtgggatagttgacttcatgaggcctgagctgcctggatgcataggccacaacctttcgttcttgcattaggacacatcctaagccttgtcttgatgcatcacagaagatctcaaaatcttttcggatatctggcaaggtgagaactggggcagtggtcaaccttttcttcatttcttgaaag

SEQ ID NO: 38398 - DNA, 14068 bp, Oryza sativa
tcgataatatccagctaagccaaggaagctgcggatctctgacacattcttgggcgggttccaagcaagtacagccttaaccttgctgggatctacttcgacaccgttggaggagatcatgtgtccaagaaatgctactcggtctaaccagaattcgcattttgagaatttagcgagtagttgatgatccctgagcttttccattatcagcctcaggtgttcagcatgttcttcctcattcttggagtatatcaggatgtcatcgatgaacaccacgacaaattggtccaggtattccatgaagattttgttcattaagttcatgaagaatgctggagcattggtgagtccgaaggacatcactgtgaactcatatagaccataacgcgttgagaaagtggtcttcgggatatcttcagatctgatttccagttggtggtaacctaatctcaagtcaattttggagaaaactcttgctccttttagttgatcgaacaaatcgtcaatccgtggcaatgggtacttgttatttatagttacttcattcagggctctacagtcgattaccattctctcagagccatccttctttttaaccagaagcactggggctccccaaggggatgagctaggtcgcacataacctttactctccaattcttcgatttgtcttttgacctctgctaactcattagctgccatttggtagggtctttttgcaattggtgcggtgcctggtgccagttctatcgcgaactcaatctctcggtctggtggcatactcgttaattcttctgggaatacgtcgggatattcacagactacgggcaccgactccaaggaggtgacttgtaaacaggttaggatagaccgacttgcggtaggggtgttagaggtaaagcggacttgctttcctccaggtccttgcaaggtgatggacttttcggcacaatctatctgtcctttgtgcttagctaaccaatccatccctaggatgatgtccaagttttgcgagtctaggactatcggtttggctaggaagtcaacttcctcagttctaaggttaacttccgggcatatttgagttgcccttatattcctcccaggggaatgtactatcataggtacacgtaaattttgggttttccaaccatttcttttcacaaaagcttgtgatatgaaagaatgagaagctcctgaatcaaatagaactattgcgggtatggagttgacagagaacatacccatcacaatgtctggagcatcctgagcggtctcagcttgaatgtggttcactcggcctcgaccaaagctgttggaagcacgagaaccttgtccacttgcctgagagctaggacgagactgagctgccgctggagtaggagttctggcagtgctgccattagcatgcccggagttggtgttggtaggattctgagggcactctctggcatagtgacccatctggttgcaccggaaacactgaactgctgacggtccctgcggtgacttgaaagaggtaacactgtttggcgcagtagtgccactaggggcacgctgctgtggccgaggtgccggacggttcatctgaggacgaggggcgtagcctggctggcagttagcctgagtgaccgactggtggtattgcatgggttgaccgtagcgagggcgaggtgcgcctcgggaagaatttcattgatggttagacttgcgtttcttgtattcttcgtgtcggtgacatggggccgagggtatcgtgactagaggcttgggtagccgcggtcacccacgtggcctgaccccctcgggggggtcgggcccgagggtgacgtggcctcccctccctctgtctccccaaggggtcgggccgctcccgtttcggccccgagggctggggcgcctcgaccccctgtggttttggcgccacgtgtgtgggttaggtaagcacagcggcgcccacctaaccgcatttatagcgggttggacgagcgcgccacgccgcatttaatgcggcgcagcgcacgcttatccggtccgtgaccggtcgcagtgtgtgaccggtcacagaccggtcagatcgcgggttaggtggcaacaggcggcctgtcacacgcctcgccccgtcccgtcggaatgatgagagtctccaggcactcgtccctagccggagccggcgtgctaactcctggagttggtatgtcagtcccggccatattcattccaagcttcatcgcaaccatggcaaggaagtcattgtatgaagaagggcagatgtgcggcatgctaaactgacgcgtggtggacaagaatgaccggtctgtgactggtctgacgccggtcacgtcatcggcagacaaccgtgctcccacgttgcatctgcttccggcggagtggaggtaggtatgacccatcccatcggagggttattcggacagcggctattgcaaatcttcatccattaatgaaggaatgacaggggtatcccctgtgtcaggcgagtgacggcgctgggcctcactcaaggacaagctgtgatttagcttccaggcgaaggcgcgagccaagttttggtcaagatagggtgggtctccacccacaagaagagtaggtagaagtggtgcatgtggtatccccttgagatataaaaggaggaccttgcccaccgaagtaaggggactgagagaaaaaaaagaggactgggagacgactttgagaatacctgagctcgtagaggagagaaagaggaagaggggttctagagtttgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacacattgagggtgaagaacctcacttagcgcccccggccgaaccggcaaagggggcctgggcggtctcccggtgaggagccccacgctccgtcacctcctgtgggccggaattaggaaaaaaaactgttctacatacatctaaaggaaaaacgatgaataatacgttcaagaaaaacctatgtacggacttatacgataaaagcgataaagtaaagaaacaaaaagcatacatcgtagtgtcattgaaaaaaaatcgatgggctttaaaataggattttctactatttaaaaataaaatatagtactctataaatatatgcagttaaactatatcttgtatataaaatctatatattatctattatatactaaaagttaattaaactttctacaaatactattaagccgtcatgtggcactataataaataaaagaaattcctataaattctaagataaaagcaaaacatgtagtcttgattttcacatacccgttattttcaactggtagattatatctatttaaaaaactcccttcttttaatctcccattctcgtaagtattgctcgtaaaaacaccccccaaaatacaagtaatcccaagtcgccacatggaaccctaataaaataaaaaaaaatcttacattcgatttttatttaaatcggtggatctagatcgttagatatatcttaaaaacaaaaacctcccacgtccgcatatcgtgcaccacgcacatactgatcaatttgtacgctccttctgttcctttctctttttatatccctatcacaattaaaattaaaattgtctttatggaaaaaaatcacaaataggcattaaagtcctttaaacatcttataaacatttctaaactattgtgtgacactcttaaattagagaaacattcatccattggttttcacttaaatcaatagacacattattttacatcgttattcgatctttttttaaaaaaaaatcatcccaaaccatattcccttcctctcatccctatgggcattaaagtacatgaacgttttgctaagctgttacttgtctcacttaaattaaaaaaaaattccaaccatcggttttttttacttaaacattaacacattattttaggtcatcagatcactctttttttaataaagaaaacatccaaaccctctctatttttccttacttttctttgtttttcctatctctatgataattaaaattaaaattatttttatgggcaaagaaaagaccacaaacaaatctccacctattaggtctagccaacttttttttttaagtcaaatcaataacttaatacccatattgactatatttaattgctaacaaaaaattacattatggacccacatgcatattgaggcctccacttaataaaggcaaaaatttctacgggacattaaaaaaacgtgtgattagctgggagacactacaagaatgtatatctgccacaagacactgcaaaaaatggtaataagctgcctgtatacccacgatattattttgttatccaaaggaaaaggagatagaaacaattgcgaaagtatgattttgcccctttctgccatgtgcggctcgcatatagctctgacgccgtcgacgccacgacatcggcagcggagggtacggtagcacagcacgccactgcgagaccgactgcaatagcatgtgctctgcggcgccctgctcaacatgaaccaggcggtggcccacgttgtgctccccttaactgcggtgtgtggcggagcatcggcgccggcatggccttcgcgctgcagcggcgacgagtttgggaacaatacggacccatgggcctaggcgcacgggccctcctcgataccccgcccccagagagccacctcaccggctgcgggtgcggtggcagcgttggaggtgaatgtgaggcagacttggtagggaggggaaaaatcatacttttgtgattgtttttctgtccaattccttttgatattataaaataatatcacagatattgaacagctaattactaattttttcgatgtcccactcataaattaaaaactacacggtttaaagtaattttagttcacaatttaaaaactaccagtgctcaaagcatgttaaataagttcatttttagtttatgataaagcaaaagaatattttttatagaaaccacccacacatgaacattcacagtaaatttcacgcacatgcccgcgcatatgcgcgggctaccttcctagttgctttaaaaatcatattaatttatcttttttaaaaaataataatacttaattaatcataagaaaatacgtcgctctgtttttcgtgtggagagaatgtgttaccaactccactgaacgaacacagccggttgggtttggccggtgaactgcggatgcagtgatgcggctgggtgaaaacggttcggaatcggtacaatctcttcgaaaacgatgtttgatcggttggtaattgattatatatatcatttaaactaatctacatcaatattaatacgatgaaaaagaaaattaaaaaacataaaatttatcaatagctaaaaatgatatggttgagaacggtacctcctattaaaaacggctctcggtcgatcggaaattttcacgactgttttcacccggcctactacggccctatttatttcccaaaaactttttgccaaaaatatcacatcgaatctttggacgtatgtatggagtattaaatatagataaattaaaaaactaattgcacagttagaggggaaatcgtgagacgaatcttttgagtctaattagtctatgattagccataagtgctacaataacccacatttgctaatgacggattaattaggcttaaaagattcgtctcacggttttcatacgagttatgaaattagtttttttattcgtgtccgaaaaccccttccgacatccggtcaaacgtccgatgtgacaaaaaaaaaaacttttcttttcaggaactaaacgggccctacctatggggcgaggtgatgcactcatgcacgttcaaccggactgtttccccgtgctgcgcacgtaggcattcgtcggtgtacttgatggatcgggggttgtccggttgagagctgagacgtgcaagttgcagagggttcgttgtcagttattaaggatgctatagtacgagtacttgctacagtgtttttagatgttgctatagttctcgttttaggcggaggcggagctaggattgagaaggatttgatggataatactttgttaaaagtcttagataaagcttaatatatcattgcttaggttaattatctaattaattagaggattatataaaaaaaggaactgttggaggagacgaggctactggtcgtcctcctacctctaccactgttttcagggggttatacacccctattaatttttgacttggatttgaatgccttcgcattgatgctacaaagtgaagttttgatatgaatgttattgcagtagttaatacttgtaaccatgtatgatttgatctttgatttatagaaatccaatggattctgatttgattttgacttgcatagtccaatgggttataattttctactagtcaatacttcgtcaaaaaaaaaaaagctaacttcagatgggaaacattccatcttatcctaggttggttttttaagggatggaggaagtagtattccttaggagtggatggaataaattaatatacaattatggtaatttaatgcttgattcgatgtagttttggtttaaagagtttgatgtgcagattgtaacttacataataatctaccaaatgttactttatccctataatattaatcagcatagatgttgaaccatatcactatatccatcgatttatatatgtcagatttgagatggtttttgtttgcttggttgtgattcagacatgggttgattacatttgactattacattgttccaaggatggagaacataaaatttcctacattcattggagaagtgtcattataagtttcctacatttaaaaaaaatatattattattctttatctatttggagccatttcgtcatgatttcacacctattagttatatgtcactacttattatccttttgatgtgtttatcaaaaatttttttaatgaaattaccttattcttatttcttccatgcccctctctcctctctatctcccactgctggcaatcgacaacgattccacgaccacgcaataatccaaccaacgaggcatgttcttgaggatctagcagcaacggtgttactgttgagcatgaccaacttgccctgggcttgacggatctagcacaagcaccgttaggtgcgactgatttaaacttgagtgggctggtttcaccacaataacctaatcagttgaggtatactcacttcgcaagaggggatatatcttgaatatatataagattgtaatatatggcattatttcaaatagatgactagtaatattattttttcaaaacgagcaaatctataattatatggatttaattaaccatttttacttttggcttctttttcgaatcaaacgtacgcatggtgctatgctacgcttgtttacacgcaagctagcttggtgtaaacacgaaagacaaaggtttatttgaaaatatactagcttgtaaataccgttctcatgggccttcacaaaaatgaattccgagcagaatcatgattcggacgcacgtgctaactgcgagcacatctgagattgatgtgcatgaacaagttgacgatcgaggatatgacaaaaaaaaaaagaagagaaaacaaaaaagccttgcttacgcaaactagacacgtgtagggagatcaccaactccaactacacttactgtactctctagcttcgatttttgtagcatccggagacgactggaattaattaatcaatgtgcatcgatctatgatgccagacaacatgcacagtagcagcttaattagcaaaaacaacaattaattacatgtggcggctacaagctagctaattaaagctacggcctatgcaggatcctcttggcgaagacggcggcctcgacgagcgacgtgatctcgtcggcgacgtccgtcacgttgcactggttcccctcgaacgtcctgatcctcgccgccggcgacctcaccgccgccacgcagtccagcaggctctggttgcacagcatgttgaggtagtcatctgcacacatgcattaatttcgacagacacatcccgttatcagtgtacaccgtattagggtgtgaaaacgatcggaaacggtcggaatcggtagcatctcttctgaaacgatgctcgatcagccggtaattgaccatatttatcatttaaactacttagtatcgatattaatacgatgcgaaaagaaattagaaaaaacaaaattaaaaaatagtcaaaaacgatacggttagaaacggtaccccttaaacggaaacggcgcccggtcgatcgggaatttccgtgaccgttttcacccctacaccgtatgtcgataggtgcggatccaacatgagtgcaggagaactcgatcgagttttccggctctattctattggatcaccgttgatagaagaaaagagggagggagaaacaataggaagctgagggagaaaggaggagacaagctccctctctctaatcttatattggatttgaatttgtcccaatgtgtagatgttcaaaatgatcaaaatgataagtgaaaaagattggtgtggaattcagggttcaaaatttcggttctatcggaacccctgatacgatattatttcggccgaaatttttatttttatttttgaatttgataatattatgttcaaaatttgtcaaattttattcaaaaattcataaaatttcgaaccaaaattttcaaaatttcagtatttcggccaccccgatacaaacgagcacaccaaacattaaacctggtgtggatacgtactgtcggtggcctggacacatgcgtcgtggagcatgcagcaggcgtcgagggcgtcgcagggggcctcgccggggcacccggtgtacgacacgccgcagtacttgccgtaccgcatcaacggcgcctctgcacacgcaacacgcaaatttcacaacaattaacacttgctcacaacacaaattacagcaagagaaactgacaaattataattatcgatcggccagggagagtggtatatatatacgtacgtacgtgcatacgtgcccaggcagtgctccgactcgcacgtccggctgcacttctgcatcatcgatcagccaaaagaaacaagaaaagaacatcagaattagccagaacgatcgaccaacgaaatcgccggctttaacctttccagtaattaacgatactatgtctctctaacgtacctcgtcgttgtcggcggcggcggcggcgggaccagacgccggcggcgcgccgccgaagaagccggccagcgagtggtctgcggcggcggcgagcatgagggcgacgaggagaagctgccgccgctgggcgtcacccattataatttggtacgtttgcttcgcctaatcgctgatcagctcgccgtgattcgcaggagaaaagaggctaataaaccgcgcgacgggtgcgtgcagataggcatggtaggtggcaaattggttgggaaaaaatgggagcaattcaagtgtgtgtcaaacaaaagacttccaagaactgaccatgatgtgctcttgctcacagcttcggtttaatttctaagaggaaaaaaaaggtttatttaaaagaaaagtgtaaattattgcctgcagattgaaggttgtcaactgtcattgtactttggctgcatgtaaacaatggattaatctggcgatcatctcgtttcatcattttgttagctcaaccgcatggacggatgtattcatgtatatgctgatttgcatcattgcatgcatggatgtggggtcagccggtcgggttggtgatcgatctctccgtgggaccattagccatgcttgcatatgcatgttgattgattagggtagcattgttcatggatcatgatgggcgtcggttttgacaggagatcggatgctccggtcccggccggccctttctaggccaggtttctttcctgggcccatccatcatcttttaatccaagaagaagaagaggaatagttttgtttttcatgtggatggcaggcaagatcttgtgtccactttggctcattcatcctagtaaaaattctgttataaaagtcagcttgtgtcctttagtaaaagatatatgaagagtacaaactcagaactgtgtttttatggtgcggtccatatagcatattctttcatttttgttttcaaatatgacattctttacttcttactatctcataactttgtttgtggcatcgccaaacattgatgttagccgatgtggtagactttttcaccacgtcaatgatatataggcaaacacagctactttaaacatggggtaaattgaatagtttgaatagcttaggggtgttggatatctgattttagaggtgagaagattgttttacacggacgctataaaacaatagttggcttagttttagctatcttatctagaacactgaatcactaaagtttcttgcaaaattatcgtgtcacgtcatgaaacaaatatgcatgagccattccatttttatggagatgttgcaaaccttctttcacaaataggcctgggctcctactctcccacgcccctgttgtgaaaacaaaaaagctgcaaaccgcctcatcttatcgtcatcacgctgtccacggcactgcctccaaggacgatagactacttcaccttttactccctcttccttacggccaacacatctttctcctcgccctgcctcctcctcttagtggtagatataaataaataacccagtctacttgaggttatggaaaattaacaagcaaggaagaagccataagccaatctaacgataaaaggagcaaaaataataggagagccttactacttcctccatttcacaatgtaagactttctagcattgctcacattcatttagacacatgtatgtgtctagattcattaacacctatatgtatatgggcaatgctagaaagccttacattgtgaaacggatggagtatattacaagcacgcatgaagaaaacatcctactatacataatataaagtttatggccaatattgcaatggcgttttaagacaatcacaacataaattacaactccaccaacataaaagttgttataattgtagtgttataaaacaactttttaaaaaaatacatatacatttgcactaaatgaaaatctaaaaacagacttccagctaaccagaactacaatattatcttttttttaaaaaaagagagatagcaaaaaccccaaatcaccaaagagcgcaaaaaaaaaaaaaacctaaacctatctttatcatacccacaccgtccacacacagcaaacaccattcccacccactaaaacccctccacgtgtcccccccgaacccaacccacctcccccccagccacacgcccgcacccgctcccctcgcgcacggcccgctccccttgaccgccacgtgtccccccactgacatgcgggccccaccctccacccacgcccttcctcctcctcctcaaatgaatccccacctccccctccccaccaaagccgcgttcgcatccgccgccgcagccgcagccgccgccgccgacgccgacgaggagaggaggagagggaaggcgagagggaggtaggtaggtaggcagttagccatgtcgccggcgagccgacgagggaggagagcgtgtacaaggcgaagctggcggagcaggcggagcggtacgaggagatggtggagtacatggagcgcgtggcgcgcgcggcggggggcgcctccggcggggaggagctcacggtggaggagcggaacctgctgtccgtggcgtacaagaacgtcatcggcgcccgccgcgcgtcgtggcggatcatctcgtccgtcgagcagaaggaggagggccgcgggaaggacgcccacgccgccaccatccgctcctacaggggcaagatcgaggccgagctcgcccgcatttgcgacggcatcctggccctgctggactcccacctagtcccctccgccggcgccgccgagtccaaggtcttctacctcaagatgaagggcgactaccacaggtaagattcgatggccttgatctagtatgtgcgcgcggcgaatcgaccaagaattcgagataggaggatttgttaggtcggtgaaggtaacatgtagggagttattgggggtgtgattaacttctaggatattcttttttcctttgtttattatatgattggtctctgggttaattaaggttgtacggtaggatttgatttgagttgtgcaggtccaaatttaagatctaatggtagttttttttatgggttgataggtgtatgagatcccttgttactgtacaggtctatgtttaagtcgtggtctttatatatgatgttaacatttcctcttggcggtgaaaaagtcagaattagatgtgatgtctgttaatggagcggttgaatgctagttttcttcatattcttggggatcttggcgctgcctaggagtttggtaccgattaaaggtgtgaaaatttttcatcttgatggatgtatgatttctcttggtgacgatttgtgaaggtaccttgcggagtttaagtctggcgacgagaggaagcaggctgcggagagcaccatgaatgcatacaaggctgctcaggttggatttgtgataatatgttttttttttgtacatgtggatgcaatggttaattggttagtcttgtggtttgaatttagttttttgttttgcgtgtgttggcaggacattgctctcgcagatttggctccgacccaccccataaggcttgggcttgcactcaacttttcagtgttctactatgagatcttgaactcccctgaccgtgcctgcaacctcgcgaagcaggtctgcttactctacttctacatccacttccattttcccctttaattttctattctgttagttgcatcatgcatcttcaatgtacatttctttgtatgatatattttcatgccaagtatttatccactattgattttgtaccattaaggacctgctttctactggaatactggttatactggagatatcatggtggatgaatggagctttttttctttgcttttgataagcatgaaagctgactttttctagtggaagttgtacttgcatttctttttatcgaaaaggcatccatgttgctcattctgaagatatatgctactttgtgagtgcatgaatgataaattaatttatactagaaacttaagctgcaatcaggttgtttctgtagctgaaatcccaaaacgtactattcaaatcccttggcacctgttggatgcattttttggctgattttcatgacgagatacagtttatgaatgatgtataacttatatgttacattttgactgtaaactttcaaggtgatgttgatcaaatggttgatatttttattttcttgattctcctgatgttccttcttgtaatttgtgtctatataattttcatttgccatatacccatgttataattttgacagaaatttcgcatgttccatttagactttgcatcatgttgaaccttcacaatcttaaaccaaatggttaaagtagtgtacctttgttttggagcttggaacggtaaagaagtgagaattatgccatttctgtgtgctgatagaattcttgtgactaactcgttctaagtgctgatacatttctagttgcttcaaataagtagaattagctatataagatgcgaaggttgtttctgttcttaagtaatagtgtgatcatattttatttgacattcacttaaaaatcagaacacggaacatatgatttgaatgaatccatgtttcttgtaggcgtttgatgaggccatatcagaactggacagccttggtgaagaatcctacaaggacagcactttgatcatgcagctcctgcgtgacaacttgactctgtggacttcagatgccaatgtgagtttcctgagccatt

SEQ ID NO: 38399 - DNA, 5772 bp, Oryza sativa
ctgcactgttagaatgctgttatattaaccatgtttgacaagacattttcagtatgtttgtatgaccgtcttggaagtgtttggttgaacctgtctcagggtctttggtccaagacattattcacctggcttgcttaactcgttttagagaacaaaaaaatattgtctgtatggtgacatgcttgagttcaccgtaatctcatgacattgctgcttctgttaatttgaccagtgggctatctgccagcttgtttcgatggtgacaagcctggaattgtttgtagcaaaatctttcctactctttctgaattctggtggtgatcccagttctgggctgtctgccagctttctgatgaacggatgaacaggttgacacgtttcgtgaactttatatataatatttttaaatactgttttaaatctgattatcaactttataaattatagtagttaattctttcgattttgtccctaacaacatttacaaatcgttaagcccttgaacaccaaagagcatcatgacccggaggaaagctcggggcgcgttgtgcaccgaatcaccgattctctcttctttttcttctttcagagacttgagataacatgatctgattttctcctcttttcttcttgctcagagagaatcacaggatctgatgaagctggacgtcggtggggtgtggtcaaaaaaagatgtccctctccattgaaagcagcacacatatgcagccttctgtttagcagtagaatctgatgcccacaatctgggggcggcacctcgctcgccgcacgctggtgtccgtgattcgctgcatttgaatcggagaccgagatagcaaacgccgcaaatatataatctgcacatcggatacctcatacctctgccttctcctttggtacctgcttttcgggccgcctcgacaagcgcccagagatgctggtatagatgtttaattactacaggtagcagcacagagtgtacacaaaccttaagatttataagaacaagattaccacacgtgtggcatatctccaagcaggttttgtcctacaaaagtcctcgctaacttgtacttgaagagagattatttttatctataaccgtccaagaatatgtgtgctttggaacaatggaacatgtactaatgggtagtacatgcattgacacaaattgcatcagaacatatggagcagagatatgcgcaaactgaagaaaacaaaaaaaaaaactagaacaaacctttatttcataacttttttttcagatctttttcctaacttctaaggatgaaaactaccagtaatcctctttttgtttcttttttactactattacatagggttgtgacaacaacagatatcagtaataatcataggatctaaataaataagaacaagcaatggagttgggaatcactcatcttcgtcgggcctgctcgcgaggcacagctcatggagctcattgagaatccactcctccccagtgtggccacccaggacaagaaccctggtgccgccaaccacgcatgtgctatgaccccaggcgaacttgggtggctggccagggacgttcaaaatcctccatgtcggcttctcctccgctgggtcgaggaggaacagctgtgagggcgagtgcagcccagcgatggagccaccgaatatgattatccgtccacaggggaggctgaccgcgacatgatcgagcctcggaggtggaccgatgctcgggaacccggttgtcgccagttgcctccattgtgggctgtcttcaccagcgtccatagtgtaggcatcacaggagcgtagccggagagagccgctctttgccaacccaccaaacatgaagagtttggtcttaccaaagacggacaaggtgtggccgaggcgggatggtggtgaccaggatgttgggatctccttccatgctggtttttccttggtgaggtcaagcaggaatgtgtcactgaggagcacaccggattcagtgcacccccctgagacaacaagctttgatccatccagggtacatgaactgtgccatgacctcggcaatggtgggccctcgcttgcaacctccctccaggtgggctgcttggcatcaaggtcaaggacaaagacatcattgagcaaaccttgctgtccacagcctccaaagaccactagccatgagccattcagccatgagagagtgtgcccccaccggccgggtggagaagctgaaactttgacacggcgccattcaggctttgcagattccaggttgagcacaaaggtatcatccattggctgcatgttgactccttcacctccaaacaggacaaggcgattaccaacagcacaggcactgaagttgcaacgggaaggctcaacacgacctccaactgtaaacttcctccatgaagctgcctcaagggttgtaagctctcttgcaagacgaccccatcctaacatcttggtgctcatctcaagcctcacagtgacgtctcttccccacgcgttttgacataccatctttctcaggtgatcattcttggtcaactcatgcattctagtgcagactgatccgatggatgcaacatctcttggcgataagcgagacaatatgttgtgcgccagaacttcatctgagagctggaggatgcagcagtactcggaactttgaatcttaggaatatgttcatgagaagcagggttgatctcttgaatgttgggtctgtggttggactgttgtttatacactggatatgatacattgctaagatcaatgttagcttcagagaacaactggattccaatgacgtgagtcacaaaaccatcatccccatgcattggaatgagccttagcctgttgtacagtggagcaccgtccttccgaaaattcaatagctcaccttggaactcaattccctcattcaagcatcgccggatctctgaaacaaccatgggatcaacaagcggatgtcgtctttgggcacgtggatcccggaattgtaagaatcggctgaaacaagtttgagtcaacagagtaatgtgagaagcttctctaggccctctgtcaagttatgtcactgttagcttgatgcaaatatgatacagttgaacaactcgtataaatgaaaaatgatagtagaataacagcaattcaagcatagagaacatgcatttgtctattagctttgtcgcagacaacgaagaagaatgtggctttttgtttggtttcaaatgtattctgttaacctagtgctaattgctaacattgctaaacattaggcagaaactagtccagctattttttttatgctttgttggactttagtcgaaatgcaaaaaaaaaaaaaaaaccctacattgaatacttaattatgttagccaatgcctagagcttatgctgattgctgaatgtccaaactactccctccatcccaaaatgtttgacgccgttgacttttttaaaaatgtttgaccgttcgtcttattcaaaaaatttaagtaattattaattcttttcctatcatttgatttattgttaaatatacttttatgtatacatatagttttacacatttcacaaaagtttttgaataagacgaacggtcaaacatgtttaaaaaagtcaaccgtgtcaaacatttagggaaggagggagtacttatgatggaacacaggtttaactaaactcatccaatgaatcttttggaaataaaattaatatgtttggaattgtttgtgatggcatgatatgtcaaaatgtaatataagagacaagttcttgcatcatgtaagcaattcaataaattgtttttcaagaattttcataatctgacaaaagagaggctaattgtgcagactgcacacaagaatatttaccattcgacgtggacgattagagcaaatcaccacaaaatggtaaaacgacatttacggaatgagtccctaaaagactttccccttctttcccaactcacatctctcgttttctgcgcgcacgcttttcaaactgctaaacggtgtgttctttgcaaaattttcctataggaaagttgctttaaaaaaaatcatattaatccattttttaattttttttaggctagtacttaactaatctcgctctaatcgcttacattgttttccgtgtcaggaggtaaaccttgcctcctgaagacagccttaagcagtacagcacgaaaatcaagttcaaacatttacaacccaagtcaaatttctcaaagtttatcttcatattacatccagaacttccatttatgctcaaaattgagttccgaattctgaaactgaccataatcagctacttgtcaactgaaaacccttgcaggtgtagtactgtagtacacttataaggttgtcaccaataatagctttccatattgttaatacggatcaaatttcacagttggtgtccaaattcaatgttaatttgtcatgtgaatacattcatagttaattattttccagtaccatccaagagaggaggaaaaagtcttactaatccagtataatatatcctcctagagcactagcaggcgaccactaaatatgatatatgccaatggaagactaaagttactaagtattaattggtagcccggtggtaaaaaataaaaaggcctggctaaaaccgtgatgctccctgttgtaaatttttgtacccacatgctacagacaactgtgctatattccaattaatggcctacccatctcattttatattcacaatatatgctacagtttattcttccatcatccctttttctatgtgcaagtggctactttagtagagcaagagaagagaagatatatcaggggaaaatatctaacgggtagccatcacccttgcttgcccagcctcttcccaccagaaaacaaaaatgacccagagccagaaagaatatatgaacatttcgttgttcgcctctaaggtccaatgcaaatatgcgatatagaacttccatacacaaaatttgtttcaaaagccatttcataaatttagcaataacatgaatatatccaaactagatcgcgtaagcacctttcaggcttttactgtacttgaacaacattatctacaatttacttcgattgttggcttgctcgtgctgtgcttaatgtgtagattaaaaatcaacaatgtcaccattactcagagattggctataaaatacagatggtctaacagaaacagtacacttcaaattctggctaaatctcatactggcatgatacccatctataaatttcaaaaaaaaaaaaaacaaccaatcaaaagtgaggataaaatgctaaaatttacagcaactagtcaggaatcacgcatcatcgccgcaattgcaagcattaaggcagagacagagtggtgcgcactctgcaccgtacgcctgtacaggaaccccctaattctaacaaatgcgcattaaaatctcaaggtttgactgcacggcaaaagctcattaaattcaacaacacagccatccacaaccaccatcaatctcgccaacatatcgagctggaatcgaatcgagagcaccaaaaaaaaaaaacaagcagcatttcgccatccccatccaaccacaccagatcagagcagagcggcatcgatcggggaacagctaagagcagggcgcgcacgagggctcaccagttgcggccgaggacctcgtcggcgcggtaccccgtggcggcctcgaaggcggcgttgacgtaaatgaccgggaaatccacctccaccgcgtccgacaccacgatcgccgccgccct

SEQ ID NO: 38400 - DNA, 5710 bp, Oryza sativa
ggagggggaagcatccaacggcgcaccttgttttgctttttccactcgtgagagaggtggagacgtggagtggaagggagagtatcttcagattgtcagcttcactagcgtaattattttttttgttctttccctctccacctctctcttttttttataggaaaagaccagatattaggggtgtaaaaatctaagagcaagtttaggctctgatcggaagcgagggttgggaacgaagcagcgttttagtgcgtgattaattaagttttagctattttttttaaaaaaatagattaatatgatttttaagcaacttttgtataaaaactttctacaaaaaaatacaccgtttagcagtttgaaaagcgtgcgggtggaaaacgaggaggagttgggaacttatactaccgaacggagcctaaaagtagagcaaaccactatctataaattaatctaagagttaacatatatataatatattaggctcccatcggatggcctaattagtcaagaaaaagtcaaaatttaaatttttaaatttaattttgagatattttcaatgtagtttctttttcagcattggcttttaagtcagaaaaaacatatatataaaaattttgtctacagatttatttttattctctaataaactgttttggcttattagtggaaaagccaaacgatgacgggaccgttagttaccaggttgtatcttatgttcttctcctctctatatgtaattaatttatttgtttacgagaatgtgtatagttatctcttgcataagagctgggactcatcgtttcccttgttctctctcctttacataagtatatagttggtttatagtctactattgaacttgctctagagggattagtgaaaatttggtttcttcttgtactagagtactgcatagagcatttaattacccctcaaaaaaatagtagaatctaataattgcgtacgctaaataaaagacttagggtttgtttgggaagctcgaaattctgggaagcaatttcgaagcaaatggtggataactaatagttagaattaaaaaatagatttattagcttatgatttaatatctacaaatttttagaatctaagtgaaaatttgaacggtttaagccaaagattccagaagtagctagcggttatatgccacttgattgaatctcaattatgttttttacacatgcagagaaaatgtgataaaagaagtattctcattgacgtttattggacacgactaattcagcatcgaaaatacaacacaatacctaaatattaagtttataacatgcacacttattttcgtagtttgattcatcgaatataagtttattgtgtggatgtttcttttaagatggaacattttgatcctgattccatgcagatacatctgtacgcattccagccagaactaatgcagaatatctcagccatccaatctgaaagctactcatccaaactttggaaaatatcatgtaccaatagcgctagtcttgtcagcaaccaaaatatcctctctctcttttttcccaattagatttccaagtctacatcggagtcactgttgggagaaatcatttatatatcattcattctgtggcgtccacttgtgcacctaaacgcctaacgagaggtcagccaaaccccagatcttatgtacatgtggatggctaccttaaattttaattaaaaagtttttttttgttgttgtcgttgtgatcactatatatcgcgtaaagttattaaaggtaatacagtgtattataattagactgtaatgttgtttgtcaattgagtaatataaatatcaagcatcatataaaaatgcttaacatacaagttaggtgcagagtcttgtcataatctgataataaggaaaataagtaacatgaacaaaattaattaataagtcaatgtcgtaagcaattcaaaatattaaaaaaccttagcaaacatgataaacctatatgctatatcacacgtcatgaatataaatctaatatcttcctagtacaatgtgatttgtctctcggtaacaactaatctaataagaatgtattctacgtcactttcatagtcttttattgtcctttattgtagtcttgtagaatagtagtagctcatagcaaaacatggtatctccatatcaacatagcttgtcacctgctcaaatcaaaatttattcacaattttctcccttttgctaggttatgcacctagttaattatcccaaagctaggtataagatttcattctttgctagattgggcctgttcggccgtctgttctgcggctgcttgataaaacaacttttccggcaatgtaacagatattaacacaacatttggctggttaccacttccaactatatcgaagtttcacgccgcggcaaatcttatagtaagaaaaatagcaaaaaaaacacatgttagacatcacacggaaccaaaatgtatccatagtaattcctaacaatttcttcacgtagcttttgaaaagcatcacataaagtatcaattatcaaaaactattcctattatcatgtaccatcaacctgccaacctttgctaataaaaggcatctcacgtggctgcagctgtctgctgcccaacaccaaacccctgaaacgcaaaaaaaaaaaagaaaaaaaaagaaaaaaaaagaaaaagagaaggacgagtgaccagaaccttccaaaggccagtgggtactggttaggcagcaaaatatccaggatggcaggggtccgtaaataagacgcctaacccaggggcaaatcagtccacgcgctgtgacggggaacaataatatcgtgcgccgctgccgtcctcctccacgcgcacacgcgctgttcagttgcgggcttgcggcgcgcgagaaaagatctgcggcgtcgccacgtcatcactcgcgctcgccgttcgccgatcaggcccctttggtagaaaaaccggagaacttttaagggcattcacagtgggaggacgtggcattcagcctcgctcccagaaaacgaatattcgacgacacgtcctcaatccgcgcaacaacctcaggtccgcggagccaatttgagctacgcgttcctcgtcaagtttgcaggcgccagggcccatactcctgctcggcgctatcatggagagggaggagagagaccacacttgaccatctatgcgctccacgccgccgagaggccgacgccgtcggacccgcatgggaggagggctgcgcgacgctcgtcaggtcgatggggaaagcgatggggctggagattttcgccggcttcctccacccaacgctgtcggagagaggaggcgccggagaagggagaggcgagagccaccgacgcggggagagaaccagccgtcacggggcaggtcgatccgcgccgcccgccgtcccccgcttccgcgccgaccgccgagctcgcactccctcgctcccgccgccagaggccgtcgccgtcgggcagcaccgccgccctgtcgcttgctgccgtcggtgctcgtggcgcgccccctgcccagctccgtcggcgtttgtggcgccctgccgcccgccgccatcgccgtcgggccgccccgccgctcgaaggagagggtggatctggccgtcccatggtcatcgccgcccgtctgccgctcctacaccgctgacgccggcgccgcttggggggagctcgaaggaggcggatctggccgccctaccgccgtcgccgcccgtccgccgctcccgcaccgccgacctcgccgatgctgcgctggcgagcgccggcaccccgccgctgctccgccggagatttcgccgctcggcccagcgccatcgccatctccggcgatttctctgcgttggggaaaggaaaagaggagggagaggaaaggaaagaaaatgctaaagtgataaagtaggtactagtgagacccattacaaggtaacttgcactgtggtgagaagcttatgaggttctttgtctacgtggcacacgagaaacagaataaaattgggacgcattgtgaatgccctaaggatttagatcgcataagaataaaaaagaatatatgagattatttggatcgaaggattagatccctttgattctttgaaattactccattcaaacggttttcctactatttttcgttcattaggattcagacattcttttttttttacatgaaagagagagctttattaatgattaaaacaggggttacattccttggtttagcaggtctaggattcttgcgttttaacaggggttaccctaaaccctacaactttactatttttatgttttaagaatcatatgttacaaagaaccctcgataactttactgtatgcgttttcctgcggcattgagaattgtcgttaaattatgaaaaagaaaaagtactcaaaccccaaaaacttgcctatcttgattccagagactcaaaactctgagaaggttgcattgaaaatcaaaacaacaatatttagcctccaaatttatttgacaagaacttgcgcaacaatgggtgggtgcctgaaagcacattgaaaaaagtagccaaacatagtcagcaaagaaagaagcaagatacgatacatatacacactgatttttgttactaacgcaaaaaaaaaaggtgcaaagcaaaacaaccagtggtcttaggtgtatgaattttggtgtccacaaatattacgcatatacaaactctcaatataattttagtgagattagagatttacagttggtttttatctcttatagcatgttttatgggacatgtttatgagtatgatattatgtataggtgtgggtctactgtgtaattaaaaaaaaatgaaaaagcgcacagaccagtcggttgatcactcgatctcgcgtcttggaaattggaaaacaatggcctcaggtttgaggcttgtgacgtggcgttgttaaataaacttttgtcagcttcatgtagtgggcttaaaacccaaccaactggtcgacagaacaaggccacacgaaaaaggaataagttcactccaagtccctcaaattgtcgtaaagtgtaaaatttcatatgatgcgtccctcaacttctaaaaccacttctaaaccagtataaataaggtcccaaaatgatttggatgatggtttaagctaacgtaacatctacgtggtacttatattcaaggaaaaactgtgggacccaaatgtaagtcggtatcaagttaaaaataaaaaatatgtagtgggtcccaccttccttctttccttctcttttttgcttctcctccttctaggcatccggcggccagccgctaggccggtgtccgacgagccacggggtgggggaggggaggggacctcggtccgacgggagccgccactgccgggacctcggctgcgtagcagctgctgccgatggaggcggacaactggcagtagacacggcggtggatgcggaagggatgctcttgtgcgggcatcgctgtgctgcgaggaccgcccggatgagaggacatcgcccgagcgctcgccgcgctctggcttcgcgcgcgtctggccgagatcaccatgctcgatcggccgtcgcatccggagcatgatcctcatcaccgccgacaagcagtagcacgaagacaacgtccaagccatcttcttcatgggatgcatcgggcatcgccgccgtctgcaaaagcatctacaagatg

SEQ ID NO: 38401 - DNA, 3904 bp, Oryza sativa
agtaattattaatttttttcctatcatttgatttattgttaaatatacttttatgtatgcatataattttacatatttcactaaagtttttgaataagacgaacggtcaaacatgttttaaaaaataacggtgtcaaacatttaaggaaggagggagtattttgttacagagattagtctcgtactacgtactgcccccctctatctctctcaggtccgaattctacatgtcgatgccataattaaggccctgtttctttcagcttgggattattataattcagattattgagtcagattactataaactagattgttataatctgtattagaataagtggttagttgtttcttttctagattattagagcctagattattgggtttgcatgtctaaaaaaggagtggggtggcatggtgggtaatttttcatccaataatctggaaaaagcttacctaaatgagcttatcagattataatatgttggactccagattataataaactaattataataatcccaagctgaaagaaacaaggcctaaggcatggttgttatcataatcctactatcatggcattgcggtagtttgtcactttgtctgagttaacacgatggaattttctgtaggaaacgaaggtattttgcacgagaattacagcactgaccaatcatgcatccagcgaagaagatggcatggacgaggcctggacgtcgtcgtacgttgcgctgctgctcgtcggcgatgatgaggagcacgctccaggcgtggccaaagagcgtggtgatctcggcccggcgcgcgtggagctgaagcgcagcaaatgtccgggcgatgtccgggcggtcctcgcaggacagcgacgcccgcacccggcaccactgcgtccactgccagctagtccgtctccgtcgacggtagctactgcgccgcaggaatttcggaaatttcggtcccctccgatatgatattacttctgtcaaaatttttcaatttttcaatcttttcataaatttggtaatatttgttcaaattcaactaaattttgttcaaaattttagaccgaaattttcgaaatttcgggatttcggtgacctccgatcaaaagccctaaatcgatatagtgaaccctgctgcgccgccgaggtccctagcatcagcggccaaggtcccggcagcggcgtctcccgtcggaccaaggtcccctcctctccaccaccccatggctcattggcacggagaaggacgctagcctggcggcggccggccgctggatgccgggaaagagaagaagcagcaaagagaaagaaaaagagaaggaaagaatgtgggacccactgcgtattttttattttaatcggatactcactgacatatggttttcatggtttttctttaggacatttaacttttagccacttttaagatgtggcaattaattatttgccacttgctgcctatgatatatgggctctcatgtgtctatgacgtgtgggtccaatggtaaatcatttagcaccactcgtaagaatgaaaaataattaattattcctttttcgggactttaagtgctatgtcaatgtcacgtaggcgccacgtcagccgaaactactgcccaaaccgtcttgggaccttatttgcgctggttttagaagttgagagatatatcatatctggtattgtggttcagggacgaatttcagattggacgacaaattgagggatctaaagtaaacatattccttgttcttctccatagaataagtctacttatcctccctcatctctttgtgctatgtcatatatggctggagtaaatctattttgcttccctgttctctttgagccgtgccttatatagccgattcaagtctattttgggtccctcaactattttcctttgatcatggcgtgcgaggccgactcaccgtgccaaggcattggcctagcacgacccaactatcgggctaggccggcacgtgcccgaaaccagtcgtactgtgccaagcatgggtcgggtcgtcgggcctcgggccttatggccatatgtactaaagataatagaagacattctaatttggagttggacctgatcgagaaaaaaaaagtacgctatctgaaagatattatgagcttatgtggcattgaaatctcacttcaaaacactagaatacacagcattgcattaaaattttctagattttcagtggtagtacgtcacctttgcggtgatgctctgcagccacttgacagatagatagacccaactcaaaaagagtccaaagtgaactaatagctagccaacatatgaatggatattgtaagccttgtttagattccaaaaaaatttagccaaaaatattatatcaaatatttagacacatgtatggggcattaaatattgaaagaaaaaccaattatacagtttgcatgtaaattgcgagacgaatcttttgagactaattacgctatgatttgacaatgtgatactacattaaatatttgctaataatggattaattagacttaataaatttgtctcacagtttacagacggaatctgtaatttgttttgttattagtctatatttaatactttaaatatgtatatgtttacttcaaaaattttacacccaaataactataaacacacctaggcagttcaatttcctgccatgctacactagctagtttgaccagtgactctgggaaacaatttttcggaaatccgtcaggtcgaaggattatcctctagtggacggagacttcgcagagtggactcgaccagaggacggaaaaatcgtacaaatcacaaatttcctcgatttttctgacttctgaggctgagctcagatcgtgcaaccgctgagcactcgtacgtgttgtttgacaccgtcacgtcactattgctggccatccgcaaccaccccactcgcatgtacagttgcgctataggagtagtactttgacgtgttgcggtgtccccggtgaagaaccaaacatctctcatgaagtgctagctcacctctgcacacgttcgtacgtacgctagctccggccatctcaaacacttctgctgtgttcttttttcagcgtgttctcgaaacacctctcgtttttcacgtgcacgcttttaaactgataaacgatacctttttttttgcaaaaatataaaagttactttaaaaaatcatattaatctatttttttaaaaaaacttaattaatcataagaaaatacgtcactccgttttacgtgcacggaggtgagttttcctttttcatatacacacttttcaaacttctaaatgatatgtttttgaaaaaaaatatacgaaagttactttaaaaaatcatattaatcatttttataaaagtaaatacttaattaatcataagtaaatacttcgttttacgtgcgcgtgaggtgagttcccaacctcacctctcaaacacaacgtggctatctatagcctatagctattgttatcatggtgccatcattctcctccgcggctatcctcctcttgttcttcctcgcgtcgttcgcatcagccactaacttcacctacatcgggccggccacgtgccaatccgccatcctctgcacacccccccccccgccgccaccgcctacatcgagcccctcaccagcttcgagaacaccaccctccacgacctcttcggatgaggctcctctaacttaaagttagaggagccccatccgaagaggtcgtggagggtggtgttctcgaagctggtgaggggctcgatgtaggcggtggcggcgggggggggggtgtgcagaggatggcggattggcacgtggccggcccgatgtaggtgaagttagtggctgatgcgaacgacgcgaggagaacaagaggaggatagccgcggag

SEQ ID NO: 38402 - DNA, 1284 bp, Oryza sativa
  unsure (1)..(1284): unsure at all n locations
cggtgatggccgtgtgggacggggagctcaacggaaggccgttggcatcgaagaggtcgggaaggngctcctctaactttaagttagaggagctccttcccgacctcttcgatgccaacggccttccgttgagcaccccgtcccacacggccatcaccgacaccgtcatcgtcaccatcctgttccactgctcctacgtcaccggtgccaaccggctagagagccagcccttacacatcattcaaccaaatgacaacatgacttctatcaccgtgcagtttgataacttggtgacctaccaggagatcgccgccgtgagcaacatctccaaccctgacctcgtgaaaatcgggcaggagctatggatcccgttgtgccggttttccagccggcaccaatttgtcattggtgttgtgctaaaaaaaaagagaagccgtctccaagtcgagccgatgctttcgagccaacccattcaacccattccgtggtcaacaacaatcacaaatcaacgtagaccaatcacaggtcaacaacaacaatccatcatacatccatcaggaataaacaatccatcaagaactacacgagtaggaacaatccgtgcacgaacttatcggtgatgtcgccgccggaaacccttggccgcccgccgctgcctcccttggccaccgccgccaactcaccccgaccggatttgcgcgccaccggttggaggccgacggagagggagaggaaaaggtcgcccgtgcggaggccacctgccgcctccattggccaaagccaccgcacgtcgccgccaacccaccaccccgaccaccccctccctagatctggccgacagagagggagaggaagaggggaccggatctacggaggtggcgccggagggcgatggctgcgcagggagggcttaatgtatgcacaagtcttcacgcaatcaaatttggtatttgttattgggatgcttggtatatttctatctaatctaggtatggaccactagaaagtaattatgaaagtattacgttatttgcaaggaactaagcattacatgctcacatatataaaaggtcagataaacttgaggtcgtaggttattcagacgctgactttgcagggtgcttagacactaagaaatccactttgggttatattttcactctcgtggagggagttatttcatggaaaagctcaaaaccgatgctcattgcatcgtcaacaatgcaaacggaatttgtgtcatgcaatcatgcaacagggcaagctgtatggcttaagaatggc

SEQ ID NO: 38403 - DNA, 907 bp, Oryza sativa
aaaagttgttggcccgggtggccgttgaaaagctgttggccgggtgccaaccttgtttcaattctaaagactgatgcattgcacatactccgaccggacgagatgcactgtctcatccgtgtcgtttgagaagcactcacttagtcgtttttagaaaagagttcaaataaaatcaattgcaaaaacaacagcctttccttgaagcctgcattaaacacttatttcccatggcttgctgagtactcccgtactcacccttgctctatataaataatccccccccagttgctgaagaagataaagcggatcctgctgatgaggagttcttccaggagcaagccggctacgatgagttttagggtttcggcctagttcccaagtcgcgcctgtgttgtttggtccaagtcttggcttccgcttcccttttgtaatgcagttgtgagctcgggatctgtccgcagcccaacatgactgtacctctactctataataaagagacctctgttgctgtgataatccgtcttcctgtgataccagcactgtttcctgggactggtatcgattaacaggttaatttggagcgtcacgggctagttccggtcggtactagttcgggacgtgacaataaacatactaattctagtctagaaaattaaaaaaataagcaaactaaaaattaagttgtacttaggtagtttctatattgtataagtttagtatatagctcgtgcaagattaggtgactgatgatggataagatacaaaactaggcaactgataaatagaaaagttattttgagtttgtgttgtaatagcatccacaatgtatgttttacagggattaagagttttttttttcctttcaactagcactgtacactgtgcattggtcttcaggtctccactg

SEQ ID NO: 38404 - DNA, 705 bp, Oryza sativa
aacattccacagatcgagggtgaagaacctcacttagcgcccccggccgaaccggcaaagggggacctgcgcggtctcccggtgaggagccccacgctccgtcatctggcgcgccagttagggggcgcttgtgtctttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtactccaccgtcctcctctcgccgaaatcttgggcgggaggaggcgctcgaggaggtcgaaagatccgcgacttcgccgcccgcgggcgatggagaaggacggcgagacggggagcgtcgcctcctcgtctacggcgatggcagcacgccccagggcgcgctccaggctgcgggcgcgctcctgcgtcacccgcccgtcgtccccgatccagagactccagcccgacgttggctggatgacgtggccgacttggtcatgacggcgcagcagcgcctaggcaccggcgggcggtcctccgccaccaaggctctggcgctgctaccgccggctccgcgtcgtcgaggcggagggcgcggcgagcggcggccgttacccgccgttcgtccgccattccctcgtcaacgcctccgacccaagaagatgtgcgtggggg

SEQ ID NO: 38405 - DNA, 1703 bp, Oryza sativa
ggatttttgatctaaaggaaaaggatttatttaaatcctttttgagaaaagaaaagaaaataaagagggaggggaattagacttccctcgggcggctagggcgcggcccgagagaaaggggcggctcggccgaacttaacgggtcggccggccagagaaggcggcccaaggcgcgcgcgcgggcggggaggagagagggagctggtgggccgggtccatctcgcgtggtcccgagtgggacctgcttttcggtggctcggctcaccgtgcggagggagcacgctgcgtgcgctagggttcggggaaagagacgcggtgcacgcgcgcggttcgcagaggacgcggatacggctggcccacgcgcagcctcacggctcgcggtggaccgcgcgcgtgagcggggccggagggagcggctgaccagggtcggctcgacccggtcgcggccgaggtggcaccgacgtggtgccttcatggcagccacgcgggccggcgagaggaagacgaaggcgccggccgcgaatagacggcgggcggcggcggtttctccgggatgccgtgcgacgacgaggggcgacggggtgtacaccggaatgacgagggagaacgagagggagcgagccaacggcttggattcgccggagggagttcgtcggcggcagattgcggtggcggcaaccggcggcgagaaaagggggaaacggcgacgaggtcacgaggggctgattcccggcggtgagagcatctacacggctacggtaatgcattcctagcaccggattaggaggaaacacgccgtgggaggccggcgacgagaggtggttaccggactcgggcggcgacggcggcgagcccactgtgagtgatggcagcagtcggggcggcgcaagtttgctacggggaggctacacatgccactaaccgagtctaaggggaggagatggatcgaggagggagaacggggagatgcactaccgtgcgggacggggcgcagtgacgatgggccgacggcacgggagtgatctcttcggcctcaggccgaggaagcggaggaagacgatgtgcccgaagtccccttcacgcgtcctttgcacgcaccggctctcccgatgcttggcgatgaacggcggaggcgagacagaggggcggcaatggtgtggtggtggcgagcgaaacgggaggaggaatcgatgggagggcgccttggttaaataggaggcgatgtcgatttgggaaccgacctagggcggtcaagggagcgagctagcgctcggcggtcgcggccaaaacggcgacagggggggtgacgccggcggaagagaaaagggaaaaggaggagagaaaggggggcttgcccgttgccactttgggaaaaggaggagggagagagggcgacgcggcagagggaggaggagctctgcctccatcccttggaagctagcgtgcggagtggcggggccaggtcgtgacgacggcgatgacggcgggggcggtgtggagcggaacagcgacacgggcggcaggcgcgggcaggcgtggcagatgctgacggcggcggcgaccaggcggtcggccaccacggcgagcgcgcgcgggaagcaacggcgcgcggcgatttgagcggcgcggctcgggcacgcgtgctggctcgcggggtcgagcggctgcgctgctacaggcgtggcagggcagcggggccgggc

SEQ ID NO: 38406 - DNA, 14677 bp, Oryza sativa
aaatagacttttgcggaggaattcgatttgggaaggaattggattcgggatttgaattcgacgatggatcggggattcgagatccggaatggcacagagactgactgcaagcgaagaaacaattttcgcaattagggtttttagaatttaaattttcccgctaggcgccacgacggaacgggcgctacacaacgtcttagcggcggaggaggagcgaggtagcggtggtgctcgaggcccctcactccacttgcggcagcaactgaggagaggagaacggggagacgtcgcccaaagcaggaggcgcaccggcggcgagggacgatagtgctacgtggcagcgggaggaggaaaactcgttgccgaggtcattgcatgtgcccacgtccatggccaccgccttgtctgctgtgcgcgggggctggcccttccccggtgtagtctcactcaccggcagctgtcacgcacccctccgcaacaccgacgtccacgccatttccaccgtccgctgcccgcgtccatggccgccgccttgtccgccgcgcgccaggaggcggtggccccttcctcggggcagcctagcttgtcggcggctgctgcccgtacctccgcaacaccgactttcgcgccgtttccacaacgacatcaatgccgctatcttcccctacttcgcgcggtggcgccaagcgtttggcaagagaggaatagaggtggtaactagtgaggagaggggaagtagtcattgacgcgtgaacatgctgactcagctgccacatcaactaaaaccagagacaataccaccgaaaatgctgcacgccgggcgcctgagcgtccgaacaaaaaatcggacactcggaccacatactaagtattttaaatagctttaaaatgatttttctcctaaattaattatccaatctatgatccgatcacgccgttgtattcgttgcaattaaatctttataacaagaccacacatgattatatttcgacaaaaaaatattttagcttttttattgatatttttttagaatgctgcatatggttcttttgatgtttcaatcaatagttttacgatgttttagctagtgtactcactatgtacggatcaaatgttgcagtggattttgatattatggaacgcgtcattgcaacaaatcacccatatattttgaaaactctctattaagggaatttgttttctttttttggttccacaaaaaatgtttcacctagtgtactcacaatgtttcactatatatagatctaatgttgcagtgaactaaaacattccattgcaacaaaaaaaagcccacatattttagaaaccccatattaaggaaattcgttttattttttgttccaccaaaaaatgtttcacctagtgtcctcacaatgtttcactatgtatagatcaaatgttgtagtgaactgaaatattctttcgctatttgctgaaacattatttttatataatgtgaaacaacacccgatttaaacgagtaaaacattttcgctctacttagttaaacaattccgatatacctggtggaacatcgtgttacatttaaaaataattcaataataagctaatttttttttcgtcggaatatatccatgtgtagtcttgttttgaagatttaatttcaacgaatttaatggtgcaatcggatcatgatttggataagtaatttaagagaaaaattagttttaaagtagttttgtacgtaaatcgggcgctgacatcagcgcccgatttccctagcccggatcgggcgactgatccgtaggcgcgtcccaatgccaccgagggattagtttgcactgattttataagttgagagatatattgtatgtggtttttcggttgagggatgattttgtaattcggtaacaagatgagggatcttcggtgtacttttccgaacaaaattgaccatgcttatgggcagcgggccatgtccaggcccagttctttccggaaaggtggggagagcccatgtaacgttccccataatctcatccgcgacgcggcccgtatgcccaaaaggcccaagaaacagagttttggtgtgggaaaaagtacaccgaaggtccctcaacttgttagcgagatacaaaatcgtcccctaactgtaaaaccggacatccggtgtccctcaatttacaaaaccggtcacaatagatctctcggcggttttgaccccgatttggtcccacgtggcgcctgactcaacgtgggacccatgtgggccccacatgtcagatagaccacgtcaccaccctttctctttttcccctgttctctcccttcctctctcctttttcctcaaggcatggatggcggcagcatcttcgacgcggcgtggaggagggccgacgtggccggcagctgacggggaaggtgcggtgtggagaggagggccgatgggacgggcggagccgccgatggctgccgtcgcgcggggaggagagcggtggtcgtcgtcagggtgaggcggcgatgcatggtggcgcgggcggcgtggcggaggggagggccggcggctagcgaagaaggagcatgacggagaggaggtccgagggccgatgcagcggtagcagcttcatcggcgcggcgaacaagagggtcgacgcagccgacggcggagaggagatctagctgtcgccgtagccgctgatggagatggcgaggcggccaccagcagctccggcgggcggtgggggttctcccactgccagtagccggtccggggcttcactcgatccactaccagctgcatgcacaaagctaaccacatgcatgctccactcgatccaaccgacttgctccaactagctcatgcacacatgcacgtactagcatagcacaaagccttggctaactaactaactaattaatcatgcatgctgttagagtgcgcagcccggcccatcaaccgtgggccacccaagtcacattgggcctgctccaccacaggcccaatcggagccacaactttaggtcctgggcctacacaacccaaaagactagtctattgggtgaggatcgcccccaccttttaagtcgtgctcccccatcatcaattactgatgtgggactaaacccaacaatctcccccgtcacacatcgggcccaacaatctcccccgtcacattaaccccatgtgatcccgaagacttgttacctggcctctctaccatgtgacccatgggaattgtttcgggttccaaaccttgggctctgataccacttgttagagtgcgcagcccggcctatcaaccgtgggccacccaggtcacattgggcctgctccaccacaggcccaatcggagtcacgactttaggtcctgggcctacacaacccaaaaaactagtctattgggtaaggaccgcccccaccttttaagtcgtgctcccccatcatcaattaccgatgtgggactaaacccaacacatgcagcgttggcgatgccgtcgtgcgtgacggtcagcctgatggcgtcgtcgttcttggcgaggcagcacgcgaatgccaccgactcccggtcgttggggccgccgaggaagacggcgacgatctgggtccccaccttctagtcgccttggttcctcgccgccgtcgtctcttcgcttgttgatatcttggtcggcaactggaagctggcgccgcccctccagaacgggcggtcggtgaagatgccgacggtgcacggggcaagctctagcaccttgtggttgagctcgcagcaatggtgctcgcgggcaccccgtcgaacccgggtgcttcggtaagttgtcgacgaaggagacggcgacgagcagcagcaccagccatcggcttcgtcaccggcgacaacctcactgtcccgctccgctgcgcctgcccctagctaccgcaggtcgcagtagtggtggccgcggcactcgatgcgcgtcacggcatgacctgcccaagaggagagaagtgagagagggagagagaggaggaagggagggatgacgtggcatcctgacatgtggggcccacgttgagtcagccaccacgtaagataaaaccggggtcaaaaccatcgaaaaaccaattgtgaccggttttgtaagttgggggacgccggatgtccggttttacggttgagggacgattttgtatctggctaacaagttgagggaccttgcgtgcactttttcctttggtgtgtgccacccccgccacaccgtcacccgtgcatgtgcgtcgcgatcgcagccatgcagaatgcaacgcccccggctatgtaaccccggggccggggctacgtgcctacgtggccgcgtgctcgacgctagccgccgaaccagaaggaagggagggacgaaagggtggtgtggtaagcgctgcatatgccccagcgagctaggcagcgagtgatacggggatcggtcccaagacgagatcatgtcgtcacgagtgagatttgacagggaaagctttggaccagctatagcctgcctgccgtgtctcgtactctcggtacgtacgtcgagtgtgcataccgtgacgaatcacaacttcacaagtactgctgctgatactgaggtatgatgggtatttcggagatgatcgtcgtctcatcgcatctgctccgatgtatgcattgattatcttgtgaatgatcacctgattaattatctgtatgcaaacaaactctctaactaggtgaaacctcgcgcattgctgcgggaatttagtatgttaaaaaaataacgtgcaagatagctagataacatcagattaagtaaattaatgtgatttatgataatttaaacttaaatagtagaatggtgattcaaacgtaaaaagtaaggtggtatgactttatggaagaagaaaagtagggagatagtttggaccgtagattaatcatctaaaggttaaaaacaattgatgtgatacgacttaattagaggaaaaaaggagaaagataatttggaccatagattaatcatttaagcattaactaaatgaggatgaactatataagtatataggatatcataaaatataataaagatatacattgaaatattatgtaaattatgttgtatgataatttaacatgtttgtatttgaaaagctcctaaattataaaaactataaagatatagcatgtttgcatgatatttaaacatgatgattgttagtggatgatgatgtggcatcttgttaattagtggatgatgatgtggcatcttgttaattagtggatgatgatgtggcatcttgttagtggatgatgatgtggcatctttgcatgttaagcttagtgagttagtgggggataactttataataagataggattaacataattatttaaaatcatcgcatgcgggaatattgtatgacatgtcaaataaaatttaagatgtgtttcatttgtatctaaatgactttgacaattatttattttttactataagtaatttgcaccatagagagctttttatggcttgaggaaaaaaaagacataaaaaccttaattatctgctatcgatatagataaggcataaactctcaaatgcttttaagaagactaatcatcaacccatgtgttgcatagatattacacctatattataaatattaaaatttcaaattcatatgctaaatacgctgggcattttttttaatcacatcggttagattataaagaagaggccgcatcagctacaacatggttaattgttaattacaaatttttttattttaaattgtcataaaatttctgaacttcatagttaataaatatcgagatgtaccctgttaggagtcataataatatttttttcatgtttttataaattcaaaagtcaaaattaatcactaccgtatattagagtattgtcaagtgtaaattagttttaagagaaaattgtatcttgggcctgtttttattaccgtagttacaacttggactaggtgtaaaccaaacttttcattttgggccaggtttctctatatgttggttcaatttggaccctcttcttcttcctcaaagactctctctctctctatagctcaaagcacggtagtgtagctcgagcaggagcaacacgcaaagagcaaaagcttggctcatatgtaattgaggttgagcataagtgcatgactcatctcctttcaaattccttcacattactgatcaagcaactcaaccttccaaaagaactcgaaggatagtttgtatttctaattttcaaccagcacattgaattggcgagaagctcaagctcaatgatagtgtcggatgactagagctttaggatgggaatggttagggttgatccatttatccactaaatctattcgtaaatttgtcctaatggatttttagggccgctccaaaaatataaatggatcgaacagatcaaaacattagaacctaggtttaaggggttcaacccaaaatacttcacatgcataaatgtttcaaaaatttgtacaaagttgcttctctatataataattcattcctacaaaattcaactaaatttaacaagttttcatagtgtgaacgcgagtttaaaaattttgggtccgagttttacacacatgtaactagaatttttgggtatcagtaatgcatcgtgggccccacatgtataaagggctcaaaatttacacaaagttgcttctctgtgcaataaattatcccaccgaaattcgactgaattcgataagttgttatagtgtgaacgcgagttaaaaattttgggtccaagttttacatacatgtaataagagttttttttttctactagtaatgtagccgatccatttagatatccatggataacctattgatataatagactcgtgatggattgatcctattaaatcatggatcaacgaactcacttaaaacggtttaggttcaatccatatcctaaccattcccatcctggctcgagctagcatgcctccgcatgcgttgcctgcactcgagctccacctccacgcgtgctgcctacactcagagctcaagctcagctttgatgggcggctgcgctgggatggcttgcacttctcttctgaatgcgctactcctgattgagaagaggtcttgagctgtccgcaacagagaaatggagctggaggaagaatagagctcaaattgaaacattgtgtaaatatacccggtccaaagtgaaaaaggttaatttaccctcggtctaagttgcaacattggtaagaaagatgacccaagatgcaataaaaatatcgagatgtactttcaatagcctgacaatcttctggcacatatgtctaacaatcttcttgtcatgtcagcgatacaggtgcaggttctataaaacaacctacatctatattaggagatatatgtgccagttgtttcctctatgcggtatctaaaatcagacccaccacacccagtggtcaggtgcctgttggtgggacccagtttaatgtagttagtttatatacagaaccggcacatataacttctcaaatgtgccgattctataatttgattgctcacgtggataaaaaagacatatgcttatgacggagcgtggggctcctcaccgagagaccgcgcaggtccccctttgccggttcggccgggggcgctaagtgaggttcttagccctcgatctgtggaataatcgcgagagagcaaatgcacgaaacacgggcgatgtagacaggttcgggccgctgagaagcgtaataccctactcctgtgttctggtggatctgtgtatgaagaagttacaaagagctggggagccagagaattcaggctctagaacccctctattctccttctggatctggatccgggatcccctcctcggtgggcaaggtcctccttttatatctcaaggggataccacatgcaccacttttacctactcttcttttgggtggggacccatcctatcttgaccaaaacttggctcgcgccttcgcctggaagctaaatcatagcttgtccttgagtgagggccagcgccgtcactcgcctgacacaggggatacccctgtcatttcttcattaatgggtggagatttgcaatggatgctgtccgaatgaccctccgatgggatgggccatacctacccccactctgccggaagcagatgtaacgtgggagcacagttgtctgccgatgacgtgaccggcgtcagactagtcacagaccggtcactcttgtccaccacgcgtcagtttagcataccgcacgtctgcccttcttcatgcaatgacttccccgccatggttgcgatgaagcctgtaatgtatctggccgggactgacgtgttaactccaggagttaacacgccggctccggctagggacgagtgcctggaggctctcatcattccgacgggacgggtcgaggcgtgagagaggccgcctgttgccacctaacccgcgatctgaccggtctgtgaccggtcacacactgcgaccggtcacggaccggataagcgagcgcgctgcgctgcattaaatgcggcgtggcgcgctcgtccaacccgcaataaatgcggttaggtgagcgccgctgtgctcacctaacccacacacgtggcgccaacaccacagggggtcggggcgccccagccctcggggccgaaacgggagcggcccgacccctcggggagacagagggaggggtggccacgtcaccctcgggcccgacccccccgagggggttaggccacgtggatgaccgtggctgcccaagcctctaatcacgatactcccggtcccatgtcaccgacagtagtccccggcattatgccagggcgaccgcccccctcgagggaagcgctcgggcgtgacgccactccttaggcctggtgacaggtggggccggtctctacaggcgggcagaaacccagcgatcgcaaatcgcgcgcgtcggcaaggaaaaaacgaccgacaataatgagcggcctctttaagaccgctacattactggagtagcgcacgaatcgggacgagccggttcgtttcgcctggagacatgatgatggcgcttcggcgagcgtagttaacgcgcgcacgatatgtcccatctcgactgccacggccgcacatccgcctcgtgcgccgtaaacgggcgagtgggattagcggaggcgtgggtacgagaaacgagggggcgagatagtgggcgcgggaaacgaggagccgggcatagcgttggcaagggtataaagacgcggaggaagagattcgtttccttcctctcgccattattccccttgccttcgccgcttgcgctctaactcttcgtttcctgtgcccttcccttgccgcactcactcgctctcaagctcctcctccgccggcgtcatggcacggggctccgcaccgctcgaaggtagcgtgctgccgccttcccgcatcgtgagcgagaggcaggccgggctgccgcgccgattcatgccggaatctgttaccggccgggaggtggtcgcgctgggcgagggacgcccggcgccacactacccggggcgatccgtcttcttcctctctttcgcaatggcagggctggtcccgccattctcttctttcttcatggatgttctggagctttacgatctccagatggcgcacctcactcccaacgcggtaatgatgttggccatcttcgcgcacctgtgcgagatgttcatcggggtgcgcccatctctccggctgctccagtggttcttcaccgtacagccggtgtcgccgccgatggtagtcgatggctgctacttccagccgcgggggcaggtgctgcaccgctacattccctgcatccttcgcaagaagtgggacgactggaagagcgattggttctatactcccctcgccgacaaagcgcgcctccgacttccgagccagcccccagcgcaggcctccagctggcgagccccggtagatctgggagacggctacgacgccgttcttgaccgcctggcgggtctgcgatcccaggggctcacgggggccatggtgttcggcgactaccttcgtcgccggatcgtgccgctccagcggcgcgcccggggcgcctgggagtacaccgggtccgaggactacatgaggacccaccaggggagcaaatgggactgggtccctgaagacttcaagatggtggtccaacgggtgctgaatctcagctccgtggaggcatccctcatcccccaaggtatcctccccttctgcagcgattcagagcgcgccaacatcctgaccatcatgcagacggtcggggcgtcgggggagcgggcccctcgaggccacgatggcgcgggcgggagccgcaggggggaacaatctaccccaggagggggtcgtgcttctgggccccgcgacgggggcccggggggcagccgccctgccgacgccagggggaagaggaagcagcagggtaccccttccccatctcctccccgagggggtggggcggcgcgtgctagtcagcaggcgcccggagggtgccgtgccgtcgtcgcagcccgaggggagcgaaagaagaagtggctccgcaagatggggggaccgaaccatgccggggaaacctcatctcccccccaaggtggtcgtttagccgacctcctcgcaggttcatccccgcgcccactgcggccgtattcattctcccatctcccaaggcaagttttcactcacccgtttctttttgtcttctggtttttcttctgcctcagcgagatcccgtcgctcccccttcgccattccaagtccggccggtctgaggccgaggagacagcgaccgcggaggcccggaggcgggaagctgaccggcgagaagccgcggaccgccttcgggaagccgaggaagctgcccaggaggccgtccgggctcgccaggctgaggaaaacgctcgggaggaggccaggctccgccgggctgaggagtccatccgggaggcagaggcggcgcgcgcacgccaggcggcctgccaagcccccgacccgactccgcccgaggcgacgacaacttccgaggccacccacgacgaggctacgggcgcaccgctcgggcccgacccttcgggcgacgctcaggacgagccagcttcggggggcgtccccgagtccggcacgtcgatcggcgggccgagccgtgcggcaacctcaccaaggcggctctcccctatgccttccactgccccactgagcgcggagccccttctgcaggccttggctgccgcgaacaccacggtgttggacgggttaagtgcccagatggaggtcctgcaggcagagcggacggagctcgacgcggcgtgggcacgcgtcgaagaggggcgacgctcggtggaggcaatggtggaggcgggccgcaaggcacaccgccggcacacctcagagctcgaggcccgtcggagggagctggcggagatcgccagggaggtggaggaggagcgggagagtgccctcctcgccgccgccgtgctgaacgaggcgcgggacgacctccgcctccaatacgggagccgggcggcggagctagagaagaagctcgacgccgcccggggagtccttgacgccgccgctgcccgggaacggcgggcggcggagagcgaggcggcatcccggcggcgcgaagaggcccttgaggctcgcgccacggcgctggaggagcgcgcccgcgtgaaggagcgggacctggcggaccgcgaggccgtcgtcgccatccgggaggcaacactggcggcgcacgaggccgcctgcgccgaagaggagtccgcactccgcctccgcgaggacgcgctcaccgagcgggagcgagctctcgaggaggccgaggccacggcgcagcggctggcggacagcctgttccaccgcgaggcagcgcgggaggagcaggcgcgccgtaatctggaaggcgcccgggccgagagggccgcactggatcaggggccgctgagctcgaggcgcgggcgaaggagctggacgcgagggcgcgcagcggcggggcggccgcgggcgacggcgacctagccgcccgcctcgcatctgccgaacacaccatcgccgagctgcagggcgcgctggactcgtccgcttggcgggcgaagtagggcccggcatgcttcgggatgccgtctcccatctagaccgcgccgggcggcaggcgggcctctggggcgggcggactgcgaagtacgctgccaaccaagggggcctcgcccagcgcctctcagagatggccgggaccctccctcggctccccgaggaactcgaggagacgatcaagtcatcctcgagagacctcgccctgggggcagtggagctcgtactggcaagctaccaggccagggaccccgacttctccccgtgggcagcgctggacgagttccctcccggaaccgaggacggcgcgcgcacgcaggttcgggacgccaccgaccacatcgtccacagttttgagggtacgacccctcggctcgcgttcgcccttgactccgacgaggagggcggtgatggtggtgcggacgccagcggcgacgaggccggcgacccgggcgcgtcggaatgagcccctaggccctcgccaatcttatatagctttttctttttcttccgaggccttcgggcccccttcttgtatagactgatttaatctgtaatcaaataaagaggaaatttcggtgtcaattctatttgttgtgtgtatgagacgaggatggcctgtgccgcggtccttctgtgtcttggcttgaataagggctcgtgcctaggtcccagcctcaaacggcgcgggtcggagctagtgcctggggagatccacgtgacgagactggccaggccgggagcgtggtgaccgagggttatggatgacccgattgtgggcctttgccgattcccccccggagttcaccacgccccggggcacggctcggttctgggccccttttggcgattttagccggcccgggccaccgagggcaggatcgagcacgagcgtgctaattcaagccaagattcttcaaaaggaaacagtggcacagacacattccttaggaaaacgaaaatgcttttattgaaatacggaagagaaaaaagataagtattatgcatgtggtagcccccggccaacactgcacgcccgggggggtgcggggttggcccgagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacatcggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcctcgcaatacatggtggcccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccatgcttcttgaggatgttgaaggtcttggttttaaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccgaaccgagcagtgatgcccctgatgaatttaagcgcggagtgcttatcgatcttgatgaccggataagcctcaggccacttagtgaacttgtcgatggcgacatacagatactcgaacccgcccggggcccgcctgaacggacccaggatatcgagcccccagacagcaaacggccacgaaagaggtatggtctgcagggcctgggccggctgatgggtttgcttggcgtggaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggatatcggcaagaagctcgacgccttgttcccgaggaatgcacttcaggaggactccgtttgccgcgcgccgatagagggtcccttccaccagcacgtagcgtttggagatgcgctggacgcgttcactcccttcgcggtcctcgggtagagttttatctgcgaggtacgcctggatctcagcgatccaagcaatcaatctaagggagctgggagcgctcccctcgggtcccgaggcctggactccgacgggcctcgggggccgttcaggcgcgtccgactcccctagggggtcgggtcgcgccgacggctgggcaagcctttcttcaaaggcacccggtggggtctgggctcgcgaggaagcgagccttgagagttcgtcggcgaccgcgttatcctgtctgggcacgtgccgaagctctatcccgtcgaa

SEQ ID NO: 38407 - DNA, 4434 bp, Oryza sativa
catttccagggcgcttttcgtccgagaggccgcgcggggcgcactcggcttctgtggcgacgacctcggggtcggagggcgacaggcgcggccttcccgcagtggccccggggccatcctgggggtcgggggcgcctggcaccatcggacaaacaggcggagggccagctccggccgttgggggcctcgggccgctgttcggctcgggggcctctcctccctgctctctcccgggtctagtcgacacagagtgggggtgcgcggagtgagggttgtcctcatcacgctccacgaccaacgccgcgctgaccacctgcggggttgccgccaggtagagtagcaacggctcatctggcttcggggcgaccaggaccgggggagaactgaggtataccttcaactgagtgagggcccgctcagcctcctccgtccaggtaaacggcccgaagcgtttgaggagcttaaataggggtagcgccttctctcccagcctcgatatgaaccgacatagggcggccatgcagccggtgacgcactgcacatccctaagcttgctgggggggcgcatccgctctatagctcgtatcttctcggggttggcctcgatgcctcgggcagagaccaagaacccgagaagcttgcccgcgggcacgccgaacacgcacttatcggggttcagctttatgcgggcggagcggagactttcgaaagtttccgctaggtctgagagtaaggtctcttggttgcgcgtcttcacaaccaagtcatcaacataggcctcaacattgcgtcttaactggctacccaaagaaattcgagtagtacgttgaaaagtaggacctgcattctttaacccgaaaggcattgtcgtataacaataagttcctatgggggtaataaatgcagttttttcctcatcctccctagccatgcgaatctgatgataaccagagtatgcatctagaaaacacaaaaggtcgcaccccgcggtggagtcgacaatctgatctatgcgtggcaaggggtaagggtccttaggacatgccttgttgaggtcggtgtagtcgatgcacatccgaagcttgccgttcgccttggggacgacgaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacatcggcgtttgcccgcaggaaggagacgagcgcgtcttcctatttgtcgtccagaagaccaccgattcgtgtggtcttggacgggccgtcgcccagggcaacctccttgaccgggacctcgtcgcacgtgatcatccgctgcctcggggcggctgggacggaggtgctgagcctctcgtcgccacccgcgggcttggacgccgcggcgaggtggtccgcgcgctgctccatacaagcaagcgcgactttgaggtcgccatggacggtaatggggccaccggggcccggcatcttcatctggagataggcgtagtgccgccgccatgaacttcaccaacgcgggcctccccaggaccgcgttgtagggcagactgaggtccgccacatcgaagttcacccgctccgtgcggaagttggcggaaccaccgaaggtgaccgggaggtcgatatgacctagcggccaagtgtgtcccggcgtcacaccgatgatcggctgggacggccggagcaccatccccggggccttgatggcgtcaaaggctgcgggggaaaggatgttgagggctgcacccccgtctataaggacacgccccaacttcacattgcaaacggtgggggaaaccaccatcgcgatctgtcctccccgagcaacgcacggcgagtggtcggtctggtcgaaggtgagggcaacctctgaccaccgcgcccgccgcgtcgcctcatgggtaggggccgcggccagaagctctcgcttcatggccttgaggctccggcgagaagcgtgagcgcacgctcccccatcgacggtggcgacggtggcctcgggctcctggaaccccaggtcatcgtcgccatcgtcgatgtcctcggcggtggccttctgcttggcctcacctcgtcggttgccggcgggagccaccggggccttgccctcacggcgctcctgcctcctctcctcctcccacttcctcgtccgctcagccaaacttttgaccgcgcggcagtccacgaggtcgtggagggaggtgttgtgcacggaacaccacttgccggtcgggcgctccctgctgggagcgccggcctccttctttttgtcgctcgcaggcctcccctttcgggtggcccgcgaagcgccctcgacggcgaggacgtgaccctcgtcgtcggaatgggccgacctcttcttcctcctcctgtcccgccgccctgaccgagcggcggacccgggggcggccgaagctgccacaccggaaccggaggagttccaggtccaggcctcctccttgcgagccacacggtccgtgagctgaaaaagctccgcggtggtctggggctccttggaggcaatcttttcgagcatgcggttgtgccgcacccccctccctgaacgcgtagatcaccccgtgtgcggggatgcatggtatggtgttgcggacttcacagaaccgctgcatgtacgagcgaagagactcatcgtcccctcgctgtaccgcgtgcaagtccgcttcttcacctgggcgtggatatgtgccttggaagttcatggtgaactgctggcacaaatcctcccaagagtggaccgacgcgggtggcaagttcattagccaaccccgcgcttgacctttcagggccatgggaagaaattcgccatgaccctgtcgtcacccccggcggcctcaatcccggtcgtatagatctggagaaactcggcggggttgacgcttccgtcgtatttttcggtgatggtgggccggaaccttgggggccaacggacgttccgaaggctcgccacaaaggctcgacagccggcaccgcctaccggggacacgggaggctggcccccgtgcccggaccgaagtggcgctccggacgaggaagcgccctccgttgcgtgggcagcacgacgaccattgcgccggtgctcgatattgaggcgggcatccggtcccccacgcacatcttcttgggtcggaggcgttggcgagggaatggcggacgaacggcgggtaacagccgccgctcgccgcgccctccgcctcgacgacacggagccggcggtagcagcgccagaggccttggtggcggaggaccgcccgccggtgcctaggcgctgctgcgccgtcatgaccaagtcggccacgtcgtccagccaacgtcgggctggagtctctggatcggggacgacgggcgggtgacgcaggagcgcgcccgcagcctggagcgcgccctggggcgtgctgccatcgccgtagacgaggaggcgacgctccccgtctcgccgtccttctccattgcccgcgggtggcgaggtcgcggatctttcgacctcctcgagcgcctcctcccgcccaagacttcggcgagagggggacggtggagtacgagctcgacggcgcgggttctgctctccatcgtcaccgctagcgctcggagagaggttgtgcgccactgcccgttcggccattgggctgagcgggagaagcttggcgcacacgaaagaggacaagggcttagaaagacacacacgcacccctacctggcgcgccaaatgacggagcgtggggctcctcaccgggagaccgcgcaggtccccctttgccggttcggccgggggcgctaagtgaggttcttagccctcgatctgtggaatgatcgcgagagagcaaatgcacgagacacgggcgatgtagacaggttcgggccgctgagaagcgtaataccctactcctgtgttctggtggatctgtgtatgaagaagttacaaagagctggggaaccagagaattcaggctctagaacccctctattctccttctggatctggatccgggatccccctcctcggtgggcaaggtcctccttttatatctcaaggggataccacatgcaccacttttacctactcttcttttgggtggggacccatcctatcttgaccaaaacttggctcgcgccttcgcctggaagctaaatcacagcttgtccttgagtgagggccagcgccgtcactcgcctgacacaggggatacccctgtcatttcttcattaatgggtggagatttgcaatggatgctgtccgaatgaccctccgatgggatgggccatacctaccccca

SEQ ID NO: 38408 - DNA, 30222 bp, Oryza sativa
  unsure (1)..(30222): unsure at all n locations
ctccccccccaaaaaaaaccacgtcctatacgccgggtcgcgccgctcgtgggggcaggtacgcacgcacgcactgtcccgcaacacgatccaatccacctcgttggcacatgcacgaaccgcaccgcgcgcgcgggtgccgtgagctcaccccggacgccaccagttttgtcccggcccgatcgcgcgcgcgcgcgatcccgcgacagcgatgcgcgtttccttggagccgcacccgcgtgtgtacgtactccactactccagtccagcggcaacgcgcggcgcgcggagaggcctcggttaataccaccaggccaccaccacctctgcgctatcctctcgtttgcggccggcgcgcaacgagccgacgagcacgcacagcggaatctgccacatccgcgcgcgcgacgccggagcgaacaagcaggaatgtcctggcgccggtgatacaggacgacagggatggcgcgtcgtatcatcaccgaatactaagggtgtgtttagttgaggaaatgaaaatttttgggtgtcacatcggacgtttgaccagatgtcgaaaggggttttaagacacgaataaaaaactaatttcataactcacctggaaaccgcgagacgaatcttttgagcctaattaacccgtcattagcacatgtgggttactgtagcacttatagctaatcatggactaattagactcaaaagattcgtctcgcgattttctccataactgtgtaattagtttttttatttatctacatctaatgcttaatatatgtgtccaaagattcgatgtgatgtttttgaaaaaaaaatttaggaactaaacggggctaactgcaggcgccagtgcgctcgacgcttgtaaagcgaagcgagcctcaatgattgagagctctagcggtagccggccgtatcgccttgtcgctgtcgggatcgagcctgctgtgacgcactaggcaaatgctgcattgctgttagctataggatactgactgctttgatcggtaatttggagttttggacatgagcgctgcaccttcatcgatacagacatggatttatcatagctaggtgctggtgaatgattgcctgattagccgactagccgtgtgcagactaagaaccatgttcggataggttaatagtataataatacttgaagaagatattgtcgatacagacaggacgctaattaagcatgctttaaggtagaagatgaaatcagatgcccctttgccgcgcgatgctttgcattgccagatttctccgggatatctggtctgaatgaagtagtgcgaaggtcaaattatggtccagttgctgacgaccatgcatggttctcgtgtcgtgagattgaccttcctaccccggagcatcagaacatggctgagctatcggcaccgatcgagcaaagcagcaaattcagcttgatcgaccggtcgagcagaacagcaaattagctcgatggcacgtccgcacggagttgcggcagggggatagttacatgttcagagatttgactaattgacgaaaacttagctgaaacgcaacacggattaattctacttgatgcgaatgaaacgctgatgagatttattcaaggttggctgcctcctcgcaaaaaaagaaaaaaaagaaaaaaaagaaaagagagagagagagagagagagagagagagagagagagagagagagagagagagagagagagagagagagagagagagagagaggtgtcttcctaatgcagcttgatttgttgaacatggagccatcagccatggagtgattgcaatgctcagccagtcattacaggtagcgaaaagaaccacctggcctattagaaacagagcacaagcacaagcacaaagacacaaaatgctagtgtgaacaaacaaacaaacgcgagtgaaagcggatacattggattcatacatctgatctctagagttggtaaagaaaaatacatgcattagtaggatatatttaaacgtacgtcgcaggattaagactgtcgatcgagatttgcaagccaatacattcgcatgattcagggcagccggtacaggatcgtcttgtccgtattcaattggattcagaaacagaaactgtacagttccatttgtgtctttaacaagtcggctggctttctcgtgatgattcatcagtcaatattgtcatactgtctgtgataattatctttttataacctgacaacactgatattgtcgccacatgcagaaatgccagtgctgtgcggatacgtgcaattgaacttaccatccattccttttccttttctttgaaggaccaatggaacttatctgcaatctttttattcggaaaccgataaacaatctgcaggttgctgaccacagaaaacgtactgaaatgaaatgcattgttgataacaccgacggtttttctatttttcaaggaacattatcaaacattgttgctgctgcccctggccggcaagactatccattttacggtttacggattagtgcacaaaacacgccatgtgataaaacggataaactgttctttgccggccactaaactaatcatcagtgatggtaacacggtacatttctgggacaccgcttggatagaagggcaaaaaccataaacataatgccactagtttatacaataaaaaaaggaggaaaaatctctgcgtgaatgcatgaagaagatctaaatggcaaaacccacctcgcagtggatctgatcaaccaactcgtatccctgtggaacgcaacacagggcatccacctagaacaaacgaggttgaccaaattgtttggaagctaacgaaccatgagaaatatttgactttatcggcataaaagacgcaatgtctgggaattataggcaccaatttcaataccttaatgatctggagagcatggaccctgcaaaaagcaaattctatcaaaatagcgtatggatctcggatcgactcacaaccagaagctggccaaacaaacaacgggcactgccccctctgccaccgaatctagagcctaatagcctcttagatggcatatcaacaactggaccgagccaatgggaaccaagccaaaacgttaagcttgatgggaaatgttggccaacaaaaaggaagtacccaagaaatacccgcgcaccctaatcccgctagtcatttgggagatctggaaagaaagaaaccaacgagttttcaagcacaaagagaccacgacacctagcctattgacaaaaataaaggagaaagcaagaacttgggctttggcatgtgcaaagcagcttcgggagtttctaccaaactgcataagccacacgtaaaacattgtacggaacatttttcccttactcttaggggctatatttttttcacccctatatatattcaatgaaatagcacaatctcgtgctaattctattttaaaaaaaatattagtgcacagaacgaaatggtccatcatgctgggttgttgtttctgtgtttcttttgaaccacaaggaggaattggaatggtaatttgagattttttttttatgaaaaatgaatcgatttaccatcttttcctgcattgccattttgccagatttctttggagatcaatacaattcacatttggattataccctccacatagtatatctcatatgtttgggaattggcttgtgggtgttaataaaaagaccaaggaacttatttttgttggagcttccgctatatgttaggctctctggcttagtagaaatgaaatggtttttgatagaccacctttaaaatcttatttgcgggttcttttcagggcaacatattggctccggaaatgggctcaattacaaaggcatgatgatcatatcaagctaataaaagatgtgtatcgtaaacttaagtcgatgatcatgcagatctttgtcaatttcaggtggaaattcaccaatataatttagtagttgtggggtctttagcttatttggtttttattagtttgcttctacttttggttttgttacttcagctacatacttaccgtgtgagtttgcttttgtgaacattacaataactagcatggtggcccgcgcagattacgcggctagcatcattatattttctctcatataatagcatatatatttttttattatattgttaaaatatattacaatgacaacataattttaaattttgcaataactttacgaaactacaaatgtgtaatattcatactgtattttatatacgtgttagttattaattatttttaatatcaaattttagttatttataaattatatatattcctatatggactctatacttgtcttttaataatttttttaattctgaatttttattatttctaattgtatttctatgtgcactctaaactcatctttcaatattctttaattttaaattttaaatttcagttacttctaaattgtattcctatattgactttaaactcttcttcccatgtttttcttaattttgaattttagttatttgtaaattgtatttttgtacggactctaaacactgcttttcattttactatgtttattctgaattttagttagttttaaattcctatatggactctatactctacttctaatattccttttttttaattctgaatttctatttttttcttaattgtatttctatatggactctgtactctacttctaatattccttatttttaattccgaatttctattatttcctaattgtatttctatatggactctatactctacttctaatattccttatttttaattccaaatttcagttattttctaattgtatttctatatggactctaatctcctcttctaatattccttatttttttaattccaaatttgaactatttctaaattgtatttttgtatggactctagtctcctcttctaatattccttattttttaattccgaatttcagttatttctaaattgtatttctatataaactcatatttcaatattctttaatttttaatttcaaattttagttacttctaaattgtattcctatattgactttaaactcttcttcccatgtttttcttaatttagaattttagttatttggaaattttatttttatacggactctaaactctacttttagttttattatgtttatttagaattttagttagttttaaatttttgtatggactctattctctacttctaacattccttattttttaattctgaatttctattttttttcttaattgtatttctatatggactctatactctacttctaatattctttatttttaattctgaattctgttattttctaattgtatttctatatgaactctatactctacttctaataattcttatttttaattccgaatttcaggtatttcctaattgtatttctatatggactctagtctcctattctaatattccttattttttaattctgaatttcaactatttctaaattgtatttatatatggactctaatttcctcttctaatattccttattttttaattctgaatttcaactatttctaaattgtatttctatatggactctatactctacttctaatattccttatttttaattccgaatttcagttatttcctaattgtatttctatatggactctagtcttctattctaatattccttatttttaatttcgaatttcaactttttctaaattgcatttctatatgaactctattctcctcttctaatatttcttattttttaattctgaatttcaactatttctaaattgtatttctatataaactctgttttttctttttctccgattaatatgagaatttctaggccatgagagcgaacgtggaaactcatttttctattactttaacaatataatagattgactatagctcttgagcggtcaggatgtttcatttcattatcataaaaaagcgggtaggaaagaatttcaaggattagttcatgacttgctatgactgtgagagacatagaagaccagaaatcacttacgtcactcctcgcttgttaattacagtcttacttgcatatatgatctctggtttgtgtttaaaggctccaggtcggttcattcttaaatagcaagagagttcctctcatggaacgtcccacatgatgtagccacctgacatgtcggcccgtgagtggttgaccccatatgtcagtgaccgtcctaaatagcatggcgacaaccgggcctatcaaacgctgattttagtggccctaacttagattagggtctattggacctatgcagcgtactcactgtacagtatgactcaggactcggtcggcgtcggtcggtcctaaccaactggccaccggccgtatagacgccatggcatgtggccgccgagtcgccgtggtgccacttgccactagtaccatgaacagcagcagcttatcaggctctcatgggatagcctaatcagctaaagaataagctaaattttaaattttcaaacttaattttaagatatttttaacgtagtttttttttcaacattgacttttaagtcaccaaaaacacatatataaaagttttacctataaatttatttttattccttaataaaccgttttggtttattagggaaaaagccaaacaatggggacctcacctagtagccctgatttcggaaggctcgtgtcaaatccttgctaccctctcacgtgacacggcctcgctctcctctcaccggagacgcgtaactgcgtcagagactcagaaataacacaccagccgtgcccgtgccgtgtgtttccacccatagatcatgtgctccctccctatcttgaggtcgacgcgtcccgtacgttgtagatcgatgcacacgctgatacgcattgccatttcggttttacctcttcgggtgtacgttcatcgatcgatcgctgcaaatccttggagaggattgatgcggcaaaagctttcgtccggtgttaattcagccggtgaaagaaaaggtaatggccgctgtgtcggatgacagagatggccgcgtgcaattgttcagggtgaacttgacggggaggatcattaggccctgcccgctcggtcacggctaagccctgtcaacttatgtttagggctggtcttgggcttaggagtggatgtgttgagctcggttccaggttctaacctaatcacctatgctcttttgcatgctctaatctttcaaaagtgggtggcaaaaagcctatggaagtactaatactaaatgttcaaaaaaaagtactaatactatgttagtggggtatggggagaattaattgtgctttgcaatttatcactctaccaaaaaggatcatatagaataagatttcgaaatggcatgtctagaggtttctcgaagctcttttccaagctcgatacaatcaagcactgaaaagaacctagccatggataacgttgacttgctgcctaccactatgcgtctacggcggattgttgtttttgttttcgttttgtcgatgttctcgtctctcttatttttctttttcctttttttggcaaaagccggatttattgatttacctgagagcccttctccattttcttatgtttactttaacctgttaataaaaccataccatacgctaggtgagccattagcgcatgattaattgtgtattaactattttaaattttaaaaatagattaatatgattttttaaagtaactttcctatagaaaatttttgcaaaaaaaaacgtaccgtttaatagtttaaaaaacgtgcacgcgtaaaacgagtcacaatctcccctatctcccctaaagaacgcagccaagttggtttgaattatacctctcattatatgcttattacctgtaagtctaactaaaatttaaattttaaaactttattttctttctagtattggtttttaagatagctaataatatatatagaaatgctttatctataagttatttttagttgcttcgttaattgtagctgaaacaatcatgctctgaactaacagtaacaatgtacggtgacgatcatgggtggtcggcgtcagccacgccgtgactctcttgggctttattagctctccctgcagtctcggtgtgttatatatacatggctccatcccggtacatgtaggggcatgtgaaggacagtagcatctggccaccccgctcttcttgagctagcgactccgtgcttgagtagcaaaggagcgagtgagcatttggttctctgccatggcgaccacaacggcagaaagggatggagttgaggaggagcagaagaagaggaagcagggaggcttcaggaccatgccattcatactgggtgagtatttattgtaggattcacttatatgagaaatttttggtgaaatgatctttcggttcacttttagatagatgctgctcttgctcagtagcatctgctagctgctctgcttgtagattgagccggcaaattaagcaaacaagatagcatagtgcgcagtttctgggagagtgagttgcaatctgaatatctgatatagatgcccaagctgggcggtaatcccgtccaaaactactgcacatctttgcccgtggtttgcattttatttttttttatgcacgaaaacgtacggttcgcagttctcggaaatctggatctgatgccttgccgatgccagtaactttggtaggtttgtttgtttctagttcttttattcatcttttctttctgacggcaagagagagtgatgttaattaactgttaactgcacccatcagtaacaaaataacgccttcctatgttgttttgggaattaaaaagacataacttttgctactttattactccctccttcctataatacaagggattttaagtttttgcttgcactgtttaaccactcgtttcattcaaaaagatttgtgcaaatataaaaaacaaaaatttgtgcttaaagtattttggataataaagtaagtaaaaataaataaataataattttaaaattttttgaataagacgagtggttaaacaatataaacaaaaacttaaaatctcttataatatggaacggagggagtattggattacataaataaaacgtatacatgtgtgataatgtgatgaaagcacttatcatgacaaacttggcttacgccaatttttgtatgtccagaatgaacctatgcttcaatgcttgtatcacattctcttctatccaaagggagtatatcgttcacttcccgatttctattcagtctagtcacaccgtgtaacaagaagtcatacctccgtattttaatatatgacgcccgccgttgactttttgtctaacgtttgaccattcgtcttatttaaaaaaataatataattaccatttattctattgtgacttgattcatcaacaaatgttatttaaatatgacataaatatttttcatatttacacaaaaaatttaaataaaacaaatggtcaaacgttgttcaaaaagtcaatggcgtcatacattagaataaggagggagtaactgataataaatttgatcgataatattaaccataattaacgatgtaattaacggtcgagttgcagctgatgtgtataatcatcggtgtatatccatggttgtcgccgagaaaatctcatgagttgtctccgttgcagcgaacgagatctgcgaccggttcgccacggcggggttcggcgcgaacctgatcacgtacctgacgcagcagctgcacctgccgctggtggaggcgtccaacacgctgaccaacttcaacggcacgtccagcctcaccccgatcctgggcgcgctcgccgccgacgccttcgccggccgcttctggaccatcatcgccggatccgtcttctaccagctcggcatgctcgccctcgtcgcgtccgcgctgctcccttcgctccgccccgcgccgtgcgcgccgacgcacggcgccgcgtcgtgccgccgcgccaccgggtggcagctcgccgggctctacctcgccctgctctgcacgtccctcggctccggcggcatccgcccctgcgtggtggcgttcggcgccgaccagttcgacggccagcagcagaagcagcggcagaagggtggcggtggcgcggcggcggcggcggcggggaggaagcggagctacttcgacctctacttcttcacgatggggctcgcggtgctgctcgccctgacggtggtggtgtacatccaggagaacgtggggtgggggtgggggttcgggatcccggccatcgccatgttcgtctccatcgtggtgttcgtggcagggtacccgctctacgtcaggctgaagcctgggggcagcccgttcacgcggctggcgcaggtggtcgccgccgcgttccggaagcgccgcgccgccgtgccggaggaccccggcatgctgtaccaggacaaggagctcgacgcgctcatctccaccaatggcaggctgctccacacaaaccagctcacgtaagctttttttttattattttctttcctactgcacgtccatttcccgtgtcattgtcttcacttgggcagtaaaacaatttagcatagcgtgcacgtgacggccttggtgtctgtggtagctactttttggcggtagatacattgtcagggcagaaaggagaaagccaagcgagagtgcgctttcctttgaaagtgcttcctctttcttacctagtcacacaagcactgcccctaaagtttagatttggtgtcacatctctatctctagctattgtatcttgtgaccgggagaaaactagattaggttgaatacttattttttcgacgttagagtaggttgaatactaaattaaacacacccactattttagtttcctcccttccgatacatagcatttcctttctgaacagttcgttgccttgcgagttttaattggaataaaagaatatttgcatatacaataaacgggtttgctaaaaataagacgccatatttttcacttaatttcagtcacttttccataagtgatttttctcgctcctgtatgtaagtatgcttccatctctcatatttcctcttctaagtagataataaattacttttaatccctattctcctatatattgtgtattagaaaattacaatgtaataaggaaacatacaatgtacaatgtaattacagtgtaagttttaaaatttacagtgtgattacaatttaaatgcgagtaatttgcaatgtaaaaatgatttgattatttttatggaaaatatagctacatccgattttgcagtgtttttgtctatccgatgttcattttttgaatggaaattaaagataaggtcgaaatgtttacgttttttttggtttttttggagtgaaatgaattagcttagtagtttttgtttctattttgaaatggaaatataaatagaaataatatgctctatttgtaaatggaaatgaacataattaaacaagcatgccctttgtcaggtcgtcattattaacaattatttcaatataaacagtgattattttttaccaagatatattataaaaacatccattgcacgtgcacaattattagtgttttttttacttcataagataagtgtaaatttaaaaggtaatatttaaagcactttaaagcaatcttagtatttgttttgatgtctaagtttaaaagtttcggctgtaattttcaataatcaaagtatgtttctcaacgttgttttcaaccatgtgtatttttgaaatatcgttttcacccatgtgtaaagagaattttttgagccacatcaaaaggactgagcccgatatgttcagatttctttttgacatttctagttgttttttactttaaacccgtatcattatgagaaggggcaatatatatgtatcaacataaaagatagatatatatgtattgaaggataagtattgataaaattcttgaaaaaacatatcgcaagaaaatatttgatttgtattctaggtcaacatagatttacgtccacattttctcaagaattaaaatgatttatctccacattcatgacataagcagctggtttaaatataacaatgttgtaaaacacatattttctccgaggagtgtacactcctacataaaaggggtaaaaaaaactcaacagtaggtgtttcatgaatcacgaggaactatatatgattaattgatcattaataattttcaaagataattcaaatccgcttataatgccgtactggaatgctagtttctttttcctcaatacgggtctaagatacaagcccgaaggggaatatactatgaaacgtactgtagaataaatgcttgcgtgcgtcataacgaaataaatttgccaccattttaagcagtctattgtgatctaacaagacaattgatttttcgacttaattaactgaacgactattatagacggttccatcaaaaatacttgtgagccgtttgtgattaaccccttctgctgtagtaaccgtcccgtgccgtgctaattcgttcaggttctttgaccgagctgcgatcgtgacgccgggtgacatcgccggctccggcgagccggacctgtggcggctgtcgacggtgcaccgcgtggaggagctcaagtccatcgtccggctgctgcccatctggtcggccggcatcctgctcgccaccgccgcgtcgcacaacggcaccttcaccatccagcaggcgcgcaccatggaccgccacctcacccctcgcttggagatcccgccggcgaccatgtccatcttcacgacggtggcgatgctcgccggcctcgccctctacgaccgcgccttcgtgcccctggcgcgccgcgtcacgggcctcccctccgggatcacctacttccagcgcatggccatcgggctgggcatctccatcctcggcgtcgcgtcggcagcgctcgtcgaggtgaggcgccgcggcgccgccgcggaccacggcctcctcgacagccccgccgccgtcgtgcccatcagcgtgttctggctggtgccgcagtacgccgtccacggcgtggcggaggcgttctcgtcggtggcgcacatggagttcctgtacgaccaggcgccggagagcatgcgcagcagcgccgccgcgctcttctggctctccagctccctcggcaactacatgggcacggtgctcgtcacggcggtgcagcgcgccacgcgcggcggcggcgagtggctccaggacaacatcaaccggggcaggctggactgctactactggctcgtcaccaccctcatggtgctcaaccttggatactacctcgtctgcttccacttctacaccatgaagccattagaggtggcagaggaagacgatgacgagaaggagtgtgagctctcctccgtccacaaaaatggcggccccggcgggttggtgtgacgaggtagattaggataattttatcagggtggataatgttgttaattacggagtacgaagtaattagctgtgcatgtgcatgccaaatataatggttgcaaaatacagcctttagggcatgtacaaaaatagagtcagatatgagtctctatattatttagagactagcatcttacaacagttagagacaatatggtttctaatcattaatgtatccaaatactttttcttactcttctttcctttttttcactatcatgcaacaaaatttgctctaataaatgctaagagtcgactctgagccattgtcatgcattacaaccatacttctttctctttcttccatatcatcaaatttacttgcatggcaacagagagagaccactaatgaagaccgttgtacatgagataaaattagtatatttagatactgaggtaggatccaaatttggcaatcatgaattcatgatcatgatcatgcagcaaaaggtaaccttgataaataaacatgatatatatcgtagccatgtggagagataatcgcagaccactttatttgttggagtacactagtcactgatccccacaaccggctcaatcaaagagccacatgcccacatggacacatggtacaatgtttacacgtaattcgtgcgtaagattgaattattaggcatctccagactagaaaatatcaactagttttcatacttgctatgttatatagatactatgtataaaaactatatatacaatggattgaatcttcaaattaaattctcatccaatcatctctcatctctctccatctctttttatctatatatccccttattttcatttttgttgagttgtttcttgtgtaaagaaggtgtcttcatctttttacctctctcctcattaactctcttaccacatcagatttttcttatgtgacagtgtatttaatgctacactacatgatatgaagggttagggatggccttagagagagggagatatttagtgcgcattatgatatatgtaaaaataacgatacaatcataataaattgctagctttatgcaccatccagatagacgtggccatgttgttggtttagtaagctactagtggaaaaactctgagtacagtcatgattcataaatttttgaaaggtaaaatgaaatctaaaaaaagaccaacaaaataaaccatcttatcatctcaaacataatactccctccggttcaaattacatatcattctacgtttgttctaagtcaaacatatctatctttaaccattactttttaaaaatccatgtataatttaacatgtaaataatatattatgaaattaatattttggtgaaacttaaaaatataaatcctatgatgctaaattatataaagtttataaaaattatggttaaagataaaatgtttgatttagaacaaataagtaatttgtaacataggaatacagttatatttttggagggacagagtactctcaattgacaaacctataactaggtaaggcaattttgcccataggtctacccggcccgatgggtatgagaatgggtgcaatattttacccgtggacacgcctgctcgagacctgacgatgtggtgggtagcagctgggtctcatttattacccacggataacccatgcctgatccggtgtatgtattattgattttggcccatgcttgcattctcataccacttcctcttggcccattaaccccacacacacacacacacacacacacacacacacacacacacacacacacacacacacacacacacacacacacacatatatatatatatatatatatatatatcccaacatcaaaccctaacctaatttccatcccacctcacatggcggaggtggcgactcaaggcacgtgcgggtaagcgacgacgacattggctcaaggcagcgcgtgggcaagcagcgacagcggcggcacgagcaagtggcggtggcaggcaatggttccagtggagtcggcggcgggtggcgctacagagtaagcggtgcaacgacgggtgccctccgggtatgcacgtgcccattgggcacgtgtatgggcacaaagttttgtccactaaaattattgggtatgattcaagtgagtattgtttttctctgcccatgcctgacccgacccgttgccacaatcttctctcagcaaaaccaaaatccattcaacaccaaaacatgaacttcatctgacgccagtgggatatggtggacgccaactatttgcctttcatcagccttggtggtcccctcttcatccatagccaatggcggcgctgctgtagtggacggagctctccatcctcaattccccttgatgtccaagggcgttgttcctcggcagcttttcttctcttccattgacgttcgattgctactcctggtccagacgccaaggcgcgtattgttcatcgcacttactctctggttggaggggatgacattgaggccaataattatattgtcataacaaaacaaatttacaaacttactggtcagactcatcatttggctctcattcaagctgctcgccgttcgtcgttcaagctactcaccgcgcacctgccagagacctctcctcggacgctcaccgtccaggtcttctcctctgatgagggcgggtgggaccctcctctcgcctgcgccattctccaggaatgcgagctccacagctacttacgccaagcccgtcgtcctgcgcggcgccgtccactggctctgcctcacatactcgcgtcaccgaatcctcgtcctcaagtgggaacatcctccacgcggacgctgcgacgtcgcttcgccgccgctgaaggcgtcgctgatgagactcccgacgccgtgccacacgacatgtgcctcgtgctatcgcaggcaacaaacgacgtcggcaggacgagccatcgcgctgcagcgtccctgagtgtggtcgccctcccaggcaaccgcatcgccgtctaggtgcgcatcaccgccgtccggcgagggaggttagtcgacatctgggagcgacgccatgtgatctgtgaggactagctaggagagcattgcacggccataggcagccgcatcaccagttttttaattattttctgttgtaactatcacgtagatgccacatcaatggcatcgtgtgacaaagattagtcaaaggaggtacgttggcatcatattagccaaaatcagggacattactattgaaggaacttgtttgcacttgttttgtaagttgagggacctattttatctggtatttcggttcaagaacgaaaatcgaacccactataaatttaagttaagatacctaaaatgaactttattcctttcagaacgaaagaaaaagctcactcatgtaacaacaccaattctgaatccagaccgtgtcaatgaatcgttcccatagcacgcgagacatctacattactgaaaaggaaagctaatcccatgatcccaccaaaatgagccaagtaatcaacaaaacaaaataatgaccattcgattcacgtggagacaaaatagcttgaaaaaatctaagcagttggataaaggaagtagcgatcttcttcttttttttcactactataaaacatcaaataggtgttgccactgtaggtgctggtagtactaaaaccggcatctacaggcctttttccacctccacgggttgaaatcgtaaaaaactagcacctttaagtaagtaattataggtgtcagttctaaacaaaaaccaacacctattatattttgtgtcttttttaaaaaaaacccggcatctataatatattataggtgtcggttaattaaaaactgacaccccaaaaatcgagccaaatagagccgagccaagccaagctggagccaagccggcgggccccaccacgacgaggcgataaggtctcgctctctcgctctcttcttcccgcctcttctcctcttctttgtctcgctctcttctctcgtctctctccctcccgttgccggctactagccggcggaggcggcagcggcgaccgcgccctcccctccaccagattcagcgggaggggaggcggctgcgacaggaggggaggcattagcggcaggcatagtcggcggtaggaggggccgacggggtcggtagcgggcggggtgtctagatctagcgtcggcggcggacggggtggctggatcctgcttcgacagcgagcggagttgctcgaggaggggaagcggcgggctcgatgaggggaggtgacaaagggcttgctggcggggaggagccctcccatccgccagatctggtaggaggggaggcagcggcaggggcggcaggctcgcggaggagacacagcggcgggcgacatcgtgacggctcgaagacaaccgaccgtgcgatgacgacttcattcggcggccagatcttcttcaacaaggcaagccaccaagccaagcaaatccctctctctaccattcccctctcgcttctccggtggtggtgtgatttttttcattgaataaatttgtgttgtgggatgaatccatctttgaatgttgtgggatgaatgttgtagactgctcggctcgatgtgtcggctcgatcgagccggctttttttttattcgtcgaacctaaaaggtgtcggttctaaggaaccgacacctttttaattttcaaatcagtaccacctcccttgtgccggttggaaaaaccggcaccgaaagaggtttcccaaccagcactaaaacctttttctgtggtagtgtttttagaaaaaacatggagagtctagaaggctcatgagcctactaagaaaaaggtattaaggttgtggatactaatatcacttcagctatgtacctgtcaatggtgttctcatgattaattattattacaaaattaagcttagtgttatttaaacaacctataaatgtatctaaagtattgaaagcaaaatggtttcaaagcacctcattggtccatagtggcaaaaaaatatggatcatcagattgataaaaagacaaaacaagaaaagcaaatgtgggccatcagatcaaggaagtagaaaaccaggtcaactgataatgatgagcaatctaggtacttcatgcttgattattttttcgggtgcaatgctgaaagatggtgaatgctaaggaagaaaagatgaagtagaattaggggtgtttagatgggactaaaactttttaaactttttagtccctgttatattggatgtttagacgttaatttggagtattaaacatagactaataataaaactaattcataaatgagagctaattcacgaaacgaattttttaagcctaattaatccataattattaatggattaattagacttaaaaaattcatctcgcgaattagctctcatttatgaattaattttattattagtctatatttaatactctaaatatgtgtctaaatatccgatgtgacagtgactagtccctgtttcccaacaccatgcttgtctgagttaccagttaaacataatatcaataatatcaatggtgattttaatcattgctttttatatataaagcaaataggctcatatattactgattctaatggtcgggttaaagttgtgcgaatccacaactccactggctagaacaactggaaatttctttcctgatttaataagcatgtactccctctgtagcctaatataaggattatttattttaaaaattaagaaattagcaaaagtacaaataatggtacaaaatatgataggatatagaataaattagtacaaaactgggcagtcgaaggaataaactgtacaaaagcggatatatgtgagagaataaataattattttgggatcataaaatttcttatattttgatacaaatttgaagaccaaaataccaaataccttacattatatggcggatagagtaattaaagatttaaatgcacatgcaaatatgcaatgccaccctttatcattggacactccacacactcgacctatcaacttcaagtcttcaactagtccactgttcgggaatgatccaattatttatttgtaactactcaaacgcgtacctaaacactgatgcgtacatgatatcggcttgacatggacagcaagccacacacaaggtcaagctcaggccaacgtatggcggacagtcatgacacgagacgagaaacaatcacaacctggaaggtgctacacgtacggtggagaagatgcgcttctctgatctccacgtctagtggcggtcgacgaagctcttgatggcgtcgacgagctcccgggtcctctcgccggtggccgggtccatgtcgacggcgtacttgttgaggtagaaggagtggctcatgccgcggttgaccagcacctccacgtccttgccggcggtgcgcagcgcgtcgcagtactcgaggttggtgtcccggatgaggtcgtgctcggcgacggcgaccagcagcggcggcagcgggacggactccagcggcggcgcgttcggccccatcgggcacgtgtacgggtggtccttggtggcgccctcggggagcgccatggcgaggaacttgtcgagcatgtcgagggtgaagaacaccgagtcgggcctcggctccagctccgacttgctccgggtggcgtgcacgaaccccgggtggagcgggatgcctccggcgacgcggaggggcgcccagctgtccgccccgtcctcgccgacgcgcgcgccgacgtggtggacgaggttgccgcccgagctgtccccgatgaggaacacccgcgagaagtcggcggccgtccggaggagctccgccgccgggtcgccgagagcggcggcgtcggacagcgcgatggagcggagccggcggagcccgtcgacgccggtgtcgatgtgcgccggcaggcggcgctcgggcgccaagggcagctcgacggcgaccaccacggccgggagcgcgcacgcgaggcgcgcgtagaagtggtggtacatgagccaggacgggtgggagatgcagaagccgccaccgtggagctgcacgacgacggggaggcgccgctcggcgagggcgacctcggggaggtacacgcggaggttgggctcgccggggaggtcgtgcagcgtgtggccgtcgcgcggctcggcgtaggcgggcaccggctgcatcagcgggagcacctcggggggacccgtccacgtgcggtcgacggtgccgtcgtcgaacacgcgcagccagccggacacctcgtccaccaccttgcgcccgaccgccgccgccgcgacggcgtcggtggcggcggcttgcacctgcgcctgctgcgactcggtggcgatggccattgctgccgtacgtacgtcaggctagtggcgttgcttccgccgtgtgtgcgatgcgattcgatgtgcgcggtgcgagagatggatgaagtggcgagggttttattgccggtgaccgagtggctccgtgttgcagttgccgattgtactactgggaagtttcgcacggaatatcacggcgattgccaagcaaaattttcccggattcgcaagcagagttgctgcagagtggtggagacttgacaggttaggagtagggtcgtgtgtggacttgtagagcgactagaccaaccgaatagcgagtgttctttttttattgcgaaaattatattgactttggtggttatagacgagattgcaagaaatgatcaggtcgtcctcaagtttcatactactacatgtggcctgtggccatgtggatacagcaagaagccaagaagtatatcactaatccgttcgtgaatctgaatcttaatccgtatgaactagggcgttcatgaccaaggacttcagtgttttgcaggttaggtcgatcggagaataacaacagggaacatttactatgctgagttataatcgaactccaaacaacaattttctcgttttctgtttaaacttaccgaactaaaaaaaaatgatgtctcttattaaaaaatgtctatatatatatatataataaatctattttttataataattattccctcgtcccgaaataaatgtaaccctcttgttacttattttattttagaatgaaagaggtaatacttaattaattatatgctaatgagttttcctgtatcatgtacctccaaatctcctccccaacctgttgtttgaaaagctatttttttttcagttcgtgcgaaagacaaagtaatttctgtagaattcgtacggtaagttccaaacaggacgcaagtacttacatctggagtacgaatttttctctccataaaaaataaaaaccaatcctaattacaaacctaggtttatctttttttaaggacgaaatagtaaagaatgaataaaaaatttgaaggtagagaatgaacaacatccttatatccgttggatctaatatggatgggtcggaccagatcgtttgttaccgttctaatgctacagtaccgttccacatttttgaaaccgggcacagtgatgatatggacgtggaccagacctttctactactgttctaatcacattttttgaaccggacacagtattgccacactgatctgcattttcaccgctgtgcgccacagttgctccacgactttgcttcttcttcttcatcaggtcagaagttcagtcaggcaagtctttctgtgcgcgtgcgtgactcgtgcggccctttttgtgcaaaccgtggggacggatcgcgcgataaggtgaattattcgaatcgtctttagcactccaaattcgatcaggcagcaggtgcagggtcgtatggatttggagctttggacggaccagaggagggacaggattagtggggctacagtaaagcatcagagtaatcgccatcagcctatctagtagtactactgtatgttgggtctcttgaataagtcggtcagtcgttgtggtcaccattcaccaatgtacaaattaagcaggagattaaaatactactgtaccattcattaatgtagaatgaaaacgagaagtgggtattactgattcgatgactaaaacgagaagaaaaggatgtaatagtaaagagatttagggtgtgtttgagtagaacgggattgaggagattgagaagatacgtaaaacgaggtgagctattagctcatgattaattaagtattaactattttaaatttcaaaaatagattaatatgattttttaaagcaacttttctatagaaattttttgcaaaaaacacatcgtttagtagtttgaaaagcgtgcgcgcgaaaaacgagactcaatctcccctatcaccttgaaacgaacagagccttagtgaacttcactttaaaaatatagttttttggataaatttttggactagaactttagtctttagggtgaaggacagaggggaataatgtttatgcatgataacttgggttgggcttgggcacacggattacacctctcgtcaactggactaagttatacccctgactactttaatggaagcaaagtggaaaattggcaggttagtagtcagaaagacacattcagcgcttctgctaaagctagtaaagtctcttgaagcgaagacaagcattcctaatattttaggaagtattcccaatattttaggtgtagtactatatggagggcgtgaagacgtcaacgattatccacgggccttactttactgttttttttttgagaacattactttacagctatgatgctatatctgtttatatatacgagaatatatatattttttactatatgcacctacactcttcttcttctttttcgttcacaaaagatattgcttatagcggtggtggaaaatttaacactcagtctttaccatttatttcttttaaagctatttattttttctaaagtggtatagatatcataccctaatacaaacataaaacacagttcctactacccgactcgtgtgtcacattgttgtatgagttaactttgttttgaacgacttacaccgaatagagtaggaaaaaaattacaagattgcaactctggaaggtcgtaactaggaaaaagaaaaatatatcatcacccacacaccgacaacgccaatacacaggtccgggagaaggctagcaccggaccagtcgccgttaagcgtgaccgaccgccactaggccaataaaggaatatagacaagatcgtccaaaaaaacgcctttacaaccaacacaaagcccaactctatctagagcgcgcttgcaccaatcgttcaagaggtttcggcaaggggatgcctagacgacatcttaagggagagaagcgacgggaaaaccgccaccgccgtccgttagggtctcaaaagagccaaggttgggctttcacccggcaaccccccttaaggagtgagacgacacgacaatgccctcaggagggggaatgaaccatcgttgttggcccggccaaggccgagctgggttttcacccgctgctcaccacctgcgagtccacgctgatgcaccgatgctccaccactgttcaaactctgccgacatgtggggccactgcaccggtgccccctgccggccagccttcacgcgccaaagactgcgccacacccgccagcagctccttgcaccgtggtcgcctccttcaccaccggccgcgcctcatcgcgttgcgccggtctcctccaccggatgcacctctcgcgtcaatctggcctccagcccacggccgcgcctttcgtgccaagccggcctccgtcgcccccagcagcgcctctcacgccgtgccgacctcctccaccggacgcgcctctcgcgccaatccggcctcccgccatcgactgcgtcaagccgacctccgaccttcctacaatcgctgtcgcgccggccagatgcggccgtcttccttgccgccggctagccgtccgagaccgccatgcctcctccaaccgcagccatggtcacgcctccacttgccgccgctagcgatcgtctcaccaccgctgccggccgcacctccatccattgatgtcaccggccacccgctgactccaccagccatctaccgacctgcagccaccggccgccgctcggcagtgagctccacgccgctgtcccacgcgctccgtactgccgccgcgacggtcgctcgatctggccgtcggatccacctccgactctgccggatccgccacgctgacgccaaaccgtcgccgttgccaaccctgccgtcgtcgccatccccgccgccaccgccatctccaccgccgtcgtcgccattctggccgtcgtcgcccacaccccccttgcccctaccgttgccgtctccagccctgcgctgtcgctgtccccaccgccagccgccaccccgctagatccggccacagtggcgcggacttggcggtcaccgtcgccgccgcactagaggctccccttgctgctcgcgcaaggagaggcgtgaagccccgctgccgccgtccttgcggccacgcggctttgccggcggccactcgggcagcggcgaggcggaggaggaaggtgggggaggggaggagggggtgaccgggttggtctcgcgagtcgcccctgggggagagcgacacgggggagaagatgctgtactttatgagttaaactttataacactaatggatggagtatattataaagctaacaaatactgcatccatccaaaaatatttgacaccagtgcagctttgtcagtttaatacacaaactgcccaaaagctgaattagcgcaactctacgattccaaactcgtcaaaagatggaagttgtgaagaagtataaaggaaattgcatagatgcggaatacttgcaccatcttttcttaacggcctgtttggtaacctgagggaaagggattgggagtttacatgagggaattgatgatgagattaagatgggaatttgatttttaatcccaatatcttgtttggtagaggcgatgaaaattgatagggagtttagttggagattggatcattaaaaaaaacggatggatgagatttgcttagacaaagtaaaaaaggaattccctcccaattacctgcccctacccaggtattgaaaaggagagagttccttcctcaattccccatctccatcctaccaaaatttccatgtttcccaaccaaacaaaacacttaatagccttatccctctaactaaacaggccgtaagggaaaaggtggggaaaggagcaaaatgattggcgcctgtggtcactgcacacaaaatatggacaccgcaaaagaaaaaaatgtggcgacgtcgtttatgtgataaaaaaacataatttatgattttcaattaaaaggcaagagggaaaattgtccatgattttcaaactaataaagggaataaaaaaactaataagaggaaaaaacctgcactacagtacataatttactcagtgtcacaaaatgtcattttcctataacttgttcgtggcagtagtgcatggacgtctgtttgtggcagtgcactccctcaatcgattcatcccaaattcccaatctcggactctacagaaggtgaaaggtgcttaccacctgacaggcaaacagcatatatagtattaacacctacaagtgcagtagtctgctacacgagtacagagtagtagtttaaagtttaaaaccaagattttgcagcaaatattctgttgtaagtagtctacctaattatgaatatagacatgaaagggatcttctatctgccatgttcctttcctttccgtttgaaaactgtcttgaccaggccacacactttgtggctgggaaaaatatttcagaactccattggaaatttcgcggaatatgtaggagaattggatgggaacccaaggtaagctgtgttagtattttcttcaataatgctatgtacaggaaattagaaaagcagacagactacttgtcttaagtcgggtacttacatggttggcagcatatcctatggaaaccaaccatactgtgcaaactttggaaactcccatcaagatctctggatgggcatccgatggataggggtggaggtgggacaattttgtaaataaccgcccgcaattagccttgctaatctccttttttgcaaatcaacccccgcagtaaccctgttcggcgccctaggacgcgtcatccgcgtcgcttcctttcgactccgcctcccgtgattcaagacgacgacgacaccgcccagtgaatcgccggacgccgcgaacgcgatggagcccggcaatgccatggactctgcgatcgagtatgctcgcgtgtccagcgacgccatggattccggcgcgcgcgtcgacgccgcctaccagtgcgttttccaggaatacgacagggacgcgctcaaggccaacatcacggcatggggcccctggtgctgcccacctgggatgagctgctgttcgtgctcctccttcctcctcttgcttgtctgctgaagctcatcacggccatgaagctgaagctctgctgttgtttgttttctgctgttaaatgtactcttaagatgaattgagcaatgtactcttgtgcggcgcccgccatggaatgcttcttgtaaacacttttttttactagtgacatcattcagcttattgctcctaattttcagatcaattgtgctgcatgtacttgccaggtcaattttgagttaatcacattccattttgagttatttgaatatctgcacaatcgtctctgtccagctcggcgcccgcggcatctccactcggccaatggccaccttctcttcaccaccgttcacagtcccggccttgctacactccatcgccaccgctcacgcgacggtgccaggggccgttgccggagaaggactgcgccgccaactcacgggcgggcgggcgcgggcgactcgcgaaggaacgacgacgcagcgagaaacgaaggggcggcgggcgtcggcggcatcatgtgaggcccgcgaccccggcggcgtctggcgattcattgggcggcgacggcgtcgtcttgaatcgcgggaggcggagtcgaaacgaagcgacgcggacaacgcgtccagggcaccgggaaaaatttgataatttgacatttttttcgttgcctaattgctttaattgacacttgtgaagatgacatgtgggaccatccgagtgaataaaagtgggccaggatgtcaaataatcgaaacccatttaaaggagtgttaaattatcaaatctctcggggttgatctgcaaaaaatgaggttaagcataccacttcggaaaagtagaaaggcacggtgttaaaccacaggcctttaatggaactcgatcactccatctctttggacatgcatgtgttaaggacatagcaaggctaattgcgggcagttatttgcaaaattgtcccacttccacccctacccatcggatgccgagctctgctatacatacgataaacatcgtacgattagtgtacgatgccttctaacctctaatgcatgcagcaaatatagggtccacaatgtttccatggcccaatcatttattatgcatgactggatcgtaacaagtttatcgtatatacagcaatttccatcggatgcccatccagagatcttgattggagttttcaaagtttgcacaggatgtctggtttccataggatacgctgcctacatagttatagggtaaggaagacgacgtcatgacgctaactgtgagatatggtcaacgtgcaaacatgctagcctcgtctttccgcttatacttatgtttatcagccaaaatttaaattttcaaccttaaatttgaagttgatttttgaggtttttttcaatcgaagtttatttttcagccttagatatggtcaacgtgcaaacatgctagcctcgtctttccgcttatacttatgtttatcagccaaaatttaaattttcaaccttaaatttgaagttgatttttgaggtttttttcaatcgaagtttatttttcagcctttaattttagatcgttaagaacacgtatataaaatttttatttacagattaattttcgtttgtaaatatatcgtttggctttttcagttttgtgttttacctgtggtgaaaagaatagtataaacatcatgcacatattctgttagtctggttagccttgtgttctgtttgttctgcctttctggtttttaagagaagttgctcagtaaaatcatgactaacagactagtgctgcaatcaacatatataccatcaagtagaacaaagatgcgggaaggcacttgatttacactgatggatagagcactggcatgaatagatgaatgaaatgtttgcaagtcgagttcaattacgtacctgttggatgttggctaatcatgtagagatctaaccatttgcacaagagtactcttcattcttcacagatcaaggactgtaaaattgagcaactaaaggttgtcgtctcatagaattgtagtatttaagaatcacataactctttgaacagcagcacagttttaacctaccacagtgtccagtagtgaccaaatccataactaacagtcaatagaatccataactaatatttcctatctccagttcccttccatcagaccacgggcagaaaactgaattaatggataaactctaccattttctacattcccaatgagtatactcacttaagggcaatgatgatgagtacatgagatagctcaacttaaattggagaccatcttgttcagaagtttcagtctttcacccacactggtaacttgacaaacaagagccacacatagtggactgtttctctccatactcctaactccttagtgacatgcaggagtactgcatgtttctaatatgtgatcatcattttccttttttcatcaacctattgtccttatcagcttgagaagtggcttatttcatgtcagcactaacacagtagctcaaacgtactttcatgtataaagggcttccattaagtcatgatgttgatattttgagttgcaaacatgtcccatttgctcttcctttcattaagcacctatatttaccttcaaattatatattgcactgagtgtatatcaccagacacacttaactgctaagcaatacaaaatctgcatccattatatgaaattgatcatccagatcttggttcagagacattaacatcaaattcaactgaactatatccaggaagcttgtcaacttttacttccttcatgaagcctcttattctctctgcatcactatacctcccagcatctgaatatatgtttgccaagctcatgaagtaaccactctttgaaggtgacatgcccatcaacttctttgaaattcgttcagcagcttccatttccccatgcactcggcaggctgctaatacacctccaagcatggcctcatcaggctcgaaaggcatttcctctatgagcttaactgcagcaacaacacggccatcccttcctagcgcatcagccatgcaagagtagtgtttgagctcaggtttcacgccatgccgtttcatcccctcgaatattgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38409 - DNA, 370 bp, Oryza sativa
ttatatggtgagatcaaagcataaaccatctatgtagtaaaagtgaacatattattctgttccaatccggcaaggggattgaaatgcacattctacttcaaggttcctcctttcttgccatcgccctcgttgccatttccacggtagagctcgagctcctcctcaggtttcaccgtctccaatggcttgaaggtgtagtacctgacgcagacgaagtagtagatgaggttgagcccctgcaagccgaagacgagccagtagtagctgtccagcttggctcggttgaggttgtcctgcagccactgcccgctccgctgcgtcttggcgtggatgatggtgacgagcagcgtgccgaggtagctgccgatcg

SEQ ID NO: 38410 - DNA, 10199 bp, Oryza sativa
  unsure (1)..(10199): unsure at all n locations
gtattggtctgggacccgtctcgttggcatatggtgaacctgtgtcggctttcgaaatgccttgtcatgaaagccttaaggtctctagacgtggccgttttgcacgggctggatgatccgggttagtaatgtcgtgtgggtaaagtgtaccccctctgcagaggttaacaaactgttcgaacagccgtgcccacggtcatgggcggatgtgaggtgattcctagcgtagttttgtttgactactgctttgtgaaattgctgctgtggaatgggttcgatgtttggaaaatcggcggctgatgggatcagccaggcccgggtggccgtttgaaagctgttggccgggtgccaaccttgatcaattcaaagactgatatattgcacatactccgaccggacgagacgcactgcttatccgtgtcgtttgagaagcactcacttagtcgtttcaaaaaggagtttaaataaaatcaattgcaaaaacaacagccttttctttgaagcctgcattaaacacttaattcccatggcttgctgagtactcctgtactcacccttgctctatataaataatcccccccagttgctgaagaagatgatgtggcccccgctgacgaagagttcttccaggagcaagtcggctacgatgagttttagggtttcggcctagttcccaagtcgcgcctgtgatgtttggtccaagtcttggcttccgctttcccttttgtaatgcagttgtgagctcaggatctgtccgcagcccaacatgactgtactcctactctataataaagagacctctgtcgctgtgatatactgtcttcctgtgttaccagcactgtttcctgggactggtatcgattaacaggttaatttggagcgtcacgggctagttccgctcggggctagttcggggcgtgacacgttgtccctgccctcgccttgccggatccgcaaacaccgtgaaccttgacgacaccagtttgactttgaccgaacatcttataacctaaaacggaggaagtatcttgttggaaacacactgttgattctgagctgttagcgaggtcgctgagccctaatttcttccataagtatgttcctggttgacatctggccagactgtgatctgctgtttcaaaggcagggcattgcggagggcataggtcacaatggggattgtcaatccattttttcttcatcatattgccatattggcattagtgtttaatatctgtctctcaaagctaaagcacataatgtctgatgaaaggttaacagcaccattctaaaaaaaaaaaggttaacagctgatatgcattcgaggtggagcgttgtttgcaaggggacagagctctttggtcaggtgaccgtgactctgaattggggcagaaatcattcagaaacagctgcatatcttgtagctctagctgtcttggtgagaagggtttggaaatttggatgcagttgtatgtgccaagacttaatgacaaattatcatgagtcactcggagaggagtcactgagggcatgtttggttgttgcctaatgttaccccttgccacaagcccacaactcaactcgtccttgtttaacattacacaacatgtttgccatgttggtggaccactgggcccctagcctgtactactactggacttcgatagaagacgaattgacttgctgctgccgactgctagtcgaagtctttcattaaacaagtaggatttgcgagatctattgctctgaactaggtcccgtataatttccttccccaccgggagctccgtcctgcactcacgcagtcacgccgcttggtctgttgtctttgtgcatctccgttccttcgtgcttcgctgttcccaaatcccaataccagccacgccgggttagttcactgacccacccgaagcttacactgttgcagtctaaatatgttgccacttgctgtcttgccatgtgccgaaagacaacatgggtcactccagtatctagtttacttatccatagaccacagctgttgaattgtgtgatcggctactagtacatcactgctcgtgattcagtacgtacaccgcggtaactggtaaggaggattcgcatcgtcgacaatggcggctgcagcggtggctgacgaaaatgggtcgcccaagaagacgaagcagggtggcttcaagacattgccattcatactaggtgatcctcctcgtaacctcgtttacacttccatatcttggtttggttcttgatggaattttcgttcagtgcaagtactgcatctcaagtgttcgattcgtgttctaagagtacactactccgtcaatgcagcgaacgaggtgtgcgacaggttcgccacggccggattcaacgcgaacatgatcacgtacctgacacagcagctgcacctgccgctggtggaggcctcgaacctcctcaccaacttcaccggcacggcggcgttcaccccggtgctgggcgcgatcgccgccgactccttcgccggccgcttctggaccatcgccggcggcggcgtgctgtaccagatcggcatgctcggcctcgtcgtgtccgctctcgtccctgccctccgccccgcgccgtgcggcggcggcggcgccgcggccccgtgccagcgcgcggacggcgggcagctcgccatgctgtacctgtcgctgctctgcaccgcgctcgggtccggcggcatccggccgtgcgtggtggcgttcggcgccgaccagttcggcctcggcgggaggcgccccggcggcgagcagaagtggagctacttcaacctctacttcttcagcatggggctcgccgtgctgctcgccctgacggtggtggtgtacatccaggagaccgtggggtgggggtgggggttcgggatcccggccatcgccatgttcgtctccgtgctgtccttcgtcgtcgggtacccgctctacgtgaaggtgaagcccgaagggagccccttcaagcggcttgtgcaggtcgtcgtcgccgcgttcaagaagatcaaggagcccgtgccggacgacgccggcgagctctaccacaacaaggagctggacgccgccatcgccgccgacgggaggctgctccactccgaccagctcaggcaagcattttcaatgcatcgatctctgtgtccttttacatgtggttcgttgtttattttgacgcaattcaacgtgtcagagagttaataacgtatttgccccaccacgtgaaggttcttggatcgagcggcgatcgtgacggcgggggacatcgccggctccggcgagccgaacctgtggcgggtgtcgacggtgcaccgcgtggaggagctcaagtccatcgtccgcatgctgccgctgtgggcggccagcatcaccgccatcgccgccgggtcgcacaacttcaccttcgccatccagcaggcgcgcaccatggaccgccacctcgcgccgagcttccagatcccgccggcgaccatgatcatcttcaccacgctgaccatgctcgtcagcctcgcgctctacgaccgcgtcctcgtccccgtggcgcgccgctacaccggccggcggtcgggcatcacctacttccagcgcatgggcgccggcttcgcggtcgccgcgctgggcgtcctcgccggcgcgctcgtcgaggccaagcggcgcgccgcggcggccgagcacggcctgctcgacgcccccggcgccgtcgtgccggtcagcgtgttctggcttgtcccgcagtacgcgctccacggcgtgggcgacgcgctcgccacggtggggcacatggagttcctctacgaccagtcgccggagagcatgcggagctcggcggcggcgctgttctgggtcgccggctccctcggcaactacctgggcacggtgctggtcacggtggtgcagagcgccagcagaggggagtggctccaggacaacatcaacagggggaggctggactactactactggctcgtcaccttcctcttggtgctcaacctcgcctactacttcgtttgcttccatttttacaccttgaagtcgttcgaggtggacgccggagacgaggcgcaacggcggcgagatgttgccgggagtgcagaaggagagactgagctctctgctggttgtgttgttgcgtcaagaaatggggtgttgtaagctagcataattagggagtgacttattgacatcagtgaagtaatttggtcagagctatctttcttttagcgagttcatattcaatcaaatatttttctggcatacgatcagaaattatttttttccgggataaattgatacatctcgccttgatattttacttgtttatgtaaacactgatcaaacagagaaaatcctttgaggacatgggcatatacacttcttgttcttgaatatatgacacacaaaaatacgttcttctattnnnnnnnnnnnnnnnnnnnnnnnnnnnnnttatatggtgagatcaaagcataaaccatctatgtagtaaaagtgaacatattattctgttccaatccggcaaggggattgaaatgcacattctacttcaaggttcctcctttcttgccatcgccctcgttgccatttccacggtagagctcgagctcctcctcaggtttcaccgtctccaatggcttgaaggtgtagtacctgacgcagacgaagtagtagatgaggttgagcccctgcaagccgaagacgagccagtagtagctgtccagcttggctcggttgaggttgtcctgcagccactgcccgctccgctgcgtcttggcgtggatgatggtgacgagcagcgtgccgaggtagctgccgatcgacatggtgagccagtagagcgccgccgcggtgctccgcatgctctccggcgcctggtcgtagaggaactccatgcggccgacgtccatgaaggcgtcggcgacgccgtggatggcgtactgcggcaccagccagaagacgctgatgggcagcgagctacccttgggcgcgtcgagcatgccgctcgccgcggccacggacttgcggcgactctccacgaccgcggccaccgcgttggcgagcatggcaatggtcatgcccacgccggcgcgctggaggtgggtgatgccgtttgggtggcccgtgaagcggcggagcacgcggacgaggacgcggtcgtagaaggcgagggtgagcagcatggcgaggttggtgaagatgagcatggaggccggcgggatcttgaagtgcggcgtgatgtcgcggtccatggtgcgcgcctgctggatcgcgaagctgctgttgtgcgacgccgaggtcaccagcaggatgcccgccgcccagatgggcagcatgcggaggatcgacttgagctcctcgacgcggtgcaccgtcgacagccgccacagcttcggctcgccggacggcagcacgtcgccgtccgtgataatggccgccttgtcaaagaacctttgcaagaacaaacagttgattaattagcccctaatcgcatcgccagttcgccgcttgctataggagttcaacttactttagctgatcggtgtggagaagacggccggtggtggagatgccggcgtcgagcaccttgtcctcgtagaggcggcttggctccggcatgacggctttcctcttcttgaaggcggcggctgcgacctgcgccagccggaccagggggctgccggcgggaggcatcttgacgtacatcgagtagccggacacgaaggcgaccacggcggcgaacatggcgatggtgggcacgccgaggccccacccccacccgacgttctcctggatgtacacgatgacggtgacggcggtgagcttggcgagctcgatgccgaagaagtagaggttgaagaagctccacttgggccccttgcgcccgcggcgcccgcgcgcgccagcgtcgagctcgagctggtcggcgccgaacgccatgatgcaggggcgcgtgccgccggtgccgatggaggtgaagagcagcgaggcgtagagcacggcgatctgggaggacgaggcgcgctggcagtcggcggcgtgcttggcgcagggcggcgggcggagcgaggggagcgcggcggacagggtgaggaagaccatgccgagctggtagatgacggagccgaacgtgatggtccagaacctgccggcgaaggagtcggcgatgaggccgccgacgagcggggtgaggttggcggtgccgtggaagttggtcagcgtgttggaggcgtcgacgagggggaggtgcagctgcagggtcaggtacgtgatcaggttggagctgaaccccacattcgcgagccggtcgcagaagtcgttcgctgcattcggtgagggatggcgggaaatgttacaacttcaaaaattgttgagagccagttctaaaataaacacaacaatttcctcctctagtccctgtttagaaaaggagaaatttacggtttcttgagagttattaagagctaggtacaaaaaaaattattgtaaattttcgtacattgtactgtcagaggtaccaaattttacaagtatgtaaaatcactccatattcgacttaagaaattagggaaaatataagcttgcaatggactttgctcattttgacatgtttttttaacaccgttaaggcgttaagttctctctgaatgggataagggcgaacacaagtttcggttaaaaacacatgaggacaaaatcacaattgaaaacagtggtaagaataccatttcccttttgagaaatagcatttttacggtccagcaatttgtacctcctgataccggtacctgtaggtaccaaaaaaatcgaaccgttcaattttagaggagtacgatcatgaggaaaaatagcggtggaggagatggtggcgggggtggtggaggcgacaccgcgatggaggaggaggaggagatggcgaccgcggagtaggcgccggtgaaggaggtggcagccgcggcggtagcaaagcagcacttgtggaggaggtggtggcggcaagggtggcgaggcgacggaggaggcgctgacggcgaagtaggtgccgacagaggaggagctggtggtggaggagatgcggcatgacggctgggaaggagacggcgcacacctctagctctattcatccgcacgcgaaattacattcttgcccctccacctctattcaccgcgaagtaccaaatcagaggcagaagtggtacctggcggtacctaattccgtcagctgttggatctgctcgatccaacggccacgatttgataccgtcaggtactgttggatggtaaaaatcctctttgagaaaacgctatattcttttagatagctaagtttgaacctacactgcaaagtaatgcgtactgaaatttccgttccactatactttagtactcattccgtgtgaaaaaatgtctgtattttttttcgccaagccggcaaatgtttgatagaaatgtttcattgatttattaaaaagtttgtggaaaatttgctctcagtcccttgatagaaaatgcaaacctgataaactcagaattttatatatatataaagggaggtgtcgagctcgtatgtatattctatcattctcgtgtttgtttctggtgaagggtgtcatgtactcatacctaattgtcgagctctttttatattcatcacaaatatctggagattccttctcttatacagtagttaagtatagaaatggggccttttccagccctagttaaaaaaaaagtagttaagtagtaattcaaaacaagggaaactttgttacagttttagcccttcatttccctcaaaaaagttttagcccttcatatatacgatcaaaaggatatttggatatttgacaaaataggctgcttgaatttagtggtcgtgaaagctttgccatagatctgattctgattctgcacgtagcaacagtagtgatatcgtttttttacaaggtcgcaaccacatgagagctactgtttggcatttttaggacttgggctatgcgtaaagatgatccttgatgctgttcgacaggtcgggttcttgggcgtcagtccaaagaaaacgtcatttcgtttcctacaagctcatggaaccgtgcaatttgtcttcgaatgtcgttttgactagtagacaccttgtttgactacatgacctcagaattaattcctactctatgcagctgcagcctggtggtatccagctagcccaagatccccaagaacaccgagatggaattaaacaaaaatcttttggatcaatctttgccaaactactaattttaatgatctaatcattcatgttctgatgtgatcatgtgagcctgatcaagcaaagaaaagaagcagcatttgtgaagcaaagatactaaaatcagattacctaggatgaacggcatggtcctgaagcctccctgcttcggcttcttcaccgccaccacgtccacggccttctcctctcctcttccatcctccgccattgttcttctccctcctcctctgcaggtgaagcttcacagttgcagcagcctctgctttctctctctctctctctctctctctacccaggagcaatgagctttcagtagcgtgtgagaaatggagatgctttttataaaggactcgcgcgaggttgagactattggattttggagcttcagagatatggccgtgccctgaaatgtccctgggaaagaacagctccaccaccacttgatgattgagatgcgacgccattgaggctcagcatccactgcagagtagtcagaatcgaacggcatcaaatctctccactataagcaagtactaacggttttttatttctgatccatatggattatctcattacatgttgtctgatttatcgtcaatatcactttgcaaatcttgcaggaaatgcgcaatcagcatgtctaatcatttgctcaagattagtctcaactctcaagtggtgggatatgttgtgtcacatctcaccagtaactaagaggaagaggaatagaggatccttggagatctgatcataacttggtggaatgtttggcttcaacgtaaccttagaattttccaacatatttggctaaacgaaaaccaggtggctttcttgatacaggaaattataagtgaatagctctttccaaaaggcccatgtgatagccttaaagggattacgagtcaatgtatctgtggagtttatatccatagcaatagctgttttagttgcttcctcagtcttttggcccttggcctttggcttttgattgtactgtgaacaattttgtttctactgcttctaatatattcggcaagtcttttgccgcttttcgttaaaaaaaaaaggctcaactctcaagttcaactacaaccaaaggcaaagatgtttttttctttttttctttaagtaaatgtatttattttccttttgttacttttgacatcatcacatatcacaatcatactaggggcactcatagtgcaagctacccaaaatgagaaacctcaggttaaggtcacacctcctctcccagacaacccctaaggggttgtttggtttgctcctaaagtttgccaaaggttaccacacctcatgttaggcaagtttgacaaagttagtatattgtttggttcatagccacacttgtggcaagattccttcttatctatttgggccccacgtgtcatcaactcaacaaagtgtggcacaatccaattttgctagctaaggtgtggctcactttttgtaagccacaacttaggcaagtgtggcacaaatagtatggtgaatagtggcaaacttagtatagcatccaaacagccccttagctttttcccgtcatcttctattctagtcctcacatgttttcaaactacatatcatataaaatttagcactaaacaccctaaaatctaaaaactagtataaaatttctccccctccctcaatctctctgttccccaatccaccacaaatagcgaagccggcggctcctcccaactggcggctcggaaggcgacagcggcggcgtgagagctcactgggcccctccaatcctggcggtggctcgacgacgaatctggcaccgcgcgagtggcggaggggggggaggcgacgacagatccacgatgccgtggaggctatggacgccgcgatggtgtcctcggtctcgtctccacggcgtgggagcggaagatggcaacgaacttggc

SEQ ID NO: 38411 - DNA, 11649 bp, Oryza sativa
  unsure (1)..(11649): unsure at all n locations
cagcagagaggggaccacacgcactttcttttttgggcgtgaggaacccggaccctagctaggaggcgcaaaccttgcaagggcacaggacccaccttttttttcctccacatcaacattcagcaactaggtaacgctccacgtagaagcattatgaaaggcttaatggagaagtaaaatatgaccatgccctaggactacaattctcatgtgaacatgagtgatctcgcactcctgtacaattaggataacgttttttaggaaactgttttgtctgatttgttagcgttatcagcttttctttttccctaaatccttaactgatcagcgtgattacgagtgacagaaatccacaagctaccgggcgtcactaccgtcaccgtcgacggcgacggctcggcgtgcagtgagcagtgagcagtgagcagctagcgcagtggcagcaccaccactgcaggtctgcagcagatagcagagattgtgatcttttctgctggtctgctagccactctggcagaaatgagacgggacactattgctacttgcttcctctgtcagttgccggtaacttgctacatggtcctgtgcatcatgtcctgcctctaggtgccacttccggcgattgagaagaattgcaagggtcaacccctttactttaaatttgttgccgattggggtatatgtgagtgagaggcagagatatttctgctgcagtacgtaccaagtacaccctcatcccaaaataagttctttttggttgttttgtctaacacaacagataaattatcaacaatgtcttatttaaaaaatttatgaaaaaaataaaaaaataagtcacacgtaaagtaatattcatatttaatcatctaatagcaataaaaatataatcataacagttttttaaataagatgaatggtcacacgttagaaaaaaaattctataaatagacttattttggaacggaaggtatactactctctgaagcacatcttggtccagattttgaaacagattgttgagtagattattgctaccgattatctatttaattatatggataaattgaatattttgataaataaatttaacaaataacttaaaaaagtcgtttaaataatacaatagaaatttttttcttataatatatattttaaacatggagcaaataatctgtaaaacaattccgtaaataattaagtaaacctcagcttgcaaattcctctaaaattaaaccctgaacctatctcactctcaccggttctcatccactggtttcttgaacagcagaagattatactctttttttttttggttaagcacagtaaaagtgcagcaagtcagaaccgaagaaatgtctactacactgatcagttaggccggtacaatcattcaatcatgtaatggtccattgtggtacagggatagcacagttggtgtgcagtgcctcaaatattaacatgcactccaaaacggatgatcgagaggcatttgttgtcaacactagctagttgatagaagccactatatatatcctaacatcattagattcaagcggctgcgcattagcactcagtgatgctcctactggtaggcttttcgctgaattttccttctttctttctttattttttgcatatatataatatgctcatttggttacatttatagcgacagcaaaagcctggccagagaagaaaaaatcctaagaaatgcattgcttcatttaaaaaattccatggtaaaaacacgcaaaaatttccccaaacctaggcaagaacgccgccaaatgttttttttgaataacccgccaaatgtatccactacggccttgtttggtttgaagaagattgagagtaaataattctacaccataataggtataaaataaatctcctccaatctctcctcttagcaattaatcaaacatggcctataagaaaatgtgctatatatggagcaccacaggggaggatcaggagaatatttctggtgccctggaagcacaaaagcaatactctctccatctacttttgataaacatatttcaaatctgaaaaaattacttttgataggtatatttcaatccaaccacctatcctcttaatgactttctcggatttaatgagtgactctccattcttcaacataagattggctacatgggcattgagaaatgcaaatattaatgaatcacttgtttacgaagaataactaggatcatgtttaaatggatgataagtagaattacttatccttggtcattgtgccaaataaaatataactatgaaaagtagatggaaggagtaccaagtaccgtaaaaatgttcgaattaaaaaaaaagaaacattagtgtctaacccatgtattatacttcctccgtttcaaaatgtaagactttctagcattgctcatattcatttagatattaataaatctagacatatgtgtatgtttagattcattaatatttatatgtatgtgggcaatgctagaaagtcttacactgtaaaacggagggagtatatgctattgatattgatattataaatattaaattttagtcatgttgactttacgaagtttaatgacttgtaccaaatgaagagtacggtacggcaacctatttaattttaatttcaaatttcggaactaaattaataatatactaagctgagagtaaggtacggcaacatatttattaattccaaactagaaaacctagtgcatgatattcggtataatctaggttataccgagattaataggagtgtaattaggatgtactctatccataaaatgagttaaatgagtttagacaggttcatgcctcactcaagataataactctgcgttttgttgcatgtgattggaaaaatacaaatacatatgtgtgttacacgggtctacaaatatgaatccttccctgagagaatagttttggaagagtgcatgtcttattagttaaagttgtaataatattagttaaaattaaatgaaaatggagggagtatatgtatacagaaatgctaagggacagggtcccatctctgcatccacaagcgatatccttaattccggatgctagcgtcatggtggtggcaagacggcgggtgcacgatggacaagcggatttgagcgagtccttgatggcaccggagatgttagggatgtattgtaggataagggtgtggaggtggataaggttggcctcctggaagacggcgagggagatgacgcagactgagtcttgatcttttcggcgtcataacagattattagtcactgtagacatttcacgtgtctaggaagtaggaagcaaagtggtagggactacctagtgcggcgccaacggagagaaggatcaccttcaccttgttgtcatcgtggcattacagttatttcttggcaaccgtcgctgcaccggaatagggacagggactgcaaggaagaggcggaaggaggaggcagtggaaaagcaggagaaggaggttgaggaggaggcacaatggcagtggtgagttagtgacaatagtattgcgctgacaataatgatctcatttagatccagctccatcatgaagcaagtatggtacctcatagatatcaggttgatacttgagcatcatgcctaatgtcgtagggcattgatggggtaccacatttgctactaggggtgggcattcggtctaaccgaaaatttcggtctcgatcttcggtctttcggtctttgacaagtgaagaccgaatttcagcgaaaaaatatcaggaccgacaaattcagtctcggtctcggtcctgaccaaaatttaacaatattttcatatatgcaaagaaataatggaaattttcaacacaaaaatcacaaaaaaaattcgtaagcacttatgagtaaagactcttattaggttgcatgcctagaagaagtagggatgtgaaaattagagtttaatcctattaaacatagtggattgtaggttgtatttagacattttttgataattcaatctttttggtctattcggttatccgaggagaccaaccgaattgaccgaacaaaattcggtttttcactacctagggccgaattgatgaccaaatttctcggtctcgattttttcggtcttggtctcggtctttcggttcggtctttttctgcccacccatatctgctactcagctggtatgtccaaaatgggacaccgtgtaatgacagcccccatacgtataacgcatattagtttggacccgtagtatcagcaatacgtacgatgcaataccttggagggggagagttgactaccaaattaagtgacgaggccaataccagatttgacacgttttagcaaccactagactcaaccactacgagcctacgaccagtaggagcaactaacagcgagaacaagtgcgtttcccacaaccccggtgctctggaatgctggaaggtaacgattactggcttgctgtttcaaatgattctagcgcatttggttgcataggtatagctactacgtatagcaaaatcagaaggacctttctttttgttgttgttgtcagtcgcctgatcatgtaggtcatcaggaaagatgggttaagaagctccactttgttgaacatgtagctacatcataataggggatatatccggtgaaaacgagttaagtgttgaaaactcgtaaaaatcatatctaaaagttttataaattcatgaaaaaaatactacatataagtgtagatatgaaatacattctcaccaaatttcaagttcaaactcaactttatttaggagtaacaaaaaagataaattttgggtgaatagaacatgacactattcactcgaaatttgtctttttttttctcttaaacgaaattgagtttggagttgagatttgatgagaatgtatttcatatctacacctatatctagtattttttttcatgaatttacgaagcttctaggtatgattttcacgaatttgcaacacttagctcgttttcaccagatatgtcctctttctaatatactcccttcgtcttaaaaaagccaacctcatattaggatacgacacatttatttttttttatggatggagtatctctcagttttagtccgtgactttatgttgatggaagctactcccttcgctccaaaatataaaaaattttaggtggatgtgacatattatagtatgaatatgaacaaagagttagaacatataatatccaaaaaaatctcttatattttgaaatagagggagtatcaagtagtagcaacctacttggactgacagctaagaggtcaattatgatgctgatttcttgaaatttatctgcacccagagatgtgaatcgatgtagtactatctgccattcctgaaaccaaagcaactaacaataaacaaaagaactgaagaaaaaaaaaggaccaggcgtagagaaatgtgaccagaacgaacggaatcaggggaggcattaaccaaggaaatgttaaagcgtgatcttctcttagagaaaaaaaatccctgtttcatcgccgagggatctccactctccagagcttctgcttgacggattccagcaatgtcggaagaggagagcaacgacgatgccggcgagcagatgccgcagcagggcggcatcaagaccatgccgttcattctcggtgaggtgttcttcttgcaatgttgctacccattttgttcttgtggatgaatgctgaggtgagatctcagattaatttgtgcggtgcagcgaacgatttctgcgaccggttcgcgacgatcgggttcaatgccaacctgatcacgtacctgacggcggagatgcacctgccgctggtggaggcgtccaacacgctcaccaacttccacggcgcgtccaacctcacaccgatcgtcggcggcctcatcgccgactccttcgccggcaggttctggaccatcgccgcgggctcggtggcgtaccagctcggcatggtcggcctcaccgtgtcggcgctcgtgccatcgctgcgcccgccgccgtgccgcggcgaggccgtggccgtggcaggggaagcttgccagcgcgcgaccccgtggcagctgctcgtcctctacctgtctctgctctgcacgtccgtcggcaccggcggcacgcggccgtgcgtcatggcgttcggcgccgaccagttcgagctgggcaagccaccgcggcggcgacccggcgaggccggcgcgccgaggtggagcttcttcaacctctacttcttcggcgttgagctcgccaagctggtggccgtgacggcggtggtgtacatccaggagaacgtggggtgggggtgggggctcggcgtcccgaccatcgccatgctcgccgcggttaccgcgttcgtggcgggctacccgctctacgtcaagatggctcccggtggcagcccgctgacgcggctggcccaggtcgccgtcgcggctttccggaagagaaacgtggccgtgccggacgatcctggcctccttcacgacgacaaggagctcgacgccggcgtctccaccaccggccggctgctccacaccaaccagctcacgtaggtccccgtgtttcacatcaactctccaactctaaattatctatgcatgtgtgtgatttatctttttaagattttttgaccgggctgcggttgtcactgacggcgacatggagggaggcggcggcgcacggccgtggcggctgtcgacggtgcaccgggtggaggagctcaagtcgatcatccgcatgctgcccatctgggccgcggggatcctgctggtcacgtcggcctcgcacaaccacagcttcgccatccagcaggcgcgcaccatggaccggcgcgtcacggcgagcctggagataccgccggcgtccatgctgatcttctccaacgtcgccatgctcgctaccctggcgctctacgaccgcgcgctggtgccccggctgcgccgcctcacggggcaccccgccgggatcacgcacctccagcgcacgggcgtcggcctcgccatcagcgccgtgagcaacgccgtggcggcggccgtcgaggggaggaggcggcgcgccgcggcgagccacggcctcctcgacgagcccggcgccaccgtgccgatgagcgtgctctggatggcgccgcagtacgccatccacggcgcggccgacgcgttcatggacgtcggccgcatggagttcctgtacgaccaggcgcccgagggcatgcggagcacggcggcggcgctgtactggctgaccatgtcggcggggagctacatgagcacgctgctggtgacggcggtgcacgagaggaccagaggcgaaggggagtggctccaggacaacctcaaccgggggaggctggaccgctactactggctcgtggtgacgctgcaggtgatcaacgtcgtctacttcgtcatctgcgccaagctgtacacctacaagaagctagaaacagtcgatggagtgagcacaggggagagaaatgacatagttgatgatcaggagaatgcaggggagagagatgagaaaggaagcgatgtaaaagatgtagagcttcagcctctgctactatcggatgtaacgctcccatagagatgtttttagagattttgggggtgtgttttttttcactgggaggcaactgttagtgccgagctccccctctctcagccgtcgtgctccatgttaggtttaatgaaactaatttaatattttaggtgtcgctaaatttttctataaacatagtcaaatttaacaaagtttcaaacgacttataatattaaacaaagggagtacattataagatgaagatggttgcaattagttctccgtagaaaatcaaatggggaaaacaagtacccactaggtttagcgggggcagcaatgaccgtctcctggtaacccacgaagacccatgtccaaatacaaattattaaattcttgaggtccaatcgacctatgattagtggataaatgataatcttgtgttcttgtcacgtggattatatatattgatatgtcgatttaatgtgtggatggtatgtattgcatcatatatgcgatttgagatgtagatattgttttaagtggagaactggagatgatggatcacgggatcaattcccgcacgggatggtgatagaaaaattgttccccgttataattggcagggacggaatgggaatgtatttccggaagagatcatctgtagttgatgcaccgtgcctttgtcactgacatgtggaaggatcctgatccgccacgacacctttgtctcgctgttgacactggccatcgctagccggccgtctttgtcaacactatcacatacaccctccgtcaaaagagagagagagagagtaatttctgacgaatatggaaacaacctatgtctagatttgtaactagaaattttttttttcatgagatggagaaagtagatgcaagtatgtactattttcaccttctcataaagaaaagtttattttctactccataccagtaaaaatatatgcataaaaacaagtatatcctcttatgttggaggtcctttgcttacccaatagtatatcactacactcgtttccttccattaaataataggggctttcagcgccagtttttatatattgaagacagaattctggtcaatcaaaatgcagtaaaattcggaacttactcatcaatgtaaatatgtaataagatgatgactgacaattattaaacaaaaactgaacgatcgaagcctacctcggatgggaacggcccaggatagtcaagatatatcaggttgatgcctacctcagataaaaccatgtacactattgccagcattatattagaagtccggatgatcacaggttattttttaataatatgaaccagatcctgctaactatataaaaatatgttagcaatcatttctcattgtagatacagaggtttgcattagtatagctgagttccaaaagggcgcgtattgttaatttctaaccatatatatctacctcgcgaaaatataaagaagactgcagatgaaactgggggatgaggtatctgtaaagtgcaatcgaactggctgagaaatgtagaagatcaagaaaaatatttattcgtaaagaagcactcgagacattcacataaaatttgtgggcagcattattgaataatctacaagattaaaatgccgtcctctaagttaattattatattgttattcctagcctagaaatttcactagtttattacatagcgacatggtatagactcctattatcctatagcacctttgatgtcatttacatagtacatactcgctcaatattttctatgactgcactcattacaacttctctacataaggagttttcctaggcaatttgctaccacggtgaatttatctttcaatatctgatacctacaatcaactaattacgcatccatactcaatattttacgaagcctttttggttttgtgctttgccaagagttgactctatatcgccatggaatagagaaagctgtttggctaaagcaaaaccacaatacataccatccacagaagcacttaatataccccctgcatagccagcaccttccccaataggatacagccctgcagtgatgtgctctcatatgtaccggtatttcgtgaaatttgcaatggggagcttgttcttgtctggaaacaggtagaaaattgcaataaataaaataaaagtaaatcgtagttgaaaagatagaattatagttaaaaggtaggtgacatgaatagaagtccaaagaaacggtgaaggattggagtgctttctaagaaattatcttgtgcattgaacagttcaacaggtcatcagggtgtgaagggcgacaacacagtagaagagactcggtataattaatttctcatgcagcagatactgcacaacttaggaaagaaaaggggaaccctacatgactatggtttacacaaaacagtgaacatggaaagaaactgaatgtactccatacaggaaatgttttccgtttaaggggttattaattctaagagcaatgtagcaacaggaaaagaaaaacgtaggtacagtcatagcgaatatggagaagaaatgataactgataaggacatcaatgttaaatatagctcagggatagagataaatgcgataactgaagtcacaagagaaggttcagtggaaggtggatgcagctcaataagaggtatctttacaatggcaataagtataggtcagggatttaggggtgaattcagtaggttaaagcctagaaccctgggaaaggttgttaggtcaaaaaaaatgggtgattatttcaaagtagagaaatcagagcatccagggagacccacgaaccagcattgacctctttagggaaagttggaagctaaaaaaatcaatgttcccaatctcataaagtgtggattttattgccttgccttgccaggcttttttccatttcataaactatgatataatggctttaccgccttaagtttgcccaaataaattaactaagaagaaggattcagtgtgtaggctagatccaaagagattggctgtaaatcataagcgacaaatttgtanacatatgggcacgttgctttgagattaagtaatgctaccgtccaatgctcaggcattggtgggattggagtcattggactaacactagactctttgatgttaaacaattggtttcaggatttaatgaatgaaccacaataaattctatggaaatagactgatgaaaaatttcgagcttgcatatgaatttgcatacctcgacaccatgaagtaatcctcactagatacaaatcctggcatctgaaaatattgggttgcaatgtcagagagatggtatttaaaaccacagaagaagaaaaaatagtgtgtgtcaaacctcttcctcaatcattattattgattgttgtagaacttcagttatgtgcgaagggaatagctcatggagtttggatggccgaactcccagcctatagcttgatggtgggagagttgtaactggaacagataataaagttaattaataagaagaaaagtatatactccgtatctttaccacctaataaaatcttagtacctgacaatctgttactgagaaaatctgtgacacactgtgcaggaacaacgaaattccctccccccatggtagctgctcttctttcaaattctctctgtttccatgaacatatacttgttaaatttgcatttttggaattgaacactaaagcaaggaaggaagaacatgagggaaatactacttaaaatggaattttatcttacatacaagaggagtattgtctttgcccattaacaaaagaggtttaggcaaaaggcagcacatggcatcccacattcatgagcaaatggattgcaggcacatgtgcacacagcatagtgatgactgacgcaagcgacaatctctaccatgctgcgtatccaatctatttgtcatactccctccgtcccaaaatgtatgatatcgttgacttttcgcataaagtttgaccatttgtcttattcaaaaaattatataaatatcatttattttgttgtgacttgttttatcatcaaagaaactataatcttaacttatactttttcac

SEQ ID NO: 38412 - DNA, 18987 bp, Oryza sativa
  unsure (1)..(18987): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggccctagggataaaattttctttttttatatattttctctatatttgaatttgaaataatcaaataatggttatgatcttcaacatcaatttaccgcagtgccacaatttcgggatatcctataacaaattccacaaaatttaagcattttgtagcaaattttatcaatatatagtgttgtaaactttaattaagatcttttatgctttgatttgctttataattcttacatgaatccgtttagtagaccgtatttattgtacgtgagttcgatggtagattcgatgttgattcgctttataacttcgtttgattgaaattggaacgatgcgacggaaaagttaaagtttgtatgtgtatgaaattttgatgtgatgaaaaagttaaaagtttaaagaaaaagttggtaactaaaccagcccttgatcaatatgatgaaaacattcaggaactttgaccagcattaactcgagctgacgagaatatacattccggaattctcaccattggttttgcccgcgtgaattgtcttcactgctcagtaattgcgctgctcgagcgcgaccaatggcctcacgaaaactccaggtggttcggccacggaaccagagtatggaactgattgcgtccttggcacgaaggcgaattttcaccgcgattttctccatttgtctgactcgtacaacctttcacctcctctttttcaccctttacccaagcaagaagttggtaaaaagaagggcaggtcacaaaagaatgaggagagcaagaaaacaaaaaaagagttcccatctcatctgcaccactactgtgtgacagcagcagcagccagccaagaagagagaagagcacattgcattattgcttttcctgcaacaactggggcaacaaaaagccacttggtactttgcttatttttatccacccaatctacttttgctccttttctcgcaaaaagcccccttgcacctctcccctcccctctctgtccggctccttgtgctctgcagaaaggccagttccgctgctagttctgggatgcggaaaaggcgaccgcatccagccgcagcatggacagatagctgtaggatctcatgcgccgcggcggcagcggcagcggcagctcgccgttgcgattgcgctgagctcaacgatccctcaacacgccggccggtgcgcttggcgcagggggaatgtgcagctgctgttgctgccgaaaagctagcgatccgatgcttttgtgtgtgtgtgtgtgttatccgacggacgaggacaaaagacaccgggcatctcggcggcgacggacgggctcagctcggcatctgatgcctcttctgatgttgatggggggttttcaggtaagctggtgggtttggttttcctttttttagttcttatgcaagtgggattttgatcgaattgcttttctggtgccttttgtgacaggaattttgtactctggtagttacattcaagaagcatacgcgcttcaccgcacacgtgcaacacacaagcacatccgtgagggtgaccttaacacattattactcaaaaacaatggagagaccgatagttgatcaaacattcgcacactcacatctccccgctcatccacgcgcaggtgacacggggaaaaaccctagccgccggccaccccctctcctctccgccgcaccgccgccggagcacgccactacaaaagctaagcgatatgctgggaagacagcggcatggctaaaacctggcgaggctaggtctccagcgtaggggagacaaagtgaaactggccacgacgtgcccccgataagggtggccgcgaatccaatgccggctccaccggatctagtctcctcgcagctgaatctaccccccgtgcgagattctaggtttagggtcccctccctaaattatggtttagggtcctaggttgggtgggggtggaaggaaggggaagagatggggacatcgctgaccttagaggggtagtcatgggaggcggtggccttatagtaggtggtagacacgggaggatggtgaggtgccaacacggcgttagagccatggggatgaaggatgatggtgggccagtgttgacggcaaggcaaagcgaagcttgtggttagtagacagcggccgacaatggaagatccggcaatagtgagaaaccgaagatgaggaagacgacaggaggtgggctcctcaccatcggtggcttcaggatgaggagagggaggaagggggtcttctctggtgctgttcgtgccttctagccaactggcaagaccgggcaatggggcggcagcagcgtagggcacgagaggagagagcgtcgtgcaatgggggtgggtatgaaggagggaggagaagagcgagggggttaccgggggagaggagtgtgcacgaaggcggcggggaaaacacgtcgacagcagagcttctcctcggcatgggaggcaaagcggcgtacgcacggcgggagacagcggccgaagcggacagcgggtagatccgcccacgccggaggctgatccggcctctcggtggtggatctagcccccagcggctagatcgggataggccgagctcgcggtggcggtggcgctactcgagctcgtggcagcggcggcgcgactcgaagctcgcggcggcagaggcgcagcccgggaggcatgggccagcggaggatgctctggcagcggcggagctcgtggcgatggtggcgacagcgggcagccggcgggccggtcggcgacgatggagaccggtgaggcgcaaggaggcgcgaccgatggtggtggaagccgacacggtacggccggtggcggtggaggcggccgtggtggaggctcgggcgaggcgtgtgccggtgcggtatgatgaggctggtcggcgtggtgcgaggaagtgcagccggcgacggcggtggccgacgcagcgggaggcgaggccggtattggcgaagcccgatgaggcgcggccggtggcagcacacaaaggctggccggggggggagggcgtcgatgcagtggcgcccacgcaccggcggaggtttaaatggcggtggagcaatgatacatcagtggtagataggcaggtggtggacggcgggtgaacccagcccggccttggctgggccgacaacgatggtgttcgagtgtcactcccctcctgagagcgttgttgtgccgtctcaccccctctaacgtggctatcgggtgaaaactcagtctcggttgtccttgagaccttgacgaacggcggcatcgatgctttcatcgcttctctccttggagacgtcgtctagacatcccattgccagaacctcccaagcaattggtgcaagctcgctctagattcatatcctcttgtgttagcgtcctagcttctgtaagttagccacgttggaaggcctaggggggacagcagtgtcattctactctctcaccctctctccctctatcccaaagatttggatagagtgggattttgtgtcggttgtaagggtcgggttttgggaaatctcggttgtgtttttttgttggcctagcggcggtcggtcacacttagtggcggccagtccggtgctagctttctactgggtcggtgtgtggatggtggtatactttttttttcccttataacctctcagggttataatcttgtaatttttttctgctctataaatagaacttcgttaaaaaaaagatttggccaggtgttttatatccattgtcaaatagacagtcctgaagactaatgcctattgtcgagtgtatgtagcaatttcgtgtttgcaccacacttttccttatagcaatttcgaggggagtataaggtatgagtagcgtggttggtaggaggtgaattcggtgctttgggaggattgtacattcaaccacaaccaggattacatgcttgggtaaattaagcctgggaagttaacacctgaacccttttaggctacaacagatgaactgattaggacttaggagtatacgaaattgctgaattgagacctgatcaacttgtcagtaccgaaattagagatgaggcccgtctttcccggcgatctttattccgagagctccatgtttggccaaaagtggcaaaatcacccaaggaagaaaattagttttgggacctaacaagtggcactatatcaacctaattgcactaggtttggtaatgacacaatccaattgcaaagccatgtggtgaaaatatcttattcggcaaattgtcatctggtctttattagtaacagcagcaaccaaatttatttctccttaattattttccatctaacgcatcagagggtaaattaatcagtgatcttcgtggttgtgtttcgctgatctaatactacatccgttttgtccgtaatgaatataaaaccttcattagcttttttttagtgataaaacacgtgtctgtcaaggtccactactagctgccactactattctattgtgctgtcaccgctattcacacgttaaacttctgtacttaacgtgtttgaactgattttgttgcgaagaaacttctctatcagggaaacttcagcagaaataaatttgttcggtatagattgcttctacttgcgagctaagataatggagttaaacatggttgaaacataccaagcaatttcattttaaggcagaatttaatattggtcctgttggaatcgtgagtcagaatgagccatttatattactgtataaatattctgatcctttttctcattggactcatgaaagacttcgtaatatgtggagcatcaaaatggtgccttccttggaagccatagctttcccagaattaaattaaatatatttctgaaagttagtattcctacaagtttgggctggtcagctgcactttacaacaaaaacggtcagaaaaatgtttatatcattcccgtttttcctctaaaatagatttttttttgagaaacacagtaaaaacgcagacgctcacaacgtgcgcacactcacccctataaacgcacacacgcacaccctacccctataagcacctccggaagactgggctggcatatcttgagattgacgaagtcaccacaggcgtctcgctgtcgacgggtatgtcgcctatcactgaaagaataattagccgtaaatgcgagcacctgtgtcaaatctaggatttgaatccgggtatcggtactattgggttattagaaaatattgaaaataaaattatcgaaatagagcctcagaaacaatatcgtaggagtaaggagtattagtgaatattccaagcagtttgatttgcatacttaataacggtactgtagcatcaacgatgacaacacctattttttaaccaatggttatgtttttcatattttgatgggtaatcagtaatttgttccaacatttcacatgaagacgatataccaattaaatggcccgaaaaatcagtatatcattttcggaccaagtaaaatcagaacggaattgcgacagaacttgcgacagtaatcagaataaaacgaccggtacaaaacggaagcgatattcatatcgttttcatcccaagtgcagcagttcagagctcctttggctcggtaagcggcgccggtgcagccaaacggccccactcatagtacttaattacgcttaagtaggcttaagtacgaattattgtaggtaaatcaggcttattaagcaggcctgtactacagaaagatggtttactaaagcgcaaataatgagtgagcatttaattgcggaaaatccaggcaggcgagagcgagaggattcatggatctcccgaccaatgtaccctgattctcctctgatgatagccagcccagccagccagcgagccagccggatctcgcaacccccagaactagacgcaagtacacgagcgagatatcaccaacagcatgtgccactgccaagtgccagccaccatcatcacacacccaaataaaaaaaaactaaaaataaaaaaaataaaaagggaaatcgcatttatcgcctctgcagataaacattgccggttgtcccagcacagggggagaaggggagagagagggggagagaacgtcaggcatgtgggccccacacctcggggggtggtgggcccggatcagtgacgccgggcgtggtggggccagcggcagatgagatcagaatctgggtttgtccttttctcggctcttcgctgcgggcctgacgcgcgcgcgtgggagtagtatctgcttggatcggagccccccaagccgttagctgtcaaggtggggtgtggggtagtggagagaggagaaaagcgggggaggggatctgatcgtcgcaggagcgcagggtgcagcggcagcgccactcaaccagcgggagcggctgctgctgctgggcttttgctcctcgcttgagcatggttggggggaggaggaccacaccatggtgtgccatcgtcgccctgtgcggcctgtgtagtgtgtgtactactgtagtactgtcttcctcgcactattttgtgtgtgggggcctgtggggaggggttgatgatatcgaatgtcctgacgtgtcccccctccctccctgtccatatcgtggctacccttcatatcccaaaataaatcaatttaaataaaaataagatattatacggtataatgaatttatacatactcttatctagatttatggtaatatgttacgttatatcccaagtaagattagcttagaacgaaagaagtagatctttttttcccgtgtttgtgttagacactcttcatcataaaataaaccaacatgatgtgatattgtcggtgacatgggaccgggagtatcatgacttagagacttgaggcagacacgatcacccacgtggcctaaccccctcgggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccgtcaggatgagagcctccaagcactcgtccttagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactgatcatgtcgtcagcagacagccatgttcccacgtcgcgcctgcttccggcggaagtggaggtaggtatgggctgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaaaggggattgattttcggatccagaaggatcagagagggagagagtaagagctctctggttctccagctcttttgtagcttcttcatacatagatccacaaaaacacaggagtagggtattacgcttctcagcggcctgaacctgtatacatcgcccgtgtcttgtgtgcttccattctcgcgaaccttccacacacagactaggagcttagaatctcacccagggcccccggccgaaccggcaaaggggggcctgcgcggtctcccggtgaggagccccacgctccgtcatctggcgcgccaagtagggggctctgcgagtgatcttctgagctctcgcactctttcgtgtgcgccaagcttttcctgttcagcccaatggccgaacaagcaaaggcgcacaacctctcttcgagcgttagtggtgacgaaggggagccaaacccacgccgtcgagctcgtactccaccgccccctccacgccaaagtcctaggcgggaggaggcgctcgagagggtcgaaggatccgcgacttcgacatccacgggtgatggggaagggcggcgagatggggagcgtcgcctcctcgtctacggcgacggcagcacgccccagggcgcgctccaagctgcgggcgtgctcctacgtcacccgcccattgtccctgacccggagtctccagcccaacgttggctggacgacgtggccaacttggtcatgacggcacggcagcgcctaggtgctggtgggcggtcctccgccaccaagacccctggcgctgctaccaccggctccgtgttgtcaaggcggagggcgcggcgagcggcggctgttgctcgccattcagccgccactccttcgtcagcgcctccgacccaggaagatctgcgtggggggccggatgcccgcatcagtatcgagcgccggcgtaatggccggcgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcaggggggggtgtgcggcacaaccgcatgctcgaaaagatcgcctccaaagagccccagactaccgcggagctttttcagctcgcggaccgagtggctcgtaaggaagaggcatggacctggaacccctccggttccggtgtggcagcttcggccgcccccggatccgctgctcagacagggcggcgtgacaggaggaggaagaagaggtcagcctataccgacgacgagggtcatgtcctcgccgtcgagggcgcttcgcgggccacccgaaaggggaggcctgcgggcgacaaaaagaaggaggccggcgctcccagcagggagcgcccaaccggcaagtggtgcatcgtccacaacacttcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccctggggatggtgctccggccgtcccagccgattatcggtgtgacgccggggcacacttggccgctaggtcatatcgacctcccggtcaccttcggtggatccgccaacttccgcacggagcgggtgaactttgatgtggcggacctcagtctgccctacaacgcggtcttggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggcttggcacatccgcccccgccgccccgaggcagcggatagtcacatacgacgaggtcccggtcaaggaggttgccctaggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggaaccttaccccctgcctcgcatagatcagattgtcgactccatagcggggtgcgacctcttgtgttttctagatgcatactctggttaccatcagattcgcatggctagggaggatgaggaaaaaactgcattcattaccccgataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagaggcccccgagctgaacggtggcccaaggcccccgacgaccggagcaggccctctgcccgcttgtcagacggtgccaggtgcccccgacccccaggacggccccgaggccactgcgggaaggccgcacctatcgccctctgaccccgaggctaaccctgtgccgattcgacccaggagagagcagggagaagaagcccccgagccgaacgatggcctaaggcccctgacgaccggagttggccctttgcccgcttgtccgacgacgccaggagcccccgacccccaggacggccccgaggccactgtgggaaggccgcccctgtcgtcctccgatcccgaggtcgtcggcacagaagacgagtgcgccccgcaaggccgcttgggtgaagagcgccccagggatgcggcccctagcgaagaggatcggccccaccgaaaggtgcagcggcccgtctactttgttagtgaggccctccgggatgcaaagacccgataccctcaggcccagaaaatgctttacgctattctgatggcctcgaggaaactgcgccattatttccaggcgcatcgggttacggtggttacgtcttaccccctcggccaaatcttgcataatcgagagagtactggacgggtggtgaaatgggcaatcgaactttctgagttcgatttgcactttcaaccacgccacgctatcaagagccaggccctcgccgactttgtggcagagtggaccccggctcccgagcccgtctcagtccccgaagccagctcgggcccctcgcagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgacttccagctggtcgttaaccaggtctgtaaggagtaccggtgctctgacccgcagatggacgcttacgttcgccaagtacggcgtatggagcgccattttgacgggatagagcttcggcacgtgcccagacgggataacacggttgccgacgaactctcacggctcgcttcctcgcgagcccagaccccaccgggcgcctttgaagaaaggcttgcccagccgtcggcgcgacccgacccgataggggagacggacgcgcctgacagacccccgatgcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcggggacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccgtgcagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccacacttaaattcattaagggcatcacaacccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagacgccttaaaaccaagaccttcaatatcctcaagaagcacggcgattcgtggattgaggagttgccagcggtgctctgggcgaaccgaaccacgccaagccgagcaaccggggaaacgcctttcttcctcgtctacggcgcggaagcggttctcccatccgagatcaccctgaggtcccctcgggccaccatgtactgcgaggctgatcaagatcagcttcgcagagatgacctcgactacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggcccggggcaaccccgcacccccctcgggtgtgcagggttggccgggggctaccacatatgcatattcttatttctcttatatctgtatttcaataaaagcattttcgatttcctaaaggctgtatctgtgctgttgtttccttttaaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaagaaccgcggcacagacatccttgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccgatgcacccaggtcgccagcctcgtcgccactatcgcccactccgtcgtcatcgtcctcctcgtcggagttgagggcgaacgcgagccgaggggccgaaccctcgaagctgtggacgatatggtcggcggcatcccaaacctgcgcgcgcgcgccatcctcggtctcgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccggcggacgagtctagcgcgccctacagatcagcgatggtgtgttcggcagctgcgaggcgggcgattaagtcgctttcgcccgcggccgccccgccgctgcgcgccctcgcgtccagctccttctcccgcgcctcgagctcagcggcccgctggttcagcgcggccctctcagcgcgggcaccttccagattacggcgcgcttgttcctcttgcgcagcctcgcggagggacaggctgtccgccagccgttgcgccgcggcctcggcctcatcaagagctcgctcccgctcggtgagcgcgtcctcgcggaggcggagcgcggactcttcttcggcacaggcggcttcgtgcaccgccagtgtgacctcccgaatagcaacggcggccttgcgatccgccaggtccctctccacggcgctggcacgctcttccagcgccatggcacgggcctcaagggtttcttcgcgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcgttcatcacggtggtggcgatgagggcagccccccgctcctcctccacctccttggcgatctcccccagcaccttccgacgggtttcgagctctgagacgtgccggcggtgtgccttgcggcccacctccaccatggcctccaccgagcgtcgcccctcttcgacacgcgcccatgcggcgtcaagctccgcccgctctgcttgcaaggcctccacctgggcacttaacccgtccaacaccgtggtgtttgcaacggccaaggcctgcagaaggggttctgcgctcagtggagcaacggaaggcgtggggaagagccgcctcggtgaggatgccgcgcggctcggcccgccgatggacgtgccggactcagggatgtcccccggacctggcttgtcctgagcgtcgcccgagggagtgggcccaagcgatgcgcccgcggcctcgtcgcgagctgcctcggaagtcgtcgccgcctcggcctggcgaagtctggcctcctcccgagcggcttcttcagcttggcgagctcggacggccacctgggcggccttctcggcttcccgaaggcgatccgcggcttctcgccggtcagattcccgcctctgggcctctgtggtcgccgggtcctcggcctcagactgaccggacttggaatggcgggagggacgcgacgggatctcgcagaaaacagaagaaagaccagaagacaaacaagatggatgagtgaaaactcgcgttgagggaatgaatacggccacgatgggcgtgggacgaacctgcgagggggtcggttaaccgaccaccttggaggggaaatgaggtttccccgggatggttctgtccctcccatcttgcggagccgtttcttcttccgctccccctcgggctgcgacgtcggcgtggccccctccgggcgcctgctgccggcacgcgccgccccgccccctcggggaggagatgggggaggggttccttcctgcttcctcttctcccgggcgtcggcagggtggccgctccccgggcccccgtcgcggggcccagaagcacgaccccctcccggggtagattgttcccccctgcggctcccgcccgcgccatcatggcctcgaggagcccgctcctccgacgccccgaccgcctgcatgatggtcaggatggaggcgcggtctggatcactgcagagggggaggactccttgaggaatgagggatgcctccacggagctgagattcagcacccgttggaccactatcttgaagtcctcaggagcccagtcccatttgaccccccggtgggtcctcatacagtcctcggacccggtgtactcccaggcaccccgggcgcgccgctggagtggcgcgatccggcgacgaagatagtcaccgtacaccatggcccctgtgagccccagggatcgcaggcccgccaggcggtcgaggacggcgtcatagccatctcccagatctaccggcgcccgccagctggaggcctgcgccgggggctggctcggaagtcggaggcgcgcttcgtcggcgaggggggtgtagaaccagtcgctcttccagtcatcccacttcttgcggaggacgcagggaatgtagcggttcaacaccggcccccgcggctggaagtagcagccaccaaccaccgacggcggcgacaccgactgtattgtgaagaaccaccggaacagccgaagggatgggcgcaccccgatgaacatctcgcacaggtgcgcgaagatggccaatgtcattaccgcgttgggggtgaggtgcgccatctggagatcgtaaaacttcagaacatccatgaagaaagaagaaaatggcggaaccagccctgccattgcaaaagggaggaagaagacggaccgccccgggtagcatggcgccgggtgtccctcgcccagcgtaactatctcccggccggtggcagattccggcatgaagcggcgcggcagcccgccctgcctctcgctcacgatgcgggaaggcggcagcacgctaccatcaagcaaagcggagccccgtgccatgacgccggaggaagagatgtttaagagcgagcacgtgtggcgaaggtagggcacaggaaacaaggagttagggcgcaagcggcgaagacaaggggaataatggcgagaggaaggaagcaaatctcttcctcggcgactttatacccttgccaacgctgtgcccagctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccaaagcgccatcaccatatctccaggaaaaacgaaccggcttgtcccgatttttagaccggccccaccatgtcaccaggccttaggaagtggcgtcacgtccgaccgcttccctcgaggagggcgatcgccctggcataacgccgggggctactgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcgg

SEQ ID NO: 38413 - DNA, 13835 bp, Oryza sativa
gattttcggatccagaaggatcagagagggagagagtaagagctctctggttctccagctcttttgtagcttcttcatacatagatccataaaaacacaggagtagggtattacgcttctcagcggcccgaacctgtatacatcgcccgtgtcttgtgtgcttccattctcgcgaaccttccacacacagactaggagcttagaatctcacccagggcccccggccgaaccggtaaaggggggcctgcgtggtctcccggtgaggagccccacgctccgtcagatatctattcagattttattttaccgctagtatgtgtcacattttatgctaggtttgtttatggctcgaatcttttcgtattcgtgaaaatcgagcatctttttaagtttcagcagttttgtaaaccccaattgtatgatgcttaattttgcctatgcatatccttttcttagccatgacataagaatttgtttttctatctaacaaaacggtagtcacatatagcttggacaaaattaaccaagaaatcgagcatttggtatgcggcatcgtactaatagaggaaaggggagtgaattcgatctgaagtcaagtctgaaccgcgcgattgtgacagcatcatgccacagtatccgcatcaagtacagtacaccaatcaaggctcctatcggatggcctaatcagccaaagaaaaagccaaattttaaattttcaaacttaattttaagattgattttaagatattttcaacgtagtttcttttacaacattggcttttaaatcaccaagaacacatttataaaagtttcatctacaaatttatttttatttactaataagccggcttattaggaaataagccaaacaatgggacccaattgaaaccgagccccctccgcgatcacgccttgtcggcgccgaaagaatcatttacgactggccctgcaggccccagctgcagtagtagctgcgactttgatccgtgcgaaacatgtgaccgaatactgatgtgtcgcgcaccggatgctcgctcggtcaccctccgggagccaagccagcaactcggacatggacacgggcacacggcgctggtggattggttgaaagcgagagttggggtcgtgctatgtgcgtacgcgtgtgatgcgtcgtaggggaggcgctgcttgtcgaatcggcggtcggtcggtcgaatcggcgtatacgtgtttatcgtctcacgcgcatgcgtcgtcgatcggtccgatggtcggaacagtggtgatgcatcgctttctgctgggatatcgaaaagagggttccgtagagccgtatagccaggtaggtggccggcgatccggaaagggattgcgtacctgagatcgagtgtctaacgctcggagggcaaaatgagtagttgcatacttgcattggctcgagtatatactgctttctccattctaaattgatttatatataattttttttaagattatttctaaatgatctacatatttatttttatttattagagtctattcgttatttgtgcattggagtaaataaacattgattcatacatccatacacataagtatttataacccacatgcaatatcttgatttgctattgactagaaaatattgggatgatgcattcattgagtttgttgctagagtaaatatagtatgagagttattagcttttcttggtattggtgtacttatgaaatatgtagatcaatttggaatggatggagtatatagcataaaacgacactggaggtagtaaatagtgacagacgtacaggttctgattttttttttttgaagactacaggttcggaattggattggctgtgttcgtttcaacccactcccaacccctctctctcgttttccgagcgcacacttttcaaagtgcgaaatggtgtgtttttttaaaaaagtttctatacgaaagttacttaaaaatttaaattaatctatttttgaaaaaatagataatacttaattaatcacgcgctaatgaaccgctccgttttccgtgcgaggagatgagttcccaaccccaggaagcgcgcactctgcggctctccgctgtctggtccagtagctaagcccaacctgatcaatttttggtgggcattggcccagcatgagtccaaaaacagcccaaggttggggagaggaatcgtaaataaactctaaattctataaactgtaacccttgtcagctcatctgaacatcgaagtttagataaagatggcatacgatgaattgaaagaacgaaatgtcgaattatgcagtgatttttgtggcaggatgaattttctctgaacagcatcctgagcgattctcttttcttctaaaataacagtaggatcttgcagctttttcaaaaacaaatcctggcaatagtttattgtggggaagcaaatcaattaccctggcaaattttaaaacgtcaggtcgtttacggtttcggtccactaccgtctaccgtgcttggaagctgaatcagtgcatatgttcgaactgatacgcagactagtactattgtttgtaaattagtgcacaataacgtctcatcgaaataggaattcttatacagctatcttttgacgctacacggaagttcgacgctgggaaagtttgactacaaatggactcaacatatgacaacacaacatagcaagttttaacaaacttggcgcattccagcaagtaggatctctcagccatggttgaaggactggtaaaccggaacctgcaaaagtaacatcacatccagcgcttagcaactccaaaaatatattaccaagtcccgtaaggaaccaactaaatgacccactattggcataaccacagtaaaatcatagtgtacgatttgtatgcaaaaataagtaaataaccaaatcagacctaaacaacggaaaaccttacatcaggctaacttcattgaaaatatcacgactcattcatattcttttggggtctatgcaagcaatggaccatacccaggtactaaccaccgagaatggcaatagtagaaatgatcatgtattgatttctaaccttttgtatattgtatagctggaaacatcttttaactatacaaaaggttagcctaccgaatttgggccactaatgctagattttaaaaactctaatccacatagactagatacaacacacgctataatgtgtacaataattgcacaaatgtactgactttatgatatgaaaggtcaaaacccagtgaatggctcacctgagaaatcatatgcccaagattgtcatagcaatgggggtatatcattgctggagttggccactgtgggtagacagcagttccagaagaggagcccatagataaatcgggttggccaaagtacacagaaggttggtttcttgacatattagcagactgcataaaaccaacaccatactgcataaactgtggcacaacaaaattgaagccaccaggactcacattgaagtcgtgcactgggcccctaacatacctgcaaaaagtttacatgttacttcttagtaatctcatcattgaaatccagtagttgaagcagaatttgaaaggtgcaactaacctcttgtagttacgatcatagtcaggatcactacgatccttttcagtgtccttaaaaacagcaactctggaacggctgttcattgtgttcaccttattctcatcaacaggaggctcaacattaattggttcatctctcgcaacagataaagctcccaaatcacttgtgccttcaatatcagaaatggaaccgttgaaaatgcgtgctcgtgctttgttgtattcctctatcctctcttcaacagttcttgctgcattgttcttggcaccggcatcacctgcaccattttggaaagccttgggccttggacaaataacaaacttaagcttctctgcagcttcatgctcatttcttgcttgtttgctgggaacttctgacaatgcaataactggaagtttgctttcagatgttttctttgcaactatcttgctaactgaaccatctactaagctatctgctactgtagtctctaaaccatagtgttgtgcaacacgatgagcagcacagcggagataagaagttggaaaatgctggaattcgaattcatgcagttgaggattctgcataaatttctgtatatccattgccatacgcaaaactgcagttaagtagaatatgatagtgagttatgtaatcagaaagaaaattcaaataaaaatacattattgatgaactggatcacaaaaaagaggcttaattcaggtgaaagattcacaattcaaagtcgtggaggttttttgagtttagtgcatagagaaataatatgacagcactagcacaaaatgtagttcgatgcagaaaaaataaacagcactgaaagatgcaaagacaggatgtgtcgcctaggcaacataatccagggtttgctttaatccatcatccataagaacttgaaaagaaaggaaaaaagaagataaaaaagaaaaatagctgcaagtgaaaggagctcagctcatactcatcctctcatggagatactgaaatgagactcaccaatcaccatcctccctcactgtagctttgttcttatgtgtaccattcatatcaacaagaatggctctatcggtgtcatatcaacaagaatggctctatcggtgtcagctatagactaagcagattaatccaaacaaaaatgttcacaatgcattgagctcaactactcaacatacagtattttcatccagctctagctgttatttcaacatagtagttttgagaatagaggacagaaaccacatggaaattcctccaagaaataaacatattgttctggtataaccttacaagttaatagcatggcactaaaaagttatgatgcctataattgattcatgttccccaatcaatttctcaagaactttaacaggttcaaatagtatgtgactaaaattcgacatggagtttccagcacagtgagatgttcaatatcaacttcaatatgttacctaatttctaaaaacaataacctaagttcaacatcagtccattatttattgataagtccattcccctaccacaaacaattagcaataacatccacacgtttacaaatatatcagcgacaatgaagctaactccttacatggctctgtcaccaaacaaagttatagcaagctgcaacaaggaatgtgctgcaagcttaagaggtagacagattgctggaatccaacccaatttcgcacggatttttagcaaatcaactgtaccaccgccctctcctagctacctcgaaccagagggaaacctagtccccaaattgcacacctagaatacgccgggaccaaaactctagcgacagccggcacaaatccgagcctaatccgaccgcgaccaaacgaattcgccgcacgagcacacccaaaccctagccgcgggcagagagctaagatgagaggcagcggttacgtacccatgaggcggtggcgagggttgtcgagcgcctcgacgaggaagggatccacgtgcgaggtgaccctcccgtcctccgcggcggcgggcggcggcggcgggggcgaggcggcgccggagctcatcgtgcggcggcggcgggtggtggtggtggtaggggggagggggggcggcggacagagagagagagagggagggggggaagctgggcggccgggtcgcctgcctctctcccttccttcccctctcctccgcttcccgatcccgaagcggctgcggcctcctgcggacggagagagaggaagaggcgtagcccgagggaaaacgagagagaaaaaaaaaaagataggtccgcagcggcagcacggctcctgatttttgacgcccgcgaggtgccgtttgattcaggatcggtgtcggggtcgcgtggaacggctgtgaccgttcgagtcggatccgacgatcggaaataaggtttggggccttgggttgggggttcgatttttatgcgcacgatattgtagatttgtagtacttggggtcctattcagtctgaacaggattaggattgtgctacgctgtttttatctacttctggagagctctcaatgccacatttttattgtaacttgtagtagttgctacgtggagaattcgtatacaatcaaaacaggattacattgtttatctacctttagaaagctctcaaggtaaaactttttaattgtaacttggatcattgctacatggagtactcgcatatcgttttaaagtcacgaatttcaaatggtaccaagagaagaaatacgtatataatgtgacatatgtaagttcttcacgaattacaaattctacataagttcttcacataaactttcaactacatattgcaaaagactagtataaagtgacatatgtaatattacaattatatgtatatacgctattagtctagaagcctgcgcctctgtaatatttgtaatttatagagtagaggcttatgcatatatgcgaacatgtatttcgtttttgtgtgaggcgtagtgtgtgatgtgtcctttccattttaaataaagctagcgagaaaaaaaatattaagctagaaaattcgtatgttatgtcgtggaagattatgtgtatccgtaaaacataatgtttatcaggatatatcgatctctgtcggtcgctctgagaaaatgtgagaaatgatccaaatatataaaatcgaaatggccctatcgcgcgatgtgtctcaaagccgttcgatcatgcgccgtgccgtggcatccatccgtgtggggcttcgcaggtgtggctttgttgtgaaggatctacaccaccactctgaccacaccttgcaatctcgcacgagatccccgttcactgtttgaaatcgagagtcgcacaagagagcgagatgcggaggctgcagtttctccccaaatccattgatagcaacaacaaccactgatttcaagaaaattataaatgatccccttttggtccgtgatttcaactggtttcagctccacatttagagattttcggacagattttaagattttatcatatgacctaaataaatcgactgaaaccctaacccgccgtcggccaaaaccctagctccccaaggtgccatcatcagcatcgtcatcctcgcagccatcaactagggttgagggcagcggatccgcccctcccgaggacaacgttgctggatccgccgccattgagctccaccgtcaccacccgctattgtcgtcctcacccctcccggtgccaagggcgacaccaccagatctgccgtcctcaagctctgccgtcattatcaccccctcggagctgagggcggcaaatccgcccctcccgaacctagagggagctgctcccgagcccactactgttggcctctctcgagcattccgttgtcactcccggccgcgaccggcctctcctgagctcaccgtcgttgctcccgcccacggccaaccgctctcgagtctactaccgttgctcaggagaggagtgcccggatatatgagggagatggaggggaggataaggagagagaatgagggaggagtggataaaaatgagggagtgggacatttttttaggtggagagaggttgactggacttttcaccacgcgagcgcccaggaaaatacattttttcatgttgatttttttaaggagctatatgtgaaaatgctgactgatttttacagggacgaccagtggtggtcagtatgcaatctataggataacctcgtcaaaaaaatcattttttttaatagtgccatgatgaaggtaaccagtaacgcgtgtccttaacccattgccaggacatatagagatgagataggcagatagctcgtagtagctccctttatcggtagcgctatccgtcgagttaaacagttccgcaacaaggagtggaggccgaggatgacacgcacgccggaaagcgaaaccaatggcgcggcctgccggccaggacggctccgccgcgggtagcccagcgaaaaatttcggcaattttgcttggtccaacgcgcaggctcctcggcgtcggcatcacggcgggggaagcaaccgcgtgcgtccacatgaaaacgtttgttttctcggcaggcggccgatgtttgatgggttgccgacttgccgtcgttttttttgcgcgttagcacaagcccagtcacgatggcacattggcacccgtacggccgtacggtccatcacgtgtaggaaattgtggtgggtgtgtgatcgcttttgctgatgacccgtggttttttttggtttactgttaggatgcttcttacgggatgaaaacagctggaaactatcggaatcggcagcgtctctttgaaacggatattcgattgtaatgtttatcatttaaattactcaatttttgacgttaatacaataaagaggatattagaaaaaacaaaatttgtatatagcaaaaaaggtaacggtcgaaaacggtatccattgtatggaaaatgacactcggtcgatcgggaatttatgtgatcattttcaccccttcatatcttggcatgtgaattgtgaaatagaagctccaactcctcggaaaaaaagacccctttgaatcgtataaatggaaaaaggaaggaatagaaaaaaacatatgattatgataggaattcaatgcaaaataggggattgcaaaaaaaacacacacacaagaatgatcttctgattgattggattgtagaaaaacatagaaatcagatgggataaatatactcgaagacaattttccaaaatttagtacaagacatccaaaaatgtgtaattagctgggagacaccgtaagaatgcgtatttgctataggacaccacgaaaaactggtaattagctgctggacaccagcaagttatttcgttatatcttgaggaattggagagagaaacaacaatgtaagtacaattctacccttttgattttttttttctttttctctattcttctctactccttccttattcttttctacctctcattctttctatctctactctttcttcaagcgagcccgaggggaagggagagcgtcggcgacggcaccgcgaggcgtgggccggtacgacgcctcggctggggcggcgttgcatggtcgcccgcagggggccggggccagcacaacgcagcgaaggtggcgccagagcaagaggggaggtggtgccgacacggttgggcggtgtcgactcgtagtcgtaggtaagggcagccgggctcggcaagcgtgatcaggccaggagcgtggtggctccgagccggctttgggtagctcgaccggatggcgtcaggtgcttcagtcgggctcgggaaagaagagcgtgaagacgacgttgggcccattgatgcgatagcagtggcccggtaaaggaagggagtggctgagtggggaggccggccgccgcttcgtcctatgccatcggcggcctccccaggcttgctaaagaagagatcacccccatacccgagatccccatccaacctaactctattgggcggctgcaacaccaccgcctaactcccgccggccgaaggaactccttgtccacccactcgcttcgtcggctccggcgagtcgtcgctccaccgcccaatctggaaagaaagagtgagatagagaaaggggggcttacatgtgaggtccacattggattcatttgagccaagggcaaacttgcctttaatatttttctctctcctattcattaaaaataataaaataatatcgcaggtatccaacagctaattaccagtttttttgatgccctaaagcaaatgtgttcttacagtgtctcctaactaattacatgtttttttgaggttctgtagcaaattttgcattctccaaaatatttacaatattcttcattccataggaatttgagaggatacagtaagatttaattctttgtattaaagctctcatataaaatttttctatatgataaaaattctttaaaatttatatatttttcatgtgaatcaaaggaccccgagaagccgccaatttcctgcggtgatgaggaagataaatatgttaggtcccacaatttaccgccaattgcctatggctgcagttgcctttcgttagcaatagcgagcggaccacacatctcgtgagaacaggccagcatatccacgtttgccttgtgaacgtatggtactgaaaaacaaactaaagagaagctatgaactttcaaaaggaaaaacgaacaccaaaaggaaaaagagcccgaattaccccctacatcgcaaataaagtcattttacacgttaaactttttaaaccggacagaaaatccccctaacccaatctgaagcgttttttttaaattattacacagtacaacgcagacactcacaacgtacacaaactcacccctataaacgcacacacgtaaatcctacctctatgagcatctttgaagactggaacggcaaatccatcctggagattgacgaagccgatcaccatagacgcctcgccggttttgattgtagatgacgcacgagtggtagtctagtttaggggggaaaacggttttattaaaattgcgatgacatatttttaatgtcaaatcacagtcgattctttttgcattgggtttaggcggatactcctgcttgtttgtgcattgtgacccagcgtgttaggtctggaccgcgtgagaagtaaacatggttgaatacagtgcaaacgatgagtaacgaagggcatacccctacacgctaagctaaatagccatgcagcgctttattacgcattcgtataaaaattactctacactgtaagtattacaagttatatagggcaagttttaaaacatagtacattgtaattaggaaaaagtaccgatcaccctcttaaactatagcagttgactaaattaccccttaaactcaaaaaccagacatcgttcaccctcaactattcataccgaatgaataatcccctaagcatcgtcttggatggttttaacttgagcttacgtacgtggccgccaacatggcatccaatcagcaaaaaaaattttaaaaaatatctaggcccacatgtcacctcttttctcaagcaaggcgtccctaatccccattccccctacttcctgctctctctctttcatgatgtcattgactggagaaggacgacagagagggacctcactcgaggagacgacaatgacggaggtgaatcgacatgagctcagccaggcgcgcggaggtcctcctcgtagtccttctcagcctcctcatcatactcgtacatctcggcatctgagtgcggcagcggaggtgacatgacctccacggcaaccactacctcgctgccaccatctccggcgaccaccacctcgtcgacggcagtggtggatacaatagcgcttgcttcaccctatttgtcagcgcgctgtctagccccgcccgtgatgccctcttcccagcggcgaaggtgcaacggtagaggcagccatgtgtggaacggggagtgggagcggctccagtagtgcacggaccaacaccggaggtggccaccacgcttgtcctccccaacgatgtcccacgccgacgagctcatccccaacagccagatccgaccaatgcggctcccgtgccatcgtcgcctccgcggtcaccgccctcgccgccggtcacgctgctctcgcctctgcctccatgctgggaacgctcgtgcccctcctctagggcgagcgtgtgcgggagagcgggccagtcgctgctaccacacgcttcagaaggggagggaggagagagaaatgggggtggggactctaacaagtgagccctagttttttttaaaaaaaatgtttgctgtgactggacggccacaagtgctattcgaaccctaaaccattctcaacagtgctgtggggggagggggttgttcggtattaaaaattcagagtgaacgatgtctggttttcgagtttagggggtaatttggtcgaccgctatagttcagggtaattcgtatctttttcttgtaattataatgtaagttttaaaaattacattgtaactgcagtgtaagttttgaaaaatatagcgtaaacccttgtattacattgtaagaaaaatcttattatattttgttaaaaatatgacgccataaaaatatatagtaccaaaaattaacataaaaactgataactgttcacctttttaagttgagtttttttatcatcaattatcgatgtggcactgaaacaaataaaatatgtgtatatatatgttagtataaatttaacacgggaactggtaattctcaaaatagacggtttcatgattattctcatatattgaacatgacgattgtaccttgtccggccaaaaagagtagatagaaaaaccaaactagatcatttccatctggtctgggcctttatacctctttcggttgatctttgtcttgcttctacgcaagggaaagctcacggcgcccaaaatgatgaaagccacgtcacacgcaaaacgccggcatcgatcgcatagattgggaaagctccatgcatatatgtactgttcgaagcttagaaaattccatcccgtcagcacggccacgaaaaggagaagtggagtgagagtggtgcatattccgaatgagaccctctctaagccactaattttagaggtgcatttctctcaaaaaaaaaattagaggtgcatttgcatctcaactttttcaactcgaagattctttatgtgttatgattttcattgtcctgatcaaagagttatataagaacattttcacaatatgctaactcgtgttttcaatgtagcatatgtacaaaaagaattacaatgcacactttcacaaaattggaactggcctatgcttgcattctttatggtcccatctgatctcccggaacaagataataatgaatttaggatcgatgacgtaggattttctcattatatttgtgaaatatctcttctctactacttaaaaaataagaggtgcttccatcgtccgtaaaaaagaccgggcaaaaaaccggcgaaaaaaacaaaatttatccaataaaaaaccgggtaaagaaaaacgtgtgcgaaaaaagaaaagaaaaaccgatccaaagaaaaagcggtaaaaggaatccgatccaaaaaaggggcaaaaaaaatggacgaaaaaacaaatctgtctgatccaaaaaaagggaaaaaaggaaaaaaaattgaaacgaatccgactttgttgacgcggtaaaaaaagggcaaaaagataattaaaaaaccgtccaattcaaaagaaaaaggaactatatatgacacggtaaaaaaattcgaccgggcaaaaaaaaactagcgaaaaaactgggcaaaaaaacaggaaaaaaaaagtccgataaaaaaaacagggagaaaaaaaaccgggtggaaaaaaaaatctgtccgataaaaaaaagggcaaaaaaggaaaaaaaaagtgcttctgtcatccgtcaaaaaacagggtgaaaaaaaccgagcgaaaaaaagtccgatcaaaaaagggcgaaaaaaacaaatctgtccgataaaaaaaacaaggtgaaaaagggaaaaaatcgaaacaatccgactccaatgcagtaaaaaaagggcgaaaaaaattaataaaaaaactgtccgattccaaattatatatgatacggtaaaaaaaatcgaccgggcgaaaaaaaccaggtgaaaaaaagaaaaaaatttctgataaaaaaacggggcgaaaaaaaatctgtactatccaaaaaaaggaaaaaaatcgaaacgaat

SEQ ID NO: 38414 - DNA, 8504 bp, Oryza sativa
aaattacgagtttagattttaatcgtgtagattggttgcaaacatatctagcataggaactatctagcatgggaactattatataagaaacaaaaaaaatgtagtttttctaaaaatgttatatcacatcgctaaaaaaaaattgcgtggaaaaatcggttttgcactacaagaggtttaagtgaacatgtacatgaaaacccctttcagagtgaaggtgaaaataagcagattcaagagggcgtatatggaaaattcaataaaatacgcacaacaaacttatcccgaatagtcacagttcctgcaccacccaccagaaccttcccgatcaaaaacctcgtaacaccattcttacctttctcgtctttacccacctcacctacacctaaccaccgtgggcccgagaccccaccataccagcgcacacagttccaggcgccttaagttgtgcgttactcgcgtcgtcctagcacttttcagccactctccaccaacggcaatgctagatctagccattcacccccacccccccccccaacacacacagtcacccactcacctcgacaaatatggcaatgacttgtgggcccagatctacgtgggccccacgtgtcacgggggtaaacccagccagcgtctggaaaacatacaggtaggggggaaagagccggatcaccacgcctcgagcacgagctcgtcaacgactccgtcgtctcgtccacctccgaattccaaattttccatacccttcctcccagtccttacacctctcgatgcaaaaaccctagcgggggaagcaccacctgcgcagccgcagcggccatggcggagccggccctgctggaccccaccgccgccttcgacctccgcctctacccggcccacctcttcgaccacgaactccctctcgccggcggcggcggcggcgacgacgacgacgacctcccgctcgacgggctcgagttcgacctgcccggcgatttctccgtggaggacttcctcctccggtctccggagcgggacgactccggcgagggctctgctgccggatccgggcccaccgcctccccgtcgtcgtccccgaccacctcggcgtccaactccgccgtcgccaacggcagcggcggcgaggtcaagcacgaggagtcggatgaggggaggagcggtgggggtgaccccaagtggagcctgaagcggaagcaggcgagccccggcccgagctcggacgcggccaagtgccgccgatccggggacggcgacgtttctccgtcggcgtcggcgtcgcggaccgctgtggattccgacgagggggggacggtgtgcgaggaggaggaggacgagcggcgggcggcgcggctgatgcggaaccgcgagagcgcgcagctgtctcggcagaggaagaagcggtacgtggaggagctggaggagaaggtgaaatcgatgcactcggtgattaatgacctcaattctaggatctcctttgtcgtggccgagaacgcaacactgcggcagcagcttagtggcggcagtgtgaattgcccaccacctggggtgtatccgccggcgccaattcccggcatgcatttcccatggatgcctgggtatgcaatgagaccccctggttcccatgtacctcttgtgccaatcccccggttgaagccgcaacagccagtgccttcatccaaagtagtgaagaaaccagagagcaagaagactgtggagaacaagagtaagagcaagaccaagaccaagaaggtggctagtgttagccttcttggtttgctgcttattatgcttgtctttggtgctttcattccagggtttaatcataactttggaatgtgtgggcagagtgataatgctatgtttaggaattttggtcagtctcatgctagggtgttgagtgtcagtagccaggataaaagtagtttgaacaatagcgacatgattggtgttgatgttggaaagatgacggggaatactgatgggccagggaagaaacatcagcctgcacacaactcaagtgagatcctccctgctttgttgtatgtgccgaggaatggaaagcatgttaagatcaacggcaacctgattattcattctgtgcttgcaagcgagaaagcagtggcacataaggcctcaaaagatgatagtgatcagtcagctagagatcacaaagagactagtgttgccatagctcgttatctttcgctgcctggaaaggatgtgaatcgacaggagacatcctcggcagatggaccattgccacaatggtttcgtgaaggaatggaaggtaagcagattaatatgtttgccaatcttctattcttgttttctgcgaatttgtgatagttcaatttttaattttgtatttcgaccagagccatggtttgtttgtcgaatacaaatattcttgtgtatgctactgaagctgtgaagtttattgcctttattatttactcagatatgtaatatgtaaatataaatactaacactatatagtggtccatgtaatttcttttaatacacggccattgcatccaatatggtttggaatgcagtcatgaatgcaagtttgaaatacaagttaaaaaaagaatgaagtgacttcctgtaggtcatagagaaagcatgaagttaatatggttagacagggatttgcgttatgtttacatgccaacaataggacacaattgttattatctaggaaatgaaacccacatttaaggttgtgaagtaataatcagacactgcaagtctgcaactaatttggaaattggaatattatttattgaaggtcccctattaggcaacattttatacacgtcactctgacatatgggttttgagatcacccagttttgtgaaactgaaaaatatgccacccgagtttcttgttgctctgaattatgtcatcatatctcattttcagttcttcccttgtgttttcttctcatctcatctcttattttcttttcaactgaactaccaatcttccctttaccacttgggcgattaaattggcacgggataaatttgtgctgatccaaaccagtgaatagttgacccctaagcagaaaggtactgcagcatcccaaccattcgttcttcgctgctccatccactggcttgctactgctcttactcattgccttccacgcgagctctcttcattgctgctcactcttttttgcctgagcgcatggaagcatggatggatcttacagtggcggaggagaaagatacagctggggacagagacggaggaaggtggttggctggcggcggttaagttgaacactaatggctatattaataaaatctttgtagtcaatgtgataaccatgtgtcatagactacaaagaacctatgtgttgttaatcctttatcccataaatttctttgtgaacttaacataacagcatggcgttctagatctcaagtttctgtaacaaaataaataaatacaaatttcaacttgtattggttattttgtagtgatccctgcttttgctcttgtgacttaagtgggaactcactctttgctgaaattgtggcaaattggccagtgctaaagctagttcaaactaatttacatcctattataccacaatcctagaattatgttttttagggcaatcatagaattatgctgtgttgtttaaagcatactccttggagttcctttcgcttttctttctaaactttaagctcaactgaaaggtttactgtactggtcaaatatatattcagcggatccctaaatgttcacaagcttgtagttgcacaaaatcaacaagttggagtcttaaggacgtatatactttgtgttgtttagagtgttagaccgatttccaaattgttgctatcaggtatttcttttgaaaagctcaattgtttattcctactctgaattctgattgttatgtaacacagttcctaactctatgttgctatgcaacaacttttgcaggacctatattaaattctggaatgtgcagtgaggtatttcagtttgacatttcgacggcttctagcaatcctggtggcattatacctgcatctcctgttgtgaactcgtcaagtgtcaatgctaccgagaaaatcccagcacattctgctgcttatcatggcaagctgaaaaacagaagagtcatgtacaatgaagcgattccactcaccgggaagacggcgaacaacacagagccttttaacagaacctctgaaagcagcagcaagttacctgatagcaagccagcatcatcagttgttgtctcggtgctagccgatccaagggaggctggtaatggggatggcgatccgagagtatctccgaaacccctgtccaagatatttgttgttgttcttgttgacggtgtgagatatgtcacttactcctgcacgcttcctttcaagagctccagcccacatcttgtgaactaagcggctgggttgttcgccaaaaactgacagatgaatagatttatacaatgatctgatgctgtttcctaaccaaggactaaacttcctatgcactcaggctgaggtaattcaagtttgtcgaaggttcggagtgatgagtgcgagtttagttaatgtatgcagtttttgcagtgctgtgataatcgggttcgtttgctgtacctctagctgtaacggtgatgtaatcatgtaatactgtttgatcgttgagatataagtgcaactagtaatatgggtagtcgagaacacgtgcagaatatacatgcctttttttaccttagtttcaatgaatatcataaacaaagctacagtacatcaggttgctgaaaggtattttttatgctttgatctggatactatttagattatgtttaggctgaatttgttaggaattttgtttgtaatgaattcaggaactagctagaaagaattgagtctggtcaacatatctatgagaatatctgttgttaacagctgtgcgttgagcttgctagtctatcttttacagcactatctaatctagtatctactcgtcttgttattcacaaggtctattctaaaaaaaggatatttaaaatttccaacttacaagcctttgcctcataatttgaatcgtgaataaagaaaatagccgttattagttaggagtgtttttacacttcttccagaactgctaaccgatgcaatttttttaaataattctatacgaaagttgatttaaaatattgtagtaatatatttttaagctttttagctaatatttaactaattatgtgttaattcatcttttcatttacgtgtcagtgaaaaagttcacaaaccctccaaccgaactatttggaggagctaaatattctgaaaaacaactatttaatagcagcttctaaaaatctaaaaaactgtattttttctagtttctggtttattttctgaattttataattaaaatatggatgaacaattgaactttgtagggagttactaattcttgaaaaaaaactgccgttacagaaaaactcaaaagagatccttaaaatgaccctgaagaaaccgtcacgcactggctaaaacccacattatcctcaggcgcaaccgcgctctccgttcttccttccaccccaactcgccatggcgctcgccgccgcctccgtctcagttctccatctcccggccatctccctcccgctcccttgccttcagggctcaaaccctagccgtcccagcctcggcttgaccaatgccctcccgtggcgccgacgcggtgggcgcggggcgggggcggtggcgggggcggtgcgctgcgcgaagcgcacgggcaagcggcggtacccgtcggagaagaagcggctggataggcgacacaaggagctgctccggaaggccgcgccagaggagggctcggcggggcgggaggcgggttactggcggctctccaagctcgccgtccctgcccgcgacgaccccggcaaggacttcgctggtgtctccccgccgctcctccaagccatcgccaaagcactgaaattcccggtacgataatgcattgcatttttgtagtagctggtgaaatgcagtaaaaaattgcgaggttttagaatagctacaccgttgatgatacagaggattttgggggcgtggattcccatgagtcgctgctctggatgtgtggaactgtaggaaatattgccctagttccttgtgcggatagctcaattcttgatttgagcagcaggttgctaatttcctctttcaagttatgaaattaagccgcggtttgcaacttactaaacatgcgtacggctctgtctctcgagcatgtttgaacgttgttcgtaaccgtctatcgaattatgcatatggttcgtgcattatctggcagggctgagtgttagctgcttgcaacctgttatacaagtttccgattgcgtcctgctggagtaatctcaatatttaaactacaacgtttagtgatacgcctttcccttgaacattgtgactatggctgcttttgcatcttttgtccatattgctgagctcatattttatgcttagacttattctaaagttatgggcttctaaaatctattctgttctactgtaggtttcttctatgctccctgaagaggccttcaccgttattcgcaagtcgtttgatgcacggaaggttctttatggaatgattccatctatatcttatttagtatttgttatcctgcaaagagacgagattgcggcttggttgttaactgtaacacagatgcttgatgttgaagctgctaaatagtgcacccaaatcggattaacattaacacaaccgggaagaaacccaatgtagtaaccttcatttcagatctccattaacatgtcatccttctgttgatgtgtccgtcctaacacacagggtaacctttatttgcatcccaagtttgcaatagttccagatggccctgtaatggctcatctgagggtttaaggaagaaaacatgaagtagtgaagaatttgactatttttgtgctacctggtattttgcttagaatactggtcttctttactagatccttttgtcttgatgtcttgcagcaaagtatattattgttttgtttcctttgcttggttgttcttcattccgagagtgttatttcaggttttgcagactaggatgaagtcatgatgctctgcatctacttgtggatttgtagtcaacactaatttatgcattttggtttacatctttcatctctgtttctgactttgcactatttttttttttgttctgtaggcatttttctgaattaaacacatctttgtttatgtggactttaccttatttcagtgactggttttttagcgtgattatacaattgtagttatgccatataaaagttaattgtaatacttttcctttctacaaggctctgtgttataccgattgcaatttgcttcacctgtgttgcattcatgtgtcagtgttggttctactgcgttgataattgtttatatcatttatatgctgattagtttatcacttgcacaatttctttgtgactaaagaaatcatgtttaacatggcagattttgaaagaacctcaatttgtttataccgttgatgtggctgttaagagacttctggatttggagccgagaacgtgggattttattgctagattggaaccaaagcttggaacaatagaatacatgcctgatgagaaagtagcatctgatctggtcagtatgcttaatgtttataagcaaggttctgatggtgaactgggaatcaatgatactgtcaataatggctctatctgtagtccgcgaaagaaaccaagggtggcagttgtaggaagtgggccatcaggcttgtttgcctcccttgttctaggtgaacttggtgcagaagttaccttaatagagcgtggtcaacctgttgaacaaagggggcgtgatattggtgccttagtagttagacgaattctccattcagaaagcaacttttgctttggagaggtatactactcgttcctattttgcttacaggacttcaccaaatacatgtcagaattgtcttgagatatgttcgaataggtattttgttgacaatggattgaggcatttaacagctcgacatatatcttttgataaacatataaagtagctatatgtccatttggctactattatggccaggtggccacatgaagtgatttcatactatggcagttggtgcatttataccaattacttgacctgaaagaagcatacatgtctagacgttatatgcatctgaaataatgtaaggatgctttaaatctattgaatgatcatgctattttgaaaactgttgtgccataatcttcatatattatcaccattttgtccatctgttttcatatcatttaccatgtataaattaacaatttaaaattgaacttatacactgtacagtatgctcaagtcgtgaactccctactcgattactcccacccagtcacaaatatctggcgtttaggataagatttggtca

SEQ ID NO: 38415 - DNA, 246 bp, Oryza sativa
ctctgaccaaattacttcactgatgtcaataagtcactccctaattatgctagcttacaacaccccatttcttgacgcaacaacacaaccagcagagagctcagtctctccttctgcactcccggcaacatctcgccgccgttgcgcctcgtctccggcgtccacctcgaacgacttcaaggtgtaaaaatggaagcaaacgaagtagtaggcgaggttgagcaccaagaggaaggtgacgagcca

SEQ ID NO: 38416 - DNA, 698 bp, Oryza sativa
cctcataattcagttataaaatgcatggcactgagctttgcttgcagggccagggcttgtatccaaaagtgatctatgacatagacaccataaaaattaccatttactgtgtggtaacaacgatatgttgtagtatgtgtaaaaacttatgtagagacctgtgcagctactgataccaggctcctttgatatatgtatctatcgatagtttaaccaaccatgtaagcacttgaatagttgccagtttggtacagctacaacatactgtatttcattttgtatattatatggtatgtgttatttgcattcaactgcagtactctgaattggctgctgaagtacataaagggcgtgggcggatacctgtagcagattacaagatagtgaaatcttttggtgaaggagatgcagagctaccagaacaaaatcgcagttgttactcattttgcatgtgtcctggtggacaggtcagttgctcttttgttgtttcactcactccctcttctaatataggagtactactagttactgcaatcctatttctactgaattctaataataacgtgtgttctgattttttaaaaaaaaactcttgcaggttgttctaactagcacaaacccatcagaattgtgcatcaatggtatgtcattctcaaggcgtgcatccaagtgggcaaactcagcttttgtggccactg

SEQ ID NO: 38417 - DNA, 738 bp, Oryza sativa
cctgcaccccgctccggcaacacccgctgccgccgccgccgccgtggctgctcatcctgcgtagcccctgcgtctaccagagcctccccgacggcgagctccgccccgtccccggcgcgaattcgagccgcgcgatcccctacttctcctcctacgatgatggctggctcctggagtaccaatgcttcggccgccgagacaggatcaggaatcctctctcccgcccgccattgacatacctcgctgcttcgatcagcgcatcaggagcctcgactacttcttgggcgacaacgacggcagtcatagcattaaccccgccgagtacacgttgcctaagatcatcgtgtgctcgccgggcctcgtcgtcgccgccgtcgtccactctacctgcatcgccgctttccggccgggaattgatcattcatggtcggttatttccggtgatgaagttatgtcgacgaccggtggtgatgatgatgatgacgacgatgatgattatccgtggatgaggagaaaatacgaggacatatcgttgtatcgaggcaagctctacgctctcactagcaaggaggagcttcttgtccatgggatcatcaacgacgacgacattgacactgtcagtgcaaatgcagtactatctcgtgctgagcatgcgatcagggcagtgcatcaccatccattgacgcttctggaacggatacaaaatttcagctccgatgagagtcgctaccttgttat

SEQ ID NO: 38418 - DNA, 7814 bp, Oryza sativa
  unsure (1)..(7814): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatatttttcaagaaggcatttcattccttaaaacatttttccccaacggaaaccgttggccggaattgatttcgccttatttgtagagaaatagcatacacagaacagaatgtactgatgtatatacgagggttaacgacgttgtgaaaccgctaatggttagtttgtgaaaactgatacagtatgttttagctgttttttttacggtttttactggtttttggtaaaatggtgaggagcggtttttaatttaaaacggaaaggtaaaccctgggagtacaattcagtcgttcaaagaaacagaaaaaaaatcatcagtgcctcagaggcagaaatcacctgtaatatgtgtataatcattgttgtatgtgtgaagtatatatttccctatttttggcatagctaaattaatcctttattacacaaaatctatggccgtccagcgtaattatgcactcctgtccactcgtccaacaacaacctgctaaatttgcgtcttgcaaagatcacctgttcatataatactctgcagggctcccctctgaaaaaagttgagatttcagacaattaacatcactaggagagaaatcaagaaacaagctagccagcaatggtgtctctccgcgcggccatcgtcctcgtcgtcgccgcctcgtcggtcgccgtcgccttctctcgtacgccacgcaccccgaaactaattgcatcgatcgatcgatcagcaatggcgaatggcgattgaattgatttggatggatgcagatgcggaagggaacgaggggccggacttcacctacatcgaaggcgccatggacgggccgtcgaactgggggaagctgagcccggagtacaggatgtgcggcgaggggaggtcgcagtcgccgatcgacatcaacaccaagaccgtcgtcccgcgctcggacctcgacacgctggaccgcaactacaacgccgtgaacgccaccatcgtcaacaacggcaaggacatcaccatgaagttccacggcgaggtcggccaggtgatcatcgccgggaagccgtacaggttccaggcgatccactggcacgcgccgtcggagcacaccatcaacggcaggcgcttcccgctcgagctccacctcgtccacaagtccgacgccgacggcggcctcgccgtcatctccgtcctctacaagctcggcgccccggactccttctacctccagttcaaggaccacctcgccgagctcggcgccgacgagtgcgacttcagcaaggaggaggcccacgtcgccgccgggctggtgcagatgaggtcgctgcagaagcgcacggggagctacttccggtacggcggctcgctgacgacgccgccgtgcggcgagaacgtggtgtggagcgtgctcgggaaggtgagggagatcagccaggagcagctgcacctgctcatgtcgccattgccgaccaaggacgccaggccggcgcagccgctcaatggcagggccgtcttctactacaacccgccgggcagcgccgtctccttccaggaattcgccaagtgattctttcttttttttttctttcttttttttttggttttttgtatttgatgttgagttgatttgattaacatttcgacgtatgatatgcactatatataattaattaacatcgcaaaatactttttttttcgagaatacataaagggctcgcgtatctttgtattaactagtgggggtggggattaattactatatgcttggacatttttccgttcttcaagattgacgcatcgatcgataaatgtatatatttgtagctaagaaggggtaaatatactaggagagaatacactctattgtcattgagtttgtctctgtcaacgatttgctactgacattgtatgtttctatcagcgatttatcaattgtttgctaggttttcccccgttgttctactcttccgtgtcaaagagtgcatgtcagattaagcagaaccaccagctaatccccttcgatgcgcagccaccgcgccgcaccaccggccggggcttgagatgggaattgaagcacgacggagatcgagactcttctactttcaagatatgatggtatagtcttacataggtgtaggatcgaacagtaagaactaattcaagcagaggaggggtgaatggttgtagtaccaaaaaaacaaaacttttagcggaattaaaagttaccctcgaatcgatgtcgatcggtctgactggaatagatctgccggtctgaccacatcgatgccaccggtctgaccagtatagatcgcccgatctcaccgcccgaagatgccgaagtcgcctgtcgccgccaccagtctgaccaccgtgtactcgctggtatgaccggtacaaagccgtcggtctgaccagtggtgtctcgccggttggaccgccgaacccgagcaaacataaattgaagaactctcaaagtaaatgacaactttattacttatctctgtgtttacaaagtgtagcaacagcactcctcacgaaaatctcgactaaactcgaaaccctaactattctctcaactcaatgctctcaaaagcgataccgagaggccacacctccctctctatttatgcatgaggtagacagcctaaagccacaaaccaaacttatacaagaagtcctaatccacctaggaaaccttcccatacaagaaaccaactttataaactccaattgcaccaaatttgaactccttccaaattcgactccgcatcacatagacacacaatatctccattgtatgccatatagaatcttcaccaaccacgtgcattgatctttagcctaagtatctcgcatgatatctgatcatccggacatcaccttatctccaagttgactcccgatccatcaccggcaacactctcccgaggcgtcaagattacctacacatgaatcaactaagaaaccatattccaagaacaagctatctccaacttgactcattgttagcaaacaacagtattacatacgcatagtatccatctagaagtcataaacacatataatccacggatatccaatgaaacaacccgaaaccgaaaccgacacagagtcggtcggtcagaccactggctggccggtttaaccgcatgcatagcttcagtctgaccggcagcacctgccaggtctgactggaccaaacatccagcagcacctgttcatcacctgcaaattcaataatctccaaaaccacttcgccaataatctccaaatatcaaaatcaataatctcatatgccaattattcatcacaaaataagaatcaaatacactttgattttacaataggtgctcatagagataaagtatgtgtgtactcatagtaggtgagtgcacacgcgttatatgtgtctgcatttgtactatctttctaaaaaaaggagagtgtatatgtggcgtgcacatctttcgtgtaattgagagagaacaaacaatataggaataagtacacttgaggccccttaacttgttaatgaattcgattttcgtcctccaaccagaaaaccagatacaacaggtttctcaattgtcaaaatcagtgccgataactagataaggtccctcgatggtttgcacgacagttttggttgacgtggcgtctatgtggctaatttgattcggtcttcatctgacgtggcgtttacatgacaattcgatctaagaaaaataataaacctcgtgggatccacatgccagtttcacacaaattaataaaaaaatagtgggacccatgtgggccagcccacataattattctcagccctcctcttcttcctcctctctcggtctctctacataatattattaatttgtgtgcgaaactgcatgtgggtcccacggggtttattatttttcttagatcgaattgccacgtcaatgacacgttagatgaagacagagtcaaattagccacgtaggtgccacgtcagccaaaactaccatccaatctgccgagggacctcatgtgcactggttttgacaattgagggacacgttctatctggttttccggttggagcacaaaaattggattggtcgacaagttaagggacctcaggtgaacttatttccaacaaattgtaaatgggccgagtagagccagcccagcggctactggccttggtccaccttggctatatatatgaatgggcctcagattcctcggcccaggcggtacacgagcaaagcgaggcgattcttcttcttcttcttctctggtggtgtggtcgggaagctaaacccgggagaagccgcagcgcagcgagggtgacgaggaggaagacgaggggagagagagagagagagagggaagcagcattggggttcgtcgcctccagatctccgtctccgatccggcgactgagctctcgatcgcctcctcctccccgccggcaaccgccgcctgctctgggttcgccatcgatgcatgcaccctgctttaatttactcctcgttcgttgctctctctctctctcttatcccctatcgattcgattccttcgagttgatgagcaggtcccctccgcgatcgatgccatggatgtgaagggtcgctccgcctccgcgcccgcatcgccgtgcgtcgtgctcggggacgacgccgccgatgccgcagcggtgcgtgtgtcctcttcctcttcctcttcctgcctctggttcgattggtttgcgattcgatgcgctcgtgctcctagttttgcttttgcgctcaagagagtttttgtctgggtagtaagtagtaaccaccgcctaattaactactcctactagttaattgatgattggatgatgccgcgtgttacatagctgcctgttcaatttcgatcaatacaaaaactcgtccgtgctgtgatttttttttttaatttcattctgtttctctgcctattgagcaagacattgttactagaggtgttatggtttgattttgttttttcttcacaggttgccaaagttgatcggaaatatgggagtatgctcaatgctgggagtccactccaaattctttacacagatcagttagctgatgcgaaaggtggtcttaaggttagtttcctcactcagttgttattgttgtttcattacaatatctgcctccttggcacctgtatcttgtggggagaagaaaaatgagaaattatgctttctggaagtgaatcgagtttgtgaccagacattttgtatttttggcccttcccagtcacacgccttctgaaggtggttgatattgtgatctgcaacaacaatatatgacattcttctgtcctctttttttattcaggcaaatgcaccatgtgaaataacttctgttacagaatgcacctgccctctagaactacaaggcatgttgaaggaggaatgtgttgatcagtacaagctactatctgacaggctgcttgccaaggtaaggttttatacttattcacacatatgcttaatctatttgagcttcacgggttgtttcagcagtaattttcttgctatatattgaaatctaagactagatcggcttgtgaaaaccagaactcttaggaatgacaacaaaaatatttttcagatagttcccaaggttgcaagagtcaagaaaccagtttccagttcagaggtatatgcagagtttggtgtttctgcatattcaaaatatggtacaagaacagtgagtacatcattgagaggtaagcccttttcccttagctattgaagtggctatgactgctgaacttttaagtatgttttgaggctttttttatgatttgtcatatatgtttgctagtggttagctacttagctgtgtgacacatttgcagttttaactcgatgtattcaatttaaggggtgcttgttaccattgctgaagaaaaatcactgcaaatagttcactactgttctaattcttgctgactgtatctactttaccttatgagttatgattagttgataatgatacaattctagtgtttttctaacttttagatattatttaactagattagcatttttgcttatttcctctaaatgtgtttctctttccatgtttttcagttcttaaactgagtcagatgtgggttttattcctggtgatccttctcttagtctgtcctgtctattcattaacacatgatggaagtgcagagattggtacttgtcggtttgacaaaacgagtgttgctgcactctcttgcaaacagcctgatgggaaatggaggccaccctcagtgacatgttgtaatgcattgctgaatgcaattgatcatttgccagctagcaatgagagcggagtgtgctgtctgtgtcgctatttgcaactaagataccctaatgatgggcatggattggtatcatcttatgttctatgccagggaaaggataggcatattgtcactacatggtcttcttttccaatcacatcatgttatacaggtatacatttcatttctgttacctttactattccatcttaagatctggagtaaattaaagtctctaaatatttttctgtcttgttttaatcagtatgcaggcaggaaaaaacttcatcgagtggtatgagtaaccctgtccagaaggatcatcctgtgagaaatgcacatggaactggcaatgaggtcttcaagatcccttggatatttggttcagtggcattctgtgtgatattacttattttcctttggtacctgtggtggtctaaggcagcatcaaatgcatgccaactgcagtcccttcccctgaaccgaaattggaggctgtcatcagatggtggtccatgggctgagcgcaggcgatcctctgggaggcgttcatcggcacaactgaaggagcgcaggatgtcatattcataaacttccctgaacagttggaaggattggaatatctggttctaaacaagttcattcttctttcttgacgggcagtgctttaattgttggtatgatatgcattgttgaggatgtgatggtgtttttgtctcaaggattgcacatacgtgaacatagcaattcacaactgctattgcttaggagttctgatatgccaaagaatgttgtctgaatataatggccatgtttaagtgcagtaagtctgtgacattgtacatcagttatactgtctaaaacctaacaatgaggagttccagaccagtgcacaaagatacttgctacttttttttgcgtgtgtgtggaaactactcactttgtcaacatgccctggccttaaagccaaagttcatggcttggatgtcaaaaacaagcttaaatgatctgacagctctattccctagcatttggacccctcggacacctgcatcatccggcagaaaagtggagcaaattacattgtttgagctttcatagaatgcattttccactggcagcttcaaggtagacctgataagtttcatctccactgttggaaagtcattccagtttgctgagccactgtttgaaatgaagcaaatcctcctttcatcccatcctctggtatatcccttggcttgcatttccttcgtcatcgctttgtccagtgcatcaaacaccggggataaaatggggccgcaggaat

SEQ ID NO: 38419 - DNA, 7770 bp, Oryza sativa
atggcccattggtcagtgacccttcattctcatgatctctggggaagcagtaagaaaacccggtataatctgtctgctgacatacctggttgaagaatgagtaacttttagtcccaaaaccaattatcccagcattgactccattgtaaagattatcttctccacagccaaagatgaaattatcaatgcttctgttgctggcaagagtgagcctgtctttccctaagtacccaactgaatactctcctgacccatatcttaagctgtagatacaagtatcatcctcttctacacacccatactcaacagcaagatccatgtgcatgccattgcaagcctcagttgagcacccaactttactgtaagttgaagaattgtaagggttgaatatttgtccagcttttgcagcttggtcatagcattttatctgacaatttttacactgaacccaggagagagttgagccggtgtcaatggtcacaagattgaagacaggtggtgtgccaaggctgatgcccatgaaatacttgttcttgcgcatgctatcatcgcctatgacggtggaggagtctgcaggtatgtttgctggctggatcattgtagatatgaaggaattgtttatgtggaacacagagaatgtaaaggctccattcgtgtttaaaccaatacctgtgttgttcaggagaaaaacagtgtttcatgaatcaagaacaagaacacataagtatgatgtgttaagaatgtttggcttaccaatattaatgcaaggactacaggtaaactaccatgacatagttgcaaaagaagtacttaatcttggtttgttgatggtttttatatgttgcctcgtgtcataagtgtgtttatttttcatgattccatatttaatacgaaaaatccatacctaaccgaattgcattctgatggaatagaatacccatgcaaattgcaaaataaaactaccttgcacatcaggtttacaagatcacttctgacagcaaaagaaaaaaaattagtatttcacctgccaagcttttttgggggaaaaaaaagatggcactttggtatggcattccaacgtaaagcagagctttcttagcttcgattgtgagcataattaacagattagatgaaaaaaaaggaatgacgagcgcattttctagaagccatagcatcatatagcagtaaaatttgaaacttcatttctgagttgattttttgctttactcatcatagtcaagttttcagcattggcttttaaactgctaataatatggatatagaagttctgcccatagcttaaacgatcatagcataatacagttgaaattaaaaaattaaaagtcattaaccacacatttgactgaattttgtataacatacaaatcgcggccacccatgtatacgtttttcatgtaatcgggggaaaaaaaacggaaacatgattaccgtaggttgatgaggaggctggactagtaatgctcatgcacagtcgaattgtgcaccatagcgaaatcaccatgacagccaagaacagctccatcaactatgtcgatcttcacaaagtctaagctaggtgctgagtaataaaatgaaatgtctctaattctcctatttattatatgggttttaattaacacatgctgcctgacaatatgcatgctccaactaccaacaataacagatatttcatcacgatgaatatgctatttctttttttttctcccctagaaatccacttaatttctctactgtttggctgacatgtgggcccaacaggcaaaacccttcctgttctatctcattctcatcgtcctggattaattaatccaacccgaaaatgaatcggattaggatccaacgaacccgaagaagaatcggattaggattcaacgaggcagatttaaagccaaagcgatcgaatttctctacagagattgctcgatcgatcgatcgatgatggctcgccacatcttggcggcggcggcggcgacggcgctggtgttgctatgctgttttcatctgccggcgacggcgatgatggcggataccatcaggtacgggccaccgagggtgccccaccggctgggcaccgtcatcgccgtcgacctcggcaacaccaactcctgcgtcgccggctacggcgacgaggctgatgcgccgccgctgttccggctctgcatccccacctcggtcgccttcaccggcgacggcgacgccctcgtcggcgaggctgccaagaaccaccccgccgccatctccggcttcaagcgcctcctcgggacgaggtttggctcgccggaggtgcggcgagctgccgagcacctgccgtacaagatcgtcgactggtgcacgatggctcacatcgaggtgaacgcccgcgccggcggcgcggcgaggagcgtgtacacctccgacgtggcctccatggtgatcgcccagctgaaggctcgcgccgaggctcgcctcgccggccgcgggaagaaggtccacaacgccgtcgtcacccgcccctactactatttcgacggcccacatgaggcggccatgaacgccgccaggatggccggcctgacaaccgtccggatcatcgacgagcccaccgccgccgccgtctcccacggcctccaccacggccgcctgcgcgacggcggcaacgtcctcgtcctccacgtcggcggcggcacctccgccgctaccgtcctcacctacgacaacgccgtcttcgaggccgtcgcgtcgcgccacgacgcccacctcggcggcgatgacttcgacgccaggatcgccggccgcttctcccagctcatcaagcgcgaccacggcggcggcgtcgacgacatcgcccccgcgaagctgaagtcgcagtgcgagctcgccaagaggacgctgagcagccacgacgtcgcccaggtgaacctccacgccaccaacctcgccaatggcgccttctccttctccgggtcactgacgagggcgcagttcgaggagctcaaccacgacctgttcgagaaggtcatctccctcgtggacgcggcaatggcggaggccagacgcgcggtggcggggttcgacgtgatcgatgaggtggttctcgtcggtggaagcacaaagattccgaggattcgagagctcatcaagaactacttcgccgggaaggaggcgacggtgaaggcgacggcgagcattggcggcggggcggtggtggtggtggagcctgaggaagctgtcgtccatggcggtgggcttctgagccatcccatggaggatggctaccattgcatgggagccggtggtcgccgtcagatagggtcgccaatggatcgctgttaccatgaattttagctgaatttgaaatttagactctcttgtgtacaactactgttgtattaatcgttgatataagagatgtagtgacataatagatgctctcttcgtttcaaattaattgttctaactttatcctaaatacttctatcaatttttaaaaattcagattcattggagagctatacctgtaggcccaaaacagtccgaagttattttttatggaagtatcgtttggtagtggtaaataattcaacaacatatgaattatatgttatacaaaaatatttctcaagctgaatctaaaaattgtatgaatatttacaaatttatagtcaaaggctctctttggcatagttcttcgagttgggtgttgctagctcaataaatcaatgaatctagatttgcgattacaatgataacgttaagataaattattttgattctattttaaatgaaatttaaaatttctaaacatctggtgacaatattttggcctgaattcactcggatttgtttccctcggattagtctctgcatgaattaattagcagttgtgatacgtttccttcccacgcacgcatgcggccagcaacatataatctagcttggcccaaaattgatgagtacacacatcatgtgtcgatgcggctaggtgaagagattaaagaaattacaaataaaaattgtgtcactgcgggaatcccacgaccttcacgtcgcacacacatacctttcctactcaggtacaagcgtttcttatatttagatgagacttgcgtgctagttatattacagtaattacagtatatttatattgtagttacattcgtgtgattttaatgaaaaaattgttaggtgatatataggtagtgatttaaagatatgccaaacagggtcaaagatatgagtgtttaatttaggataaaattaaaacgataagtaatttaaaacaaagagaacataaattatgttgtgaacggctgattcgagcattagtttcatgcagtgagacttacattaagctgtaattaagcaataccagttcaactcaaagcttatcactcatagatcacgcttctctatggcaatatggcataatctaaaacagttagaaacccaagagcacatcatatcactttggttgtagcataccaaatctttgaatcagtgatgtagcacatgggcaattacaaatatatttacaagttttgggttgttctagaaacctgggattaattaggccaattcgaaatgcataaagaaaaagtataaaacgattggttcaagctctatcctactagtgagtacttttgtttgtttgaagaagtctctgacgttcatcacgagtaacaactaacggatcactaattgagttgtcgtgtggcttgtgcactgaagtccttttctaatctatggtcgaacctttctggtctttggtcacttggagctcatcagtttggactatttgttcaaacatttcctctttaactttattctttatgatgttgacaagacagggacagtattaatggacttgcaaatagcggaagaaacaacggttatatatgcatattttcgtcaattataaatgatagttgttatttgtatctttagcattatgctccgagtagtttcttataattaatttgtgattttgtcgttcacattaattggctctagctttttcgaagcaaatgcccaaaaaaattactacattattaaaaaacaatgggctctgaattctaataattaattaactagccagtggcctctggtacagttttcagctagattatgtcttttgcaccatacttccttgcttgatgctgtttaatcaatcatgccctatggctaccctgattaattaatacaaagtttattccaaataccactgtatcaattatcttcagagtttatttcagatacctgatctgtataaatcatcagagtttatttcaggcaacaccgtatcaatcatcttcgttttgttctgatgctctagccagttcataggaggtgacaggtaatatatgacgcagaatgagaactaaaaaataattatcgccttaatttacgaacaaaccacaaaaacaaaatgaagttgccctgcaaacgtgatggtactactaatcacccagtacactctaaagccatgaaaaaatatgtatgttcgttcttgtagcaagaaaagtattttgttacgcatgtcaactccagttgcaatgtgaacatgccatggaaaatttgaaatccacattccgttcttacgtacggtcaatatgcgccatattgcaaattcttcgtgcgctataattagtttgacaataatgtcatgatttattagagtcttccctcggcaggtttcgccgtttagagaggggttactcttcgcctcacggtaaacacaaagaactaaacaaaatctatcaaaaaaattacttttttcttctaaactttaccccgttacgcacccagacccttcctatcaccgacgataagacatacatcatgtatagattcatagtcaaggtttgtctattatttttggacggagagagtagatggtaagggaaaccctgctcctccacgcatgcttatagctgttggcaagagaaaaaaatcagcattagtctcgattctctgatcttggtctaaagatgctccgttgaagatatgtgagaatattttccttgacaagcaaaaaatggatacgtattttattccaaaagagacccctgaatcttcaacgagaggggaaggtggtgttgaaagaatgagcaactggatgatccttttatttttgttcaagtaaagagttgtactttctcttatcagacgtttctcaagttaacatatcggaactaaacttgtctatcatttaaaataggaaaaagtacgaattacccctccgaactatcgcggtcgtccgaattacccctgaaccataaaaccggatatttttcatcccaaactatgcaaaccggacgaattacccccctcgatctaatccgcggtggttttggtctacgtggcgtacacgtggcatcccagtcagcgttttctaattaaaaaattgtgggacccgcatgtcatagtcttcactttccctctctctcactcttcctctcttctctctctcactctatctcactcttcactgcttcgggaagacacggcggcaacgggagacacggaggagcgggcggcgggcggcggaaggcggcgcacgggggcggacggcggacggcagcgtcgcggcgaaggccgagcggaggcggctgcgataatgtacttttctatttgttagtagaagaattatgctttgcagaaaaacacgatgagctcttgtcaagcttggacttggtccatggactcataacatataatgtacttttctatttgtaagtagaagaattatgctttgctgaaaaacacgatgagctcttgtgcccccacaatatctttttttttccaaaataatagggctaaatagggataggataactcccttcatgatatcctattagcaacgaaaatagctagttctcgatccgatttgctcggaccgaatcgatgatgtacttcccttgtcttaaaataaatcaacttttatacataaattttaacttatagcctatgttcagaggatctaaacatgccctatctataaaagatgatttattttgggacagaggggagtacaatgtattttctaaaacgcaatggatgtggattaggataggtattgctaaaatttgatagatatggattattcgatcttttttatgcagatcattcaataaagtactactatagaataatccattttttatatattactaactaaggatatggtatgtattgttttctaaaatccaattaatgtgaattaggatatggtattgttaaaatctggtgtatatatattatccaatttttgtgcgaaagtgctattggacatgatctttttatattaccacaccatttttttaacatacaaacatattaggaagcaagatcagagtttaggggataaaccccagtacattacagataagatctgaaagcacagagccaccctattgaaatgggaatttaactggactaaaggagtagacttcccgatgaaactgagcagcaaaaaaggagcagattgacggggagctacggcaatgccgtgacaactgcttcctaaagactcatttgacgtgcactccacttggtaggccggtaatccccatcggctatctccatggaaacggcacaaaacagaggtttgatgctgagccgtagattttggggtgagcttcaccggactcagcaaaggatatggaggttgtcattgaatctgaagagctctaacatcaaacctatcaatcgaagtcgcgcatgtggtctgagctcaaccggaatgacaaactcggcatggtttctactgat

SEQ ID NO: 38420 - DNA, 17654 bp, Oryza sativa
gcaaagaatattattttggacaactccttacaagcagactctacctatgtgtcttcatctgcaaaataatatattttcaaatatatcaacaacacaacatatgctatgcacgaagagtccaattaatatccatatataccctatcatgaaccaggtccactaaaatccccgcaaaatataaaatcattaatcattatagataatcaaagtactaaaaatgaggagaaaaaaattaaaaaaaaggcgataatgacacgtaggctggcagcgatcccgagagcacgtccctcccttaaatccacgcacctcgccgaagttccaatcgaaaatcaaatcaaatcaaatcccaaccaaaaaaaaaattcaaaatcaaatccccaaaccccaccatctccatggccgccgccaccgccgccgcgcgtgacctcgccggcgacccgccggagtcgacgctcctccgcgtcgggggcgaggtcgcgtggccggacgtctatgaccgcgacgactcgctcaaggagaacaccaaccccaagtgcatcctcaagacctacggcggcggcggcggcggcaactcgtcgcagaggttctccggcaacctgaagccgacggcggcgccgatcattggcttgtcgaggaagctgggccatggcgggggcggcggcggaggaggaggagggggtttccgtccccccgcgatcttcccgaagaaggccaagaccggcggcggcgggcgcaccccgagggcggcggtgcccgaccacgagcccgggtcgcccaaggtgtcctgcatcgggaaggtcctctccgaccgcgagcgcgcgcgccgccaccgccggtggtcgctcgagacgaggccccgcggcgtcggcggcggatgctgcccggggctcggttccctgttcgtccgccggagccggtcgaggaagaacgtcgtggagtgcgtcgacgaccagtcgccgcccccgcctccgccgccgccgccgactgcggccgcgctgaggcggagggaggagaaggtggtgttgatgaccgaggaggcagcggcggcgccggcgccggcgctgggagggatgacgcggttcgcgtcggggaggagggcggcggattgggcggctgagatggagatggatggccacgtggcgagatctgggccgttgtagcgtgatctggaaaccatgtgaagagaagacatcgtgtacatggaagtttggtttggtttggtttggtgtgatttttagctggttgttgatgtaatttagtgcaagttttgaagtttgtgtacatattgaaaattaggagatgagaatgatgggattcaggtcagcaaactttgtctaattttgttctgttttgatctgtttctgtttgatgtgagttgaatggagaagatttcagtactggcatgcttgcattgatgatatgtatgcaactctgactttgcatgcctaacttttttttttccttatgtaaggacaagtagtgcactagtgtgattttagtgtagtgttgatgtgtgtatgtctgaaaattaggatgtgagaataatgggtttcatagtactaccaaattagtcaaaatatgctctttctttttcttgtttctatttgatgtaagttggatggagaagattccagtgttgacatgctttcattcatcatatccatgttccaatgactttgcccttttcttttctttctttttttttgcaaggacaagaagcgtgcttttgatgagttgatagttgattttaagcgtactatgcataagtccgataggttatctgttacttgcaccagtcataaatatttgatggacgttacttacaagatgtgatttaacttttaaatatttgaaacaacaataatttctcgaatatgcttaatccaaaattaagaaaagggtaggcgtagatttaacttgaaaaatattatcataaaatcataagcgtattatattttatttattgttttttaatatatattgatagtgaaagttttaaaaagtttgggtggatcttttcctcgtcaaatatttagaggagtacgattaagtgggatagagctatgagcctgagaaaaggactaactacacttcacaatgagatgaaaaaactaacaagtacatttaacaacgagaaaatgttgatttcgaaatcgctggaatgttgttaggttgaaggtctgatgagtgtgtctgaaaatcgataggctgagagtaacatgaaattgatgaattatgctcaagaaacactacgtgtatgagaagtagagtatatgtttagcctgagaaaagaaccaaaggactaagaagtacagtttacactgagaaaacgtgaatttaggaaatgcattttccttgtctcatccttgcatctcccatgactttgcattgagtaacttgtcggagggacaagcagtgtgctttttggggattcggatcggttgcagtcacaatagttaatattgcacgcaactttggccgtctatttttgtgatcaacggtttaaattcataactacagtaacatgaacagtattccatgctacagtacaacgaaagtatttcgtgctacataccacgaatagtatttcgtgctacagtaccgtgaacagtacaccgcacgatctaggccgttcagcttgtatccaaggatgctactgctactgcttaattttctaaaacgctttttagaaaatctgctttttggtggttgataattggtaagacaagtcaacatgttgcgtgaatttaattaattagataaggtattttctaaaacgtatatttagataaggtatgaactgagcagatacagattaaaaactgcaatgcataatagttcagatcatagctagattcgttaatatacagtatatataccaataacttcaatcaatactttatacaagaagttaagcagtgcaattaactgaatcccagcgagaggaacgcatatatacgccgaatagggttcatccaaagttccaaactacaacactgcaactgaacatcacattcagtaagcataatacaaatatgtaaaacaccctatctgataattattgtctactcccatacaatacaaagatatccatgtgatgtaggatggctagagcagttccacaagcaacagcttcgtcaggcctcaattctgtattcagctcccatcaaagtaatccttgataattagttcttgaatctttgggatcatttttcttccaccaatgacaacaacctcatttgatcagattcttcttgttgttcaactctgttgtcatcttggaggtacatacggatcaatttccatttgatcatcacatcaggctgttgatgatcatagtaaatcaatttcagcatatatacctgattgaaaaatgagtaacttttacaccctcacctcaaccaattataccagcattgaatccactgtaaaaggtaacctgctccgcagccaaagatgaaattgcctttcaaagttatcttctctgcagccaaagatgaaattgcctttaaaagttatcttctctgctgcgttcatcgtcttaagaccaactttactgtaaattgaggctcatcaatccaagagagttcaacctttgtatcttgaccatagcattttatctgacattttttacactgaacaatccaaaacattttattcgacactttttacactgaacattaatccaaaagagagttgagcccagtgttaatggttgctgtcatcacctatgatggtggagccttccggtatgctgtcatcaccaattaattaaacataacgtgcatgattactttaatctagaagggccaccgtttgtggattaggctcaacaccaacgacgacataggctatgaaaaagaaaaaaaaaaggagtgccagaaaaccaacccaaccaatctgatgagcccatttgaacgagaaatttctccatttaacacgagattcaaatgcataactgtaacagttgacacaggccttgtcattcgactctactacactacaacaaccaagctcaacttcgaacgatgcttttgctgctgctgctgctaaaaaccagggtagtgaaggccgcataaactgtgtacagcatgcgtatttaagcctaaaatgctgcaatgcaacttaactgcttcatatagtaacatattactctgtacagatccagagggaaatgtagaaattcgtgttatcacaaacagttactatattgtattttgggacaactgtcatgcaaccctgtagaacatctctgctgtctcccccataagaaatgtacaggagaacgaaaaatgtgatgacaagtgtatattgactgtaatctatagctatgacaatgctgagtttctagatggcaaatctacggcttcagcactaaacgaagacgccaggcaaggtttcctttgtatatcatacctgcatcaccagaaaaacttcacagaagaaattgtcatataaatcgcaggtcacgtactatttctcactgccatccttctcgtctaatgctccattaggcttctcaaaccttactggaagaacgctgcgccgctctttgccacctggtttagctgatgcattcccataccatatcatcccaacaacagcaaggatcatcccaaggactacctgaaaattcagaccttccttgccaaagaagagaaacccaagggacaagacgagcactgtcttcatgtggcccaggacttggaaggatacggcagaaaaccgaccaatgcagataaattggctcagattaacaccaatggcaatgacacatgagagagtcaggaaaaactgcggaacaataaaaaccatcgtaagatgaaatggaaaatttgaggtcaaattacaaacaaatcaagcattgactcaaattcatccatattccaaccaagtaaagtgtaactatagactaataacaagcaagagattgcacataaaaggaaatctatagactatagttgtttgaagttactgctaacaagtgatgctatgaagtaaagacttttgtggtcacaagaggaaatgtaatgctagtctaggtcatttgaaaatgagtaaatttcataaaatcccacatattatggtccaagttgcacaaaaccactgggattttggcatgtgacatataaccccacatattataatcctagagtttcacaaaaccacactattgatcattttaacttatatctaccacacttttgagttatacaatcacatctcaaatttatgagcgttttatccatcatataaatattacatccgctttgtaaaattttaatatatgagtatgtcaaaatggttaacggtgttggtttgtgaaactttagaatcatggttttgtgtcacatgccaaaattcctgtggttttgtctaacttagatcagaaacaaagcattgtaatgaggctagcctcttaccaaagcaatcgatgtgaaaccaaagtgatccactcttttgcctgtcaacaagaaatctacaaagggcccaactagcagaagagatcccgcttgggctggagcagtgtggcccaggaggttgaatgagttcagagagtacttcctttggagaaaatgaacatactgcaaggaaaatagaaaaggaaaggaaactaatgagtaatttgtctataattaaagaagtgacaaacaaacaaatgatttagggagtgccaattattcataactaacaaggactgcagggaaccaataatgattcagggagcgccaactattcatcattcatcaataagaagacaaatagatagccacagttactgttgtaccaccatgtactaatttccccctcataaaaatgttcatggctgccaaaggagagctataggaatagaatgcaatcttatctcatagctgatatataagacataaccatacaacaagggtggtgattttaacttacatattgttgtaaagctgtgctccaaacagctataacagcagcagccagaccttttgcatttacactgacatcagtaactgtgcagactgcaacacctataagcacaaccattatgctcagctttgtgtcccgggagtaatgtacacgatcgaagacaacctccaggagacatgatgcaggtatcatgcacagctttgctatctgaagggaagaaaaaggattgtttagtagttgaaagtttaaagccatgatggaatctagctactagaacggtcctttgctaacctgataaaatcccacagagttccacatcaagctcacattcattccaacaattgacaagttcgaaaagatcacaaacttaatcagatctggtattggtaagtgggagggctggctgaggcctaaccaccgaaacacgatagtcatcaaggtggttgtcacaaaatgaagaccagttaatgttgtggctgcaaaatacaaaacacagtcagttacatggcatccattatcatacaaatgaagtatgtgtatgttgaggagcagcccataaatcttgttggacacaacaagaaactggataatatagtgtgcttccactgttccattaaggcccttttaatgttcatcaagcagagtggcagcttgtgacaagaaattatgatcataattctcatagcagctagaacagcgtggttttcaggtccaccggataccttataggttcacttttaatttgttttagatcacaacaaaaacaaatccggcgaacttctttggcatatggattatctagaattcaaatgattggaatttgataaaaaattactcaaagtttaaagatgcctgtcagtcaattgtttaattgcatgccccaaggaacaaacatctagaatccacaattacataagatctagtagcatttattcgttctatactaaaacaacataatactgcaagtttgtcatcccagaacacggagtagcctggaataaaacatcacaaaatatatatcttaaggtagcaaaaaacataccgaaactgaatccatgtgtagccatcagagccttgttgaccatgatgattccaacggatgtggtgatgttgaaactccatgccgcaaaatctagcaccttcttcttgtcggatttgctcatggaagaagtcatttcgctcgaatccttgaggcttcaaatcaacaccaacactttggcaggggaggacctaacaaattattttgggaggaaacaaaactgtaagaattggtactaaggttaaaacagagagaaaaatcctcttccagatctagaaggagaagagaaggaaaaaggttaaggcacagagaaatggtgcgcgcgggtagaacgagaggaaaagaggacgcgcgctcaccggaagcacgccgtcggccggcgccgctggctcgaggggtgatggatggagatcggcgaactcgctcgcgagtcgagaggccgaggtggcgggtggggagagattggcttgggcgcggcgaggaggagccagaggcgagggtacgcggcggcgggagcagctggacgccgccgggcaccgccgctcgcgtcgcggtggtggagatcgccgcgcgacggcggaggcggcggcggcgggccaaggagattttgctcgtgtggtgttttttttttcttttgttttattttttttttagcgaaatgaaaacaagtgtctccaaatctcccagatctgccactatgtggagggttatttatagtgtgctttagtttggtttgaaattttgaatttagtaccaaaatatgtccaaattcctcgattagatcgccgtgatttcgttttcaagtaaggtgtcaagaaaatgccagcccatccttccatcaccgcgatattacaggagtaatattttttcttttttcctttttaagtagtattttctttgagaagtaataaggacctgctcgaaagtgtttgatcaatgatggatgaaactgaaaaattgtacttcctccgtttcagaatgtaagtcattctaatatttactatatttatattgatgttaatgaatctagatagatatatgtatatattcattaatatcatatgaatgtgaaatatgctagaatgacttatattgtgaaacggagggagtacttccttcgtcccgaaatatagcaacctagaaccgaataggatgtatcatagtactatgaatctggaattgctcgtccaggtttaacctgtccagattcgtagtactaggatacgttctatcgggacctaggttgctatattatgggacggagggagtaataattattcaagtatagagatgaataatttaaatattaaaaagttgattgatctatttaaaaagttttcagggaaatattaacgaacaattcttttctcaaaagatatcgcacagtttaaacatgcatctattaaactttaaatcaacaattgtgttgtgtggttctgtttgtgaaagtactatatgtatcagtgttccgcttaactggttgattatatttattaattaattaatacggttgacacaacgttggggttaagatctgtatactttttttagaacaatatctgtatacttaattgtttattaataatgtaaacacatacaccgtgcagttagggtgtcacataagcatggcagctcatacacgtagggtccatgcatccattatattcagatctcaaatcagatttgggcatgcaaccttttttgagattccaagccatcgcactcaaatcaacatttcatccaagttactactaactagtccgttgattaagattatatactcctacttaagtttttgtatgtatcttcaaaaaaatgtttcgacatgtgtattctaaaatgtgattgctgttttggggggggggggggggtttggaaaactgaccaagttaattctatatattaattccattgactatatagctcatgtatttatgaagtaaaggtgtgatttggcacgccaagctacgcatacaaaaggcatgagcaggtcagaaaccaccccatgttttatttgtatggagtaatacgaattgtatgttggtatcatgcatatgctgaatcgatcgatcatctgttggagtgttaattggacaactttaattgtcgtgcaggttgttacatgtgcaattaattggccagatagtagtaggagtactactgtgtttttagtcaagtcgtgtacactcctgagagtgattaactatcggcaacctagcttaattactgatttgtcggtgtgtgtacatggatgcacatgcacctgatgggccaagtaagcagcaaaccatctttagcttttcaggcccgtatgtgattgggccgaactacggcccaaagtcaaaacgtattaataaaaacaaagatcccttcacctagatttctttcataaccacacaagcataatagattaatagtatcattttggtgttaaaagcaaaatatcatgtttttttagaaacattacgagcgaagacaccttcgaaagattggaccagcaaatattaagattaataacgaagtcatcacagttattatcgacagatatattatatatcacttaagaaaataattagctataaatatagacacctatgtcgagtgtagaacttgaacctgatgagctgattccaccacagttgagtaacattcacttcagaaaaaaaaatcatttcctctctaaaaagccaaaagcagtgctgcaggctgcagccatgatgcgactgtatacgcgtacctgcaccgacaaattacgaaccattagtccatttgtactctcctggccaaaggaaaaaattggaaaccattaatctagttgccaataagcaatcaatctcaggagtgtacacaacgttgactaactactacaactcacacgagatatcatcgatgatcactgaattcagcagggtacaatatatccgtattatgggaactagacatggattttcaatgtgatcatgccctccctacgcatagctttcgcgtgccgaaccacacctttacttcacggaggaattgaccctatatcattgaaaaattatgattttagttttcacccaagattgtttaaatctcaattctgatgtacaattttacaatcctaattaagggtaagttcttataggattgactactttcttgtttattcttggtatgcttcctaaaccgttaaatgatacgtttagtgaaaaactttttacatataagttttttttaaaaaaatcaaataaatctattttttaagtttataataattaataattaaatattcacatgccaatcacatatttcggtatctgtgccactaagtagcagagttgaacgactcttttgaacgtctaagatgtctgattctacaattctgtataggcaggatatattactttacattttaatttatacaattctatgattgcgatcccatatcgaattttccaatccgatccaggatcgtgattttaacaaccttgataccatcgaaagttaactctattactctatttatcattgcatatccaaacttttgttagattcattttaattttatttatttatccccatctcacgctcaaagttggtatcgatatcactctatcccaaacttgactatggctacctctatcatcctcaagcttaccacggataaactgcccttaaagtcgcacatagccgtggtgattgaggttgcaaggttatccatggttattaccctcgattagactcacacaagcaatgtccttgaagtcacccatgaccacaacaaaatgaccattgtgctcacaaggccaccatgtacagtacccttgatcgggcttgccacatgtcgccatcctcatcacagtcgagcttgcattgttacccatgtttgccaccatagatctagctcgtcgataatcacttcctcacctccgcaagggaacaatgtaagtgaataaagatccatactgaggtctcggaggacgtcttggtagagtaatcttcacttgtgatcatctctagaagtttgagttggatcttggtggtcactcgaattctagagaaagacctaggggtgttggattgaaggccgaggacttctgtcgggatctttgcacgatgaggcaagaggttaaatcaagatctaactcttcagagtttctcgacaaatagtaggatccgtgtgatccgaacttcgggaaaaaaaatccttttgtctcccctgtgcatattttgtgcttgcccgtgtgattcaattactctgcttgtctactgtgtatcgtgctgattgaataggcctagaagtttgattagatttgaagtcaattctctcatttatttcaatcccagaagttcctgtcttagaactccggaagttctggggtgtctgagctgccaggaagttccgtcgttcttcacgaggaggttctgagccctgttaaaatttgaccgttgcgattgtttttagtatttttcaggaggaaaaagtacgaattaccccctcgaaatatcgcggtcggccgaaattctcccccgaacccgaaaaccagacatcattcaccctaaacttttaataccggacgaattacccccctcgacccaattcagagcagttttgtgctacgtggcgtacgcgtggaaacccagtcagcattttcctttttttaaacatggtggggcccagctgtcattctctcccatctccttttcctcatcccctcttcctctctctctctcgcgacgtcaggcgcagccgcgcgggtggtcggcacacaagggcggcggtgggtggtcggcgctcacggcgcgcgcgagggcgggcggtgggtggcggcgtgggagcgggatgtcggcggagaagcgaggcggaggcggagaggagcggtggccggagcttgttgacgagcggtggtaggcacgacgaggagggagaactggtctgtgggctccagacagcagtgggtggcgaggagggggcgtggctgggagggcgaggcgagcgtggctgggttcacgaggcgagcgcggtgggcggccgggagggcgcggcggcaagcgagggtgcgggcgcggctgggtgcacaggcgagcgcggtgggcggcatagagggtgctgtggtgggtgcggttaggtgcacgaggcgagcgcacggagattccggcgagccctctcctcccgcctccggccaatatgctcccactgcggtggccacggggaacatcacgagctcccgcagcggtggcggcggcctccgtggcagggcgatgtctgccaaccgcttcattggtatccctcgacgctccaggacgagcctcctcttccggcgctgacgcccgagtatgtcggtctttgcaggaaggcggtggagtacttcgattggatgtgccgtgtacggccggcctgacgccatgtccaacgcgttcaggatactcttaggtgttcttccgatttcctcgtcgttgtgatgtgaatgttttcttgataatgtgttgctgtttcctccctagtttggttaactactagattgcccatactatccataattgaatacctgcgccacctcccaccaaccgcgcggcagcacctaatgacgcgctgccgcccaccgccccctcgcgtgccgaccgcccgcgcggccgcgcctgaagtcacgagagagaggaagaggggaagaggaaaaaggagatgggagagaatgacaagtgggccccaccatgttaaaaaaagggaaaatactgactgggttgccacgcgtacgccacgtaggacaaaactgctctggatttggtcaagggggtaattcgtccggtattgaaagtgtagggtgagtaatgtctggttttcgggtttaggggggaaattcggccgaccacgatagtttaagggggtaattcgtactttttccttttcagcaacatctattcacccccctcccctctaggctacatctttaagctttcaccattgtcgaccacgtgtggtgtaccataccgccaagtcgacgacgaccaggtaggttttcccaaatatgatactcaagtgatactaatatatgagagcactaccagcttcgaccaatagaaatagagctattaccttacagataaggggcccgaaccttgtatagaccttgtatagaaatccttatctccatctcttatatctcaatctcgcatatgccctggtaccaacgatctccataccatgcaaataccgtagtcgtgatctacaacatcgtcaagtagtatatactgttttaaagttggctgcagtgtatactggttttcggtcaatattagtatatgcagtttttttttacattggtatatactgtttttttagtagtggtatatactatttatcagttcgtagcggtatattcttttgtttaagctagcgtcggtatatactgttttttatttactagcagtatatactgtttttaaagttagtttcagtatatcctatttttcaattagtagcagcatatgctattttaaagttagtatcggtatacggtgtctttgtcaggggttatggataccacatacctaatagtagttgattaaatctcggcagtaccaataacctgcggatataggaggagttccggataagaaaagacaaccacagttctacatggaaacgacaatgactactcggattgtatccatattggtttcctagttctacttggacaaggggacacttatgggtataaatacaaggccccctagaaggagaggggacaatcaacagacacatccaccacaatctacggaacaatagatcaagacagaagatcaacatataagccaacatataccaagacaagacgccggatatcgacttcagggataagcacggctagtcccctacagtgtctccggatactgtcaggagagacatagcgttgtctctgatctcgccgggcacgaacttgaggaggaagactaccctgttatcaactacgagtcagaccttcagaccgccatgtcgacaacagttagataggctaccccaaatattgtactggtgtgattatggtgaataagagcaataccggcttcggccaacaggatgtagggttattacctgacaattcaggggcccgaacctatataaaaatccatgtctccatcttttttacctcagtctcgcgtatatcctagtaccaatgatccccatactatgtaaataccagaatcgcgacatcaaacatcgacagtggcgcgccaggtagggggattttggtgcttcaggatttagacgagataggtttaagagatggattcttcaacaacaagctactcgacgacttcggctatggaagatctaacctgaccggagtatgtcttccgacgagatcggaagcataaccgaaaattcggtccttcgagatagatagcttcaagacgtcgctaccgctgcggcggacatcgactcagccttcctcatccttggttgactcgatctccaacgcggcgtccctagaaaaaacagcaaagttacggccggcgaggatatgcaactttgttcaacctcggacaacaattagatacggagtactacattggactcccatgcaaactagtcgtgctcctacgacctaaccacaagtaatcaagtcggacacgacaacagctactgcatgcccatgattgagcatgcacatggacaactgggaggaaagaaaaaaaacacacgtattcatacagtacgtgtccatcaagttagtatattaatttttttaattaatctactaatttcgtagatatatccggcatatatctacacaggtacgcattattttatataaaattttccgtacctattttcagactatacaatattgtcagatccaaaatttattatgtttatctagagcatgtattttatacaatatctattgcgtgagtgtccccggtgttaaatcgactacaatctaacgctgggggctcgctctatttccttccgtataaatcatgcttgtttacggtttacataatgcctgatatttacatctgctcgttatatcctgataatactaaaagatccatgcagtttttcgaatacatactcgacattatctactatatgtcttgccttctagaaaatatttttcaagaacaattgagcactcgagtaggttgtggtcaagtacactacattatcgagaacgatctcgacgaatgcagagtcgtcgcgcccaacctaccaacaaagaccgactacctatctcatagcaccggccatggctggactactcgagaaaaggttgttaacggataactcctcgcaaacgccgtcggcttgatcacccgacatgattgcgaacggacatccagatatgctacaagttgggtgtgtgagtcatgctggccacatgagacgcacatgtaataaaccaattctagcacctccattggtgttcgagagataattctacacattcgctggtcctcgaaccagtacatagcaatctctcgcaccgcaacctccattggtgttcgagagataattctacacgttcgctggtcctcgaaccagtatgtagcactctcttgcaccgcaacctccattggtgttcgagagataattctactcgttcgctggtcctcgagctagtacgtagcaatccctcgcaccacaacctcaaatggtcgaggtacgactacagcaataacgcagcggtcctcgcaccacgactgcaaatgatcgagagacactactcactggttctcaaccagtcaatcgtagtgatctctcgtacatttacttctagtggttgagttacgtctactacctggttcttgaccagaggtgtagtgattctcccattacctctacttcaacaaagttgatatcaggtacacaataatgccaagtgttttacccagagatcccttaccacaaagacacctagcgttgaaacctatcctaatgtccctttacgctgtcttgacaaggcctccgaggaacctaagagaacttcggctggggacgcccagagcggataaggccttgtcggatccttcagagacgaaagaccatgtaagatctggtcgtgtaagagttctcgccgtgcgtattaaccaagccgtgtaatcggaaattgggttttctaacttcacggctaggggctaggatcagtgcttgttcaaccgaggcaggtaaaaggtccaagagtcttatcttccgagaacaattctccgatgagaaggctgggggctagggagagtgtataactcaacaaactgactgatcgaagtcggtaaaagagtagatgctcatatacaaaacattggtctgtaagtttaattcattttcggttttccatacattctataacatgttaccctttgagcgttcgctcgggggctatttctatctaatattcttttctgagtattgatttcaggaaaattctattcgacattatctaaggctccatgtctctatggttctacaccaagatcgactaaggcgagtacgacaaatgttgacaaggcttcggtgcagattctacgccttctcgatcgctcgagaacggttggtggatctcgacaaggaatacgaaatgaagaaatggtgtacccgccgagataaaatttcttgacttcaatccaaattctcgattacagcaagacgggagacttagtcgcatgttctgtacttttttggttggcgtcggagattgactcagacaaaccctttaggtgcccgcacgagactgataaaggaagtctaacgttatctctgaactcaccgagaacggtcacatgagctcgataacagttactccaaggcctgcgcgcggttgagaatatgaattcgttcatttgcatcgaagtcgggggctactgtcagggttatggataccacatacctaataatagttgactaaatctcggcagtacccaccacatactatgtcctatacggaaacaacctgcagatataggaggagttccgaataagaaaagacaaccagagttctacatggaaacgacaaggactactcggattgtatccatattggtttccctagttctacttggacaaggagacacttatgggtataaatacaaggccccctaggaggagaggggacaatcaacagacacatccaccacaatctacggaacaatagatcaagacagaagatcaacatacaagccaacatacgccaagataagacgtcggatatcgacttcagggataagcacggctagtcccctacggtgtctctggatactgtcaggagagacatagcattgtctcttatctcgccgggcacgaactcgaggaggaagaccaccctgttgtcaactacgagtcaaaccttcagaccgccatgttgacaacagttagataggctaccccaaatattgtactagtgtgattatggtgaataagagcaataccggcttcagccaataggatgtagggttattacctgacaattcaggggcccgaacctgtataaaaatccctgtctccatctcttttacctcagtctcgcgtatatcctagtaccaacaatccccatactatgcaaataccggaaccgcgacatcaaacgtcgacagtcttttactagttagtagttggcacgggatttccagttatcggagaatattaaggtgcacagaaggggcgagaacgtcggattttttctacaatagcctttgctttttgtgtagtttgaagccaatg

SEQ ID NO: 38421 - DNA, 5723 bp, Oryza sativa
tgtcatcatgggttcgcacggtaagtgtgcgaactcatgatgtgttcacggtgtttgcagggagaaaagcgaactcgcacaataatgaagtagcgagaacgatccgtagcactgtgaactcgtggagcggggatgctccctagtccccgttgagcagactcacatgtgtgtccacgatttcgcatccctaatttgcgaactcgagcgtctgccatgagttcgtatctttgctctgcaatgatggtatattttaatcaattctttcaaatgtgtgtattcctataaaaccggtgaaaaaaacatatcttcaatttgttttcataacttccatacacatttcatgttgctaaaattattaaaagaatatgtaaaattagacaaacactagtttaggggttatatgaatggtactgtaaattttagagggcacaactctttatcctcctgattttgttactataaagctatcgagtggttatgaaaggacgtgacctatatatgtacatgctctgcgattaatccaatctatcacgttgagtcattccttctcacaaccttaattaaaaacaggaacctacatagcaaatgacctttaaagctaggacaatgttttggcaaaaggtatgccactgtttttcaaccaaaggtgattgtgcccaacttctgaaaagtgaaaacattagcagagcagccgtaaacattgaaagtaagtaagtgccattagagtacatttgtgctgccctacaattgtacatgtgtgacaatctgttcctctttttgactcctgccccattcccaccaaacaacagaatgttcttccaaagcttgatccacacgcgagagcatgctggtttgtcaaggattaaacgcatcgactttcaatttgctggcgtattaattagcgaattactatttggcaaaaccccagcttgagatttagaaatgccactgttagtgttagctgttagggtagtacgtataggctggcaaatttaaatcatacgtcctctaggcaagaagcttaaattgcctctaaaactaggaaccctgttgctgcgttcaagacaaggttttaaaataccagtctcctaggccagactggttaccgaaatgtatagcacttttttaaaatgcaactgcaaaaatctaaatatgaatttgaagtgatttatctgacgatcacctggtatttttggtgatccatagttgaagcaactgcaagttctgaggctaaacacatgcccagcacgtgatgtgcaggagaatccaatgtcctgttcatctctcttgttaatgaggcagcagatcttgtcccaaccaaaacacagtggggggtggtgcactggtggccttcagtcctacatccccttcttcatttctcttgttaatggcctggcagatcttgtcttcccctacctgaaaaaactcacatttattatgcaaccaatagtagcattggccatggtgtctgttcaatctcatcgttttgcccacatctgattataaaccgtaacatttattaacgataacaatataatttatgaggtaaacttttatatacgagcatgattaggtaataggtttttgtcattttaaaccatatttttttctgggtaaaattgataaacatatagatgcatttagtttgttaccaaacattggtaatgcctaagtaatttttgcaacatcatatttagcatattttatcaaaacttggtgatgctatcaatttaccaaaattttgatattgcttaatattggaaatgttctttttgacattaatatgaatatatcttatatcttcttaggcaacaacaatatatatagcaaaagtagtccatatagatgggacccacatatatggactataattattgctttcttcacaatgtatatagatagcaactagtattaggaggagacaggaaataaagataaataacatatttattctatatgggtagcccatatgcttatgggtggcttttgctattttcttgctatggactagttccacaatgtggttaggtggctgaatgaaatattttattgcttatggactagttttagactacattgtggatgcccttagtgacttaaaagccaacgctaaataataaattataataaaaaaattcaaagtcaactactcaactctaaagttaagatttacttcatccgttttacaatgtaagttattctagcattttccacatttatattgatgttaataaatctagatgaatctagacatataacatcattgtgagaaatagtagaatgacttatattatgaaacggagagagtaaaatttaggatttggttgtgcttgataagctgaaagagcaaacgatgaagatgtgctgacagtaataaaaatgggttcacaaattttgggatggagtaaaggttacaaaaatggcttccaaatttgatcttgagcttatctgtgcagtcagtgagctgtactgaactactgatgaacagttgctgaagaacatggaatttattagtaagatggaagagaggttgctttgcttcagctcgagtgtactgcattttcctatgctggattcctttgagtacgtgtaaatttaacacgccgccatcaataggaatctggtacaaagaatgatggagcaggggcatttgaatactgtatattttattatcaacccaattcatcaagcaatttgcagcaaatttgatgcaagtctgaagaacaaaacctgaatttcatctgaaccgaacccctgcgaactcctacattcgagattccagttagaaaatttgcattctgctgtcacaaattttactaggacaagcacgaattgctcctaaaagttaattttttttatatatatcgcacgaattgttcctaaaagttagtaagaaaaagagagcaaaaagcctttccaaccatggtgtttggtgggctcagaaaggaaaaaaaccagaatacctaacattcagttaaatttcggtcaagtacagtgcaaggcagatgcacgtaacaatgtaacatcacggcaatgagctggttaatctaatcccttaactaacaaattcccaatctcacagggccccagatctctgttgccaattcaaaaaaaaaaaacagcttaaaaattcgtaatagagagtagcctctctcaccttcttcaatggcaaagcttaaatagagtgaatgggaagctagagccatggccatcatcatcatcaacgatgcatccatggctatagcctaagaggaagaggaagaggagatgatgaacccatcacacccagcccagcactaactaaccctcccttcaatccaactccacctcaatccaattccattctctcgctcgcaccaaacagctgcaccgattttgttcttttcccacttaaaaaatttggatctttttcgggtgctaaaaaccctttctttcttttttttttcttttctgtccacttcgttcgtggtggagtggatttggaccacgcgcaccaccgcaaccaatcccccttcccacgacaaatcccaatcggaagcaagaatacaagggagaaatcgatagaaatcgaccctgaattggagccatttgccaccaagaactcccccaccaggagaggaatccatcatttcttggcccactccaccaatccgaagaaagaaatcgcgagaaatccccaccagattatagcgcatcattagcggaggattagagccaagagaagagaaaaaaaggtggaagaaaagcaatggcggaggtggcgctcttccggggcccgaccaacctcgcttcacccgcaagccgctcctcctcctcctcctcctcctcctcactgcgttatttagccacctccgatggcgacgtgctcccaagaagaagcagcagcggtagcggcagcagcctgggatctacaggaagcttgggaatccaagaacggcgcgaggaagagggaggagaatcggaggaggaggaggaggagtggtcgttcttggcgctgctgctcgcgctgctgcggaagtcgctgctcgggtgcagcgcggaggacggcggcggcggcgaagggatggagatagggtggccgacggacgtgcagcacgtggcgcacgtcaccttcgataggttccatggattcctcgggctccccgtggagttcgagcccgaggtgccccgccgcgctcccagtgcgaggtctgttcatcactaggagctgaattcttcagagtttcaggccattcagtttgtagttcaggtttaattttctgtgttcaaaaagtggtaaaccttttttgtttgaattcttcagagtttcaggtcattcagtttgtagttcaggtttaattttctgtgttcaaaagtggtaaacctttttttgtgtgaattcttcagagtttcaggtcattcagtttgtagttcaggtttaattttctgtgttcaaaaaagtggtaaacctttttttgggtgtcattgtttgcatttctgctggagttttgatatgcattgttgcagaaatgttaagagtcctctaatttaaatagtgttggcttcaaacaagttgttcttaaagaagaaatttgagcctgtttcctaaatttaggttgcattggtgtttgcaaagtatggtttttgtttcggttgtggtaaaaagaaaagttatttgtttattaaaaactctgtgcgactgtgccgctttcatctgaattggtagaaagacattttttatgttttctaggtggagttttaaattctgtttgaattaagtttgtgtattatactccgtttggttttggtctttgtgttggtagactttataacctttgctgcatttgaaccgtggtagacaaaatgtgcatgtcttgatgattggggttaggcttcggaccaccactctagaaatgtagaagaagtgtgtgtgccacatttttctccatcactcattaataatggtccaatcatgtcttcagatgtactgttttttgatggcatcgcatgatttttctgtagctgcttactaccttgtaaaacttgggtggaaaaaataccttcaattataaatggtactgtaatcaaactgttgttttttctactaacaaataaggctggttggaccgttgtagtggtagtttgttgtaaatcaattagatcatgtgttagagaaaaaatttactgttatatttaccttattaaaggtatttacttagtaatagtagcatgtggtttgcctgctccttcatcctggcgtttacagcggtagtatttctttcctgttcctttaacccatcaataattgtggtcctgtttgactcataagcaagcacaccaatttaacccatcaatattcatgggctagagcttaaaaggtatgcatatgattatctttcatcaaccgaatctagtaagaaggaaaacgacacctttaattaaacaccataccagaagaaattgtcctaggagttctgttgattgacattggaatatatatataaaaaaggatcatggcatcacctgttattagaaagctatgagaaagtgtcatgtttgactaatgatacacgccatattaattggatgatccattcacatttgtactttcattttcatttgtctacatgtgtttgttttgcgttttgaacttgagttgcttgaaatattgattttttttctttgctgtcctttctgacttactcctatacatctatactaggaaaacagcagatacaataagg

SEQ ID NO: 38422 - DNA, 5242 bp, Oryza sativa
acaatgtttttatgtaccatataaattgttaaatatgtttcttaaaaatatgccttgaccttattgacaaatgctcttcagctcttgttttcatacattacgttgattctacgacaagttttgcaaacttaacctatttgcactgataatatggaattttgagcaatatcgattatgcttaatttttgtttgatttagcatccgagattgtggctgattaaaactttacttgcagtgcaagtgtctttggagtttcaacagaatcgatgcagtgctcctatgattccagaggaaacagtgtcccaacaattctcttgatgatgcaaagacgtctttatgaacaaggcggtcttcgggtatggcttgttagattttaattgattttaaaactatttaaattggttactgtttttgttttaatcagtgtctttgtttgtactttgcaggcagaaggtatttttcgcataaatgcagagaatagccaagaagagcttgtgagagaccaattaaatggtgggatcgtgccagagggtattgatgtccactgtttggcaggtctaatcaaagtaagcttctttctattattttgaattatgtgattccattgacatcaccagtatcctgatcacatgtacaatacttagatagctgttgattattgtctgtactgaactagtggaatttcacaaaaagaaaaacacctggcagagaatccagacttcctatggaacctgatcatgtcctttccatttagaaagatttttttcacaatttattatttgtcaacacatacaaaattgaggctgtgctgtcagcaatattctgttgcagaatctaatatttgcttttggaagcagttataggtgcggtcacacaaatttgataacaaaggtgtattcccaccccatatatattttcgcatgttttccaggcctggtttagggaactcccgagtggggtgctggactcaatcccacctgaacaggtgatgcaatgccagtctgaagaggactgtgctcgtgttgccaaatgccttccaccaactgaagcagccttactagactgggctgttaatttgatggctgatgttgtccaagaagagcaaataaacaagatgaatgcgcgcaatattgccatggtttttgcaccaaatatgactcaggtagtgtgttatcctattgcgatcatggtactgatatttcattaggtggattctaactgttgtcacacatgtaatgcagatggcagatcccttgactgcattgatgtatgcagtacaagtgatgaattttcttaagatgctaatacaaaaaaccctcaaggatagagaagagtctgatctggatgatttgtctcttcctcagaaggacccgtctgatgaaaatggacaccagaccaccggcctctcgcttgattctcaccctgacgaaggatccaggcgtccctctttcgtcagcgaggagccccttctgaacagtcccgtgcacagcactgaagagaaacctaataagaccaatcttgctgaaggaaaatttgcggattccagttgcccggaaaatgtagccctaacgagcatggagacagagggctctactagttgctcccaacctgctctggcagcagctgccgctgctccccgtgctacagctatgaacttacttcaaggcaaagggagccgtagcctgaatagtaggaggactagaaagggcaaggtgcagtttggaacacgtgctgctccagcatctgagaaatcaaaaggtgcgagcattgtgagcaggataaactcaaaggttgaacggatcgaagcgtggcgatgaaatcagaagttgccgcaaattgttgttgtgaagtagatgactgacccaatgtttcctgtttcctgaaaataggaccaagagctgtgtgctttgtgcattttgcattttttgatgtgcttatcatttcttgttggaccatgatcacggtgtttttagatcattttctgttgctgctaacttatgtatcttgtttatgagtactactgttgtctgagtgaatcaaacagactgttgctttccccttgtacataaatgtctccaatgcctaaaatcttagctatctgagaattgttcatggataattatgttggtacttgtgtttattctcatttcattgtgtacctctttttatctctcattcttctggaatctggttggatcaaccaactgttccagcattttcatcttgtttgcaagtactctgttctcatatgtttgaaaatttaagttctaagttttgaacattggatcctcgattccaattcacattgcgttaattcatccacttcatgtttctgaaagtatcgtaatttccctatactgaactatctgaaatgtaactctcaccatcttatccatgtccatccattgcatcatgtagctttgtcctactccctccttcacgctttgtcctaatcgtcaaaaagaacaatagtataagcaagaaacacatctattgcaatttcatccagacatccaggtacgcttcagaaagaaaattcagacagataagaggcagccgagaaatgcaaatttcagcttgctttctgcctgttcagctgtaaatgggatgaattgcactccattgttgtgacagtcacatcctttattccctgtcagttttgaaagcagctacacattccatcttcaagatcacttcacagcggtgtgattctcagtgacaagaacactactggttggggaaaatcatcgcgccattatcagatcagttcttgcaccacgtgaaattggaattgttttttgacagaacgaatggaattctgttctagtgatcttatcagagtttacatcacgggggaatatccggtgaaaaccatcgaataaaaccggacctttttcacgggtttgatggttttcactggatatttccactgcatcatggtctacaatcatatctcagtcgcacacagaagtggtaactgaagcattttttttataatacaaatattagcctctacatccaaaatacatgtgaccaagtaaactgtgtgtaaaaagggaggaaaatacctccaaggaactgacattaagaggaagaatatgtgccctatctcgagacagagagaactcagaaaattgatctagcttcttacttcatagagacataaaagcatatggatcatgcatgcaagtcacagcaagatcatggcaaacatgaggacaggtcaactcctgttccagaatcagaatagtgaagcaactgacgtgtcaagtacagataacagatttcatggggctcagagatgcctcctctagctgcattattgcacaccttttacctgctagtagcttctgaattctgatcaagcaagccaaaaagtacttatattatataagatcctgaattctgaacaccaacacttgtgcttgcagcttgctgttgcagtggcagtcatacagaagtacagaatcgagtagtagtagtagcatttgcaggcaaaatgacaggtctcctcaagtagttgctctccacttgtgagaaaatattccaattccacagccacatacatatgcctgaatctttctcagcctcttctttttctctcacaatatatatgatatatatatctctctcttcctctgaattcatcagagaattactcaaatttcttcctgccccaaaatttgtcagtcacaacacatattttatatacaaatacaaaacatttttttctgcaaattgtccatctctgacgcctcatctgaattgactgacgcctttttgaggtaaacgcagtgacacatctacttaagcactttggctgaagcttctgcggcatatcttttttgccggtgcaaagctttggttcttggccggtggcggcggcgcgcatggcggcggacggcggcgcgctgaggcggctgttcgagaagccgctgccggtgccggagaacccgacgctgctggaggcgctgtcggcgtgcaaccatgtgcaccaccgcaagaagctcgtcgacacggcctccttcaccgagatcttcggcgagctccacttccaggagaagccggtggacgtcgccgccgccgcccggttcctgccgccgccgccgccgcctgttcgcgcggcgtcgtggatcgacgtcgccgacgacaagagcaaggacggctcgtccctggacgcgctgctccggccgaagtcgtccgccgtcaagaggagcgccagcttctgcctcaagagctccgagtcgtcgctgctgctctgcaccgaggggctcgggacggaaagcacggtggacgccgacgacatggtcaaggacggcgacggcgacggcgaggccatcccccgtggcgaggaggagacggacggcgtggaggaggacgacggcgcggggagggagaagcggggcacgccgacgctggcaccgacgccgccgacgttcccgccgccgatacggtcgatcgggcgcggcgggaagccgtgcgtgtgcttccggtcgttccgggcggaggggaggttcgtgctgatggaggtggtgatcccgggaaggagctcctgcaggcgacgcgcgagggcggtcgcctcacgctgcgcttcgccaacgccgcggccgtgggcggcggcggcgaagcagacgacgatgtcaacgacgacgacgtcgatggcggcgagaccaagaatgcatgcgcagcaagagatgatatgctagctaataactgcacttgttaattaagaatttaagatggctgcaagttgcaacgaagaacttgatgcttttgaatatttgatcgacgtgtgtcaaatcgccatgcgtgaatccaagcaaacagaaaaacaagtttgtttcgaatcaaggagaagaagttcataagtggatcatttcagaccttcatggttgattcgggggagcaccggttgagtggtatggcatggactcataatttcttttagagcaatgctacacgtactaaatttttcttactaaacttttactaacaatcatctcaaccgtttgatttaagtagatggaagttacaaaaaatctagatgcactcgtagcataacacatcagtgttagtaagaatttagtaagaaaaagttagtacgtatagccttttcctttcttttaaggtgaatatgactgccaggttttgccaagcagtataaattttataaataaaaggagttatctacaaaggagccacaaagaaaattgttcttactccctccatttcgaaatgtttg

SEQ ID NO: 38423 - DNA, 8101 bp, Oryza sativa
tgaaaaagacgaacggtcaaacatgtgctaaaaagtcaacggcgtcaaacatttcgaaacggagggagtagattataaccaatcaaacactaattgttttaaatagtgcttcattctgcacatatgtaggagaatctctctcttaaactgatttctccaagcttcgaaagttggatgcacattatgaaagattagcatatttctctgcttccaaatatgccagcaagaatggactcatagttttcatccactaggataaaaggtatcctattcgcgtatataagattttaataggattttagtaaggctaggattataactttacttcattgtcatgtcaaaaaaagttacaagaacatcatgaaagcatttttaataacaagatcactagcttctatctcttgggaaatttgacctctccgtatgcaaaccgggaggagatcatgcacggtcatttccgcccgttgcttgcacgatcaacgcgatcaattaaggttacttattagcacatgattaattaagtattagctaaacatttgaaatatatattaatatgatttttttacaataactttcctataattttttattacaaaaatcacattgtttagtaattcgggaggtgtacatgtggtaaacgaggaagtgaaggttgggaatcttcacttaagaacacgacctaacacattgatcggtaatgccaaaacttgccctcctccctcagcaacatattaataggggagatcaatgctgtgtcgtggtgatagtcacttcacgataatcttctgcccgaaaccataaaacctcttacgaccccaattacttgtgttggagggagaacttgcgattgtcctagggcattgtagatggccctcggaaggcctctatggaatcaaaccgcgatcactttgtctgcgctactgctataacacaaatattgcactaatggcttacctatcagttttttacttttaaattccgcatatattaggatgataatgtttaggctaaacaattagattagtatattagataatttacaatatcatttttatgtaccaaaactatagtatttcatctcttttaaatagtagttgtcgttttaattagcttttgttttaagtcgatcattaaattataaagatatatatagttttacattacaagattaatttatattttggatatactatgcgaaatactttcttcatatataccacataattttattttattaaactaatgaattaacatgaattgatagtcaaaattaaagatgtctatcttagaacgaagctaagacgataattaattaatttgagtacgtgtctatgtgaccggccggtaattaaggcgcaagagtaaattgatgcagtaggtaatcgctcaagcatacatatcttctgtgctgcatttcacgcacaaaatccgatcgagcgagtctgatgccaacatctactaattcagattcttgctagctaggtatagctcgggcccaacgcttggtgccattatctgaaaatgaaagaaagcatggccacacgcactaaaaattcatccaggaatttttgggcgtcaaaatacatttcatttgcgttgaatggttttactactcgactggtcatatttatctgacgtcaggagtacatgaaattgataagttttttttatgagtacaagttagaacgcgtgcgtgcatacataccatacccatgcctatgtacacctttgtggtgcatatactagcacatgccaaataaaaaaaagatccgatatcacatagcatgggtatgcacgcccgtgtgcatgtactccctctgtcctaaaatataataatttagaacccggatgggatattttctaatactacgaatttagacagacatattaagagaactattttgggacgaagggatattgctgtacatgagattaaattttagtaaaatatgagcacatgtgaaaaatagaaaataacgaatcaaactaaaagtcgcaagttaaattaagagaactattgtacataaagaaaaccttacggagttaaaacaattacgttaagataatacaattagactgctcctagcctcttcacaattaggatgaacacaatctatgccttttttttttaaaaaaaagagaaggacgatatgatcacaaatgtgatggcactagtacagaaatcgttttttccaggcagcccaaaaggcattttcgcgtgtggaaggctgacctgtctgcccaggatggtctgtgaagatcatcatctttgcgtgtgggctgctcaactacacacgaatatatatattcgcaggcaggccgcttaacgcgaccgcacacgaagatcgagtatctttattttacaaccaaaaaggtttctttattttacaactaatatgtacatcattataattaagatagtatatattgtactcattgtacacaatcttatagctcatccgttatataaattaatctaataactgacaaatataaaattttaggtcgaccactaattaacaaatagagcaagatgtacatcttgatttatatattattctactacttcgcaacctcaaacccttttgaaactgtcatgatcttgtatcttaatttctggtcctactataccccccttttctttttctttaaaatgaaaagcatttatgcccttttttctggctcactgtacgtcacactgtatactacgtgagatgctacaaacagggcttgactcgatcggctgtcccttcttcttttccttgatgaaagaaccctgcaactgacaaacaggaaaagtttggagaaaaaggcagggatcgatgtaaacttgctggagcttttcgatgcagtgagaaggtcgtagctatcgatcgatttcctttctatttcttttaaaagaaaagaattcatttgagacattgaggtagctatcgatggtgcaatggagctagctagatttctccttacattttctgcctttcaagtttagatattcccatggatatatatggagttggaccatggttgtaaatgtccgcggtgcgcaattctctatgtccatatcatacttcctctataaaaaaaaaaccaatctaaaattggattctttttacatagctggattttttttacataggtttagggttagcctcggaccagatgaccaccatcggttggcatatgctatagcatatcaacacaaccaggctgatgcttatcagcataagcttttctatcatctgatgctacagtccaaggagccaaccaataggctgtagctgaaaatcagccaaccgatgaggccgataacttcttatttggcctaagagaaaattatatggtgaaaatgtatggttctttatgggctttcatgcctaggccctggaccatggcccaggtggcccgggatcagacattcagaactgagaccgtcattgaccagagcttctctcttggccggcctttaatttgtcgctgccgaattcttccacaatcaacgactgttcgtcatcactaacctcgcggcacagaaggattaattcgtagcactaatacagaattgattattactgcaatataacagaaaaataaatcagtaacaattctaaataatttaacactgccagattaatttaccattcatcagcaagcatcgatattgaaaaccaacctttcatggcctgcagatcaaacacataacccctgaacaatctcgttgccatcaatattcggctcaaacgccaaagagtaagggtgcgatcctgatcataaacctcatccagttagctggataggagatcaagatggaaattaagtcgactaattgcaatatcgcgtggttatcttatagatatcgtgatgatctcgtggtaactttctcatttttaaaacctcatggttttccacgataactaagtaccgtagtaattatcatgatatcgctgagtagcagtagccatcataaaaagggtaaggaagacgatggctgatgcaatcgatctggtgagctttgaactgaattaatcaaaattactagtagttaattactctatttgtttcatattataagccgttttgaaattttttttaatttaagtttgattaagtttataaaaaatatagtgacataacataaaataaatatattatcaaaatatattcaatgttagacttaataaaaccaatttggtgttttagatgttgccaaattctttttacaaatttaattaaactttgaaaaatttaactaggaaaacaatcaaaacgaaatgaaacggagtaagcgctatcctgagactttctgatcaggcagctgcaggcaacaaagcgtgttgattcagcaattaactgcgatactatcattattatcaactttacttttaattagacattgtcataacacacatgcatggatcattgaaaaattaataggccatttggaacaaatatacgaaagagacccacttataattaattaagttttataaaaaagtaatttaaaaagttcggaacccttcccacccagtaaaaaaacgaagcagtggattaacttattaattaaatattaattaatacgattttttaaagcaactcgaccatataattttttataaaaaaatacagtttagcacttgtgaaacgagagaaagatgaaaaagatcggcatgcatgacaggcatgcactaaaataatctaactaattactcggccaaccggttgctgggaacataacttgaatccatccactaatccatcaaattaaaatattaaagagtttcttgcccagaagcaatctaccaagacgaggacttcagaggagagatgaaccagtcgctatagatcgatcttctagttgaccacttcagaaacatctaacgctcagaggctataaatatggctgcatcctttccatatggccaaagcatcagatatagctccatacacaaaacaacaatcgactacttctacaggatctgtagatcaagagcaaaagttccatcaacttaaacatggccgcctccaacttctttcttctcacagctttcattgctttggtcgctactcaggccatggcttctgatcctagtcctcttcaggacttttgtgttgccgacaagcactcgccagatatattattttatcactgatcatgcaattgcatcaaattgattacacattcatgttgtacatatacatgtttctagcttccgatctgaccattgtatgttcttcaatgcagtacgtgtcaatgggttaccctgcaaggatgcaaaggatgtgagtgttgatgacttcttcctagcagctaaccttgacaagccgatggacacaaccaagagcaaggctggatccaatgttacattgatcaacgtgatgaaactcgcaggtctcaacacccttagcatctccatggcaaggatcgactatgctcccaaaggacaaaacccaccacacacgcaccctcgtgctactgagatcctaaccgttcttgagggctcactctatgttggttttgttacatctaaccaagcaaacagagaaaacaagctcttcaccaaaacacttaacaagggtgatgtcttcgtgttcccacagggtcttattcactttcagtttaatccaagctatgataagcctgcagttgccattgctgcacttagcagccaaaatcctggggcaattaccattgctaatgcagtatttggatcacatccaccaatttcagatgatgttcttgctaaggcatttcaagtggacaaaaaagccatggattggctccaagctcagttctgggagaacaaccataactaaattattgatgcttgataaggttcagaattagtgattggtataaaaaggatttgttgattattatattagccaaaggctatatacttcatgtaatcctaaactcgatatttatacaattctttttacgaataatgtataacagtacgcacatatatatgttacattatgtatggtctggggtattaatttaatatagttgatttcttgggtattttttaacactcataaagatggataattaaaatcatattatagtagggatgcatttccctcgttcaatacttatatttgttatgtagctcacatgatcatagtactcatccaaattaatctattctttttcaattcttgtgattatcatgaaaatttgaacgcttcaaaaacatataaaatttgtttttagatgtgaaccaaattcatttatatataaccgttagttactgacaaaaccaacaaaataaattcaaacaaattatctacaaatgaatttttgtttgatttttttataactagcaaatctaaaagtatgataaacatattataatgaatcaggaaacaattgtgtttcacgtatcatcatgtctgacaaatcataattaaaatttccaaatacagaaaaaaagaaaaatctaacaattcaccatcgcccgttctcgtcgctggcattgcttaaactcatgcctctgacactaattaagttgtagtaaaaaaaattagaagatttggtttctgctcgtatgaaagagtacaataataagcaattttgataaaagtacatatactacacgtaattcaattggtcatatatccatcatatctctattattataaaaattgaatatgtttttgccggtattttgttatatcatccgtgtatgagttggtttttaagttcgtttgcttttgaaaataaatattcgtatttgaattggtttttaagatcgttcacttttagaaatacagaagaaaccatataagaaatctgtttaaaaaaaactcgcatactaacttgagacgatcggacgtctaactgcagctcatgattttctatatatatatatatatatatatatatatatccaagcgaactgctacagtgaatttcatcttaactaaatcatataatagtaataagattaaaataaactttacccgttacaacgcacgagcaatttttctagtatatatcaagttaacaactctgctccagcacatgctgaagaggaaggaagagatcgagttcgatcgggctaattaacagaaagaaagggcataatagttttactaatctctttttaccagttaaaactactactataatgtttttagaacggatgaattataatatagtgcgcgcgaaaaggacaaatatttccattattggaactatttctttatctaaccctgtttgggtatccagctgatcgaccaggagaatgacgagccgccggccgatgtgatcgatcgatcgatcagccggtgatagagctttgaactgaaataatcaaaactacaaattagttgaaactgtctcagggcaacggggagcatgttgatcgattcagcaattaccgatatcctttttaattagcatgcatgtgtgctagctcttgaaaaatcagaccttattatattgatgtaacacacatgcatgcttaatacgcggagatcattgacaaattaaaagggccatatggaacaaagttactaaaggagtaaagaggccaagtatacgtacgttacatagagagaagacatggtcatatgtttatctgcacctgatactgtataacacagccaggcttcatcatcaatctaatgcatgcatgacaggcactaaaataatctaattgattaactaatcggtcaccgtgttgctgggaagacaacttgaatccatccactaatccatcaaattaaataagttcttgcccagatgcaaatctatcaagaccggttcagactttagagcagatgaacaagtcgttagttcagcctttttttatttttcttattgaccacttcagaatcacctcattctcagaggcctatatatatggatgcatcctttcctggccaaaaaccatcagctagctgtagctccatatacacaacaagctagcatcgagtaatacttctgcagaagcaacagttccatcaacttaaacatggcctcctccaacttttttcttctcatacctctcatcgctttggtcactactcaggccatggcttctgatcctagtcctcttcaggacctctgtgttgccgacaagaactcaccagg

SEQ ID NO: 38424 - DNA, 12941 bp, Oryza sativa
agttcaatccaagttatgataagccggcagctgctatcgttgcacttagtagccaaaaccctggggcgattaccattgctaatgcagtatttggatcaaatccaccaatctcggatgatgttcttgctaaggcatttcaagtggacaaaaaggcagtggattggctacaagctcaattttgggagaataaccataactaaataaattattgatgcttatctgttgaaaattagttatctgtagtaaaatggtttgttgattgttagtagctaaaaattgtatacttcatgttatcctaaaaatatgttatttgattctttttacgaaataatgtataccactacgcacatatacatatgttacgtgatgtatgatctgggatattaatttaatatatttgatttcttggtacctttttaacactgaatgatacataattaaaatcatattactagggatgtattgccctcgttcagtacttatatttgttgtgttgctcacaagatcgtaacaagcatccaaattagtctcttctttttcaattcttgtagttatcatgcttgagaaacataaaaaaaatgtttgtacatgcgaactaaattcctttatatataaccatgcattaattactttaaaaaccaatataatataaacaaattatgtaagaaatgaaattttgtttgattttttattacttcgctagtttagtgagcggtttataggtgtgaattgtttaataactagtgaatggtttataggtgtgaaccgttcaataactctaataatcaacatgtagtgtcttactttcaaatctacgattcagtagaggtgacgatacacaccactcgagactcaagagtttattactcttttgaatgtagtaatttcataagattttcacaaaaaaatcgttcaattcttacgagtatacttcacaattaccacgcacgttctaaagaaccccttgaaggccatctgatcctaaatctcatttggccaacaatggagttggtgacctaatcgatcgtacatgaaacaacattacaatgaactgaagacaaaaatatgaaacaacattaaaatgcctagtacaacattacaatctaacaaaaagaaacatgaaaaacattggcttaaacattagaaattttaaacattaaaaaaactgtatcggctatatctgacttcctcctcccctccaatggttggatcgggctttcttcgacaacctcaaacgctgcaatgtgatgacccggtgattctttctataaatgaccttgacttccttgttgtcaactgcgatggcatgaccaccacttgctccgtccgctgcttctctacgataggtttccctcctcctcgctgtcgtcgttgtagttgtcctcccgttgccatcggcatcggctacccttatggtgacatgtcatcatcgccacatcaaagccttggtgggagatagagacagacacacagagagagagagagtagagtaatcaagtgcgcgataagggggagagatgtgagtgagacaagggagagagaaatgattgaatgagtggatgggaatgattggcaggaagccggtttttttctcctagatccagtgcccagcttggagcgttttcactagaactatacttttttatacttttttgggaaattgctaaaaaaactaatcacaatttcattttggtaaatgctttcaaatataactatggtatagttgtagtaactataatataattacactatacttacattgtaactacattgtaattacaatatacctacattctaatctctatataacttagctgtaaagttgcatatttttttaatctttacaagttacattgtagttatagtataattattgtagaattatagtacaactatactgcagttatatttgagagtttttcactttaaaaaattgtggtacctttttttagataatcccttttttatgcaaaacacactcctgaagatagaggaaggataatataacaagcgctaaaaagataaatatttctatatattggaagctagtatttgttttaactcctctcctagctatccatatgcagctggccaggggaatgaagagccgccggccgatgtaattgatgatgtaattgatctggtgagctttgaactgaattaaccaaactaccaatagttattagcttgaaactgtctcggcagctgcaggcaacagagagcgtgttgatatattcagcaattaactgcaatactgacattatcaacttcccttttaattagcatgggtgctagctcttgactaattaatcagacattcagacgttatattgccataacacacatggatgcctgaatatgcggagacgaaagggaccaagtatactttacatggatagagaagacatggtcaatctactcgttaacgtacattcacggttatttttgttacaacttgaatgtcatattaaacttgtattgtatatttgtaaagagatatattttaatttaatttaattatcttatcatttttttaaatcttcttgagagataaaaatccatctccctatctttatcataatatgagcctgttcactttgatgccattttctgataaagttgctaaaattttaactacgtttagtttgttgctaaatttttagtaagcacatataaaatcttgccaaaatttagcaaccttgttaaaattttagcaaacataccaaaatttagcaatgctaaaacttggtaaggttgaaaatggtagtaaagtgctctgtgtttctattcacctgataacaaagacagccaagacatcatcaatctaatgcatgcatcatgcatgacaggcactggaataatctaattaattaattagtcggccaacctagctgttgactgggaattaagatagcttgaatccatcaaattaaatagtttctttcccagatgcaatcattaagagttcaagaccagttcagacttctgaggagatgaacaagtcactagctagctcatccttttcttattgaccacttcagaatcatttcatgctcagaggcctatatatatggatgcttccatggacaaaagcatagactacagctatacaagaagcatcgaccactacttgtacacaagcaaaagttccatcaacttaacatggcctcctcgaacttctttcttctcacagctctcatcgctttggtcgctactcaggccatggcttctgatcccagtcctcttcaggacttctgcgttgccgacaggaactctccaggtagtgtacttcttcactgatcatgcagttacatcagattaacaatgatatgagatattcatgttgtacatatatatgtttctagctttcgatctgacctttgtatgttcttcaatgtagtacatgtcaatgggttcccttgcaaggatgctaaagatgtgaatgttgatgacttcttcctagcagctaacctcgacaagccgatggacacaaccaagagcaaggctggatccaatgttacattgatcaatgtgatgaaactcgcaggtctcaacacccttggcatctccatggcaaggatcgactatgctcctaaagggcaaaacccaccacacacgcatccccgtgctaccgagatcctaactgttcttgagggtacactctatgttggttttgttacatcgaaccaagcaaacggagaaaacaagctcttcaccaagacacttaacaagggtgatgtcttcgtgttcccacaaggtctcattcacttccagttcaatccaagctatgataagccagcagttgccatcgctgcacttagcagccagaaccctggagcgattaccattgctaatgcagtatttggatcaaattcaccaatctcggatgacgttcttgctaaggcatttcaggtggacaagaaagctgtggattggctccaagctcagttctgggagaacaaccataactaaattattgatgcttgataaggttcaaaactagtgattggtagtaaaaagagtttgttgattattatattagctaaatattgtatacttcatgtaatcctaaactcgatattttatatgattctttttatgaataatgtatatcagtacacatatatatttgtcacatgatgtatgatctggggtattaatttaatatcgttgatttcttgggtacttttttaacactcataaagatggataattaaaatcatattactggggaagcattgccctagctagttcagtacttatatttcttatgttgttcacaagctcatagcactcatccaaattaatctattctttctcaattatccctacatgcttgagaaagataacaaaaatgtttgtacatgcgaactaaattcctttatacatgaccattaattactttaaaaaccaacaaaatctaaacaaattatgtaagaaatgaaattttggttgactttttattgcttggctagcttagtgggcggtttatagatgtgaactgttcaataactagtaaacggtttataggtgtgaaccattcaataactccaataatcaacctgtagtgtcttactttcaaacctacgatttgctcaagactcaagagtttattactcctttgaatgtaggaatttcacactttacaattaccacgcacgtcctaaagaaccccttaaagaccatctgatcctgaatctcatttggccaacaacggagttggtgacctaatcgatcggacatgaaacgacattacaatgaactgaagacaaaaatatgaaacaacattaaaattcctagtacaacattacaatctaacaaaaagaaacataaaaaaaacattggcttaaacattagaaattttaaacattaaaaaaaatgtattggctatatatgacttcctcctcccctctaatggttggatcgggctttcttcgacaacctcaaacgctgcaatgtgatgacccggtgattctttccataaatgaccttgacttgttgtcagctacgatggcgtgaccaccacttgctccatctgctgctttgccacgatgggttgctctcctcctcgttgtcgtcgttgtagttgatcctcccgttgccatcggcgctagctgcccttatggggacgcgtcatcgctgcatcaaagcctcggtgggagacacacacacacacagagagagagagagagagagatagtagagtaagcgagtgcgcgataagggagagagatgcgagcgagacaagggagagagaaatacttgaatgagtggatgggaatgattggcggggagccggttttttctcccagatccaacgcccggcttgaagtgttttcactaaatctatattttggaaattgctaaaaaaaaactgtcgcaatttttttttggtaaaagctttcaaatataactatggcatagttgtagtataactataatataattacactatagttacattgtaactacattgtacttacaatatgcttacattctaatcttgatataacttagctataaagttgcatattttttaatccttacaagtcacattgtagttatagtataattattgtagaattaaattacaactatactacaattatatttgaaagttttttacttaaaaaaattgtggtactttttttttataatccctttttttatatacaaaacacactcctggagacacaggaagtataatataagaagcgctaaaaagataaatatttccatatagggtatgtttagcaaataggatatgggaggtcggattgggaaatggaaatagatgaatggctaggattaaataaagtgtgaagaatggatggctaagatgcaatgttgccttttggagggtgggatattatttctcaatcctatttgccaaacacagccatattggaagctagtatttgttttaactcctctcctagctatccatatgcatctggccaggagaatgaagagccggcggccgatgtaattgatgatgtaattgatctgttgagctttcaactgaattaaccaaagtaccattagttattagcttgaaactgtctcggcagctgtaggcaacagagagcgtgttgatatattcagcaattaactgcaatactgacattatcaacttcccttttaattagcatgtgtgctagctcttgactaattaatcagacattcagacgttatattcccgtaacacacatggatgcctgaatatgcagagacgaaagggaccaagtatattttacatggatagagaagacatggtcaatctactcggttcttagtaatagttaacgtacattcacggttatttttttacaacttataggtgtcgtatcaaacttgtatgtttgtaaagggatatattttaatttaatttaattgtcttatcatttttttaaaatcttcttgagagataaaattcatctccctatctttatcataatatgtttctctgcacctgataacagagccaggcaagacataataaatctaatgcatgcatcatgcatgacaggcactggaataatctaattaattaattagtcggccaacctagctgttgactgggaattaagatagattgaatccatcaaattaaatagtttctttcccagatgcaatctattaagagttcaagatcagttcagactttagaggagatgaaccagtcacaagctagctcagccttttgttattgaccacttcaaaatcatctcatgctcagaggcctatatatatggatgcatcatttccatgggcaaagcatcaactatagctatacaagaatcatcgaccactacttgtacacaagcaaaagttccatcaacttaacatggcctcctccaacttctttcttcccacagctctcatcgctttggtcgctactcaggccatggcttttgatcccagtcctcttcaggacttctgcgttgccgacaggaactctccaggtagtgtacttcttcactgatcatgcggttacatcagattaacaatgatccgagacattcatgttgtacatatatatgtttctagcttttgatctgacctttgtatgttcttcaatgcagtacgtgtcaatgggttcccctgcaaggatgctaaggatgtgaatgttgatgacttcttcctagaagctaacctcgacaagccgatggacacaaccaagagcaaggctggatccaatgttacattgatcaacgtgatgaaactcacaggtctcaacacccttggcatctccatggcaaggatcgactatgctcctaaagggcaaaacccaccacacacgcatccccgtgctaccgagatcctaacggtttttgagggtacactctatgtgggttttgttacatcgaaccaagcaaacggagaaaacaagctattcaccaagacacttaacaagggtgatgtcttcgtgttcccacaaggtctcattcacttccagttcaatccaagctatgataagccagcagttgccatcgctgcacttagcagccagaatcctggagcgattaccattgctaatgcagtatttggatcaaatccaccaatctcggatgatgttcttgctaaggcatttcaagtggataagaaggccgtggattggctccaagctcaattctgggagaacaaccacaactaaattattgatgcttgataaggctcaaaattagtgattgctagtaaaaatgttttgttgattgttgttagctaaatattgtatactgtataacactacgcatcaataatgtataacactacgcacatatatatgttacaagatgtatgatctatggaattactttaatatatttgatttcttggtactttttacactcgtaatgacgaagaattaaattcgtattactgggatgtattgccctcgctcagtgcttttgtgttgtcgctcacaagatcgtaacacattcaaattaatctattctttctcaattcctgtggttatcatctaaatttgaatgttgaaggaacatacaaaatttgtttataaataggaaccaaattcgtttatacataaccattaattactgacaagaacaaacaaaattgcaatatagtttccatacgacgacgacgccaagagacacgcctccgtggaccctgtattcgggcttcaagcgccttctcggcaaagggttatggaaattaatacttatggggttttaacagttttaacttaaaaaattgattttaactttagagagaatctaataaatgttattgacaagcaccatatttcaaaaaataccaatgtacaaatcaacttgtcacctactactaattaagcatggcaggcatgatctggaccatcggctgtggattaggcccatcaccaacgacgacatagataatctaccggagcaattgactttcatcatttggaagaatggtagtgccacagagaaccaacaaattaatcagttaatctgaacacttgacacttgcaggcactacaacaacaaagctcaacaccactagtacagaacagcatgtgtgtttcagtctaaaatactgcaaatctgcaatgcaactgaactgcttcagatagtagcatagtgctctgtacagatccagatggaaatgtagaactccgtgttatcacaaacaattactacattgtcttttcggacaactgtcttgcaaccctgtagaacatctatgccatctcccccataaggaatgtacaggagaacgaaaaaaatgcgatgacaaatgtatattaactgtatcctatagctatgacaatgatgagtttctagatggcgaatctatggcttcagcggtaaacgaaaacgcctggcaaggtttcctttgtatatcatacttgcatcaccagaaaaacttcacagaagaaattgtcatataaatcgcagatcacatactatttctcactgccatccttctcgtctaatgctccactaggcttctcagaccttactggaagaacgctccgccgctctttgccacctggtttcgctgatgcgttcccataccatatcatcccaacaacagcgaggatcatcccaaggactacctgaaaattcagaccttccttgccaaagaagagaaacccaagggacaacacgagcactgtcttcatgtggcccaggacttggaaggatacggcagaaaaccgaccaatgcagatgaattggctcagattaacaccaatggcaatgacacatgagagagtcaggaaaaactgcagaatgataaaaatgccatcgtaagataaaatggaaaatatgaggtcaaatacatacaaacaaatcaaacatgcactcaaattcatcaatattctaatcaagtacagtttacctatagattactaaaaagcaagacattgcacacaaaaggaaagctatagactatagttgtttgaagttacagataacgagcaatgctgtaaagtaaagacttctttggtcacaagatataacataatgctagtctaggccatttgataaacttgcaacattacagaatgtgaaccagcaaaatgccaaccagcagcaaatcaccattacacaactaaccaaactgcaaggcgaattacctatggaaaaactagaacatgtatatcagtgagatcagatacagagcattgtaaagaggcttgcctcttaccaaagcaatcgatgtgaaaccaaagtgatccacccttttgcctgtcaacaagaaatctacaaagggccccactagcagaagggatcctgcttgggctggagcagtgtgacccaggaggttgaatgagttcagagagtactttcgttggagaaaatgaacatactgcaaaggaaaatagaagagttaaaattgtattgtctatgcgtccaggtaaggaaaagaaattaaggtgctatttggctataacttaagaaatgacaaaatcaaacaatgattaaggagtgccaattattcataactaacaaggactacagggaaccaacaatgattcagggagtgccatctgccaattattcatcattcgtcaataagcagacccatagataagcagagtcattgttgtgccaccatgcaataatttctcccccgtaaaaatgtttatggttgccaaaggacagctataggaatagaaggcagtattatctcatagcagataaatgggacataaccatacaagtacaacataggttggtttaacttacatattgttgcaaagctgtgctccaaacagctataacagcagcagccagaccttttgcatttacactgacatcagtaactgtgcagaccgcaacacctataagcacaaccattatgctcagctttgtgtcccgagaataatgtacatgatcgaagacaacctccaggagacatgatgcaggtatcatgcagagctttgctatctgaagagaacaaaaggattctttagcttttgaaacttgaaagttcaaagccatgatggaatttagctagcagaaccatcctttgctaacctgataaaaccccacagagttccacatcaagctcacattcattccaacaatcgacaagttcgaaaagatcacaaatttaatcagatctggcagtggtaagtgggagggctggctgaggcctaaccaccgaaacacgatagtcatcaaggtggttgtcacaaaatgaaggccagttaaggttgtggctgcaaaacacagaacataatcagttacatggcatggcaggagataattccattatcatacaaatgaaacatgttgaggggcagcccataaatctggttggatataagaaatcagataagttacaatgctcccggtgttccattaaggtccttttcatgttcagaaggcagtgtggcaacttgtgacaaaaaaaaaagttctgatcataggctcatagcagctagaacagagtggctttgagagtccagaggatacctcatagctcatatttaactcgtgttagatcacaaaaaaagcaagcctatctggtgaacctttttggcatcattagattaggcatacaagttcagttaaagatttatcgatcgtctagaactcaaatgattggaatttgtgctagcattgcgaaaataaatgactgaaggtttacagatgcctgttagtcagttgatcaattgcatgtccaaaggaacaaacatctggagtctacaattactacacaagatctagtaatatttattcgttcaatattaaatcaaacaggatactgctagtttgtcattcagaacacggagtaagcctagaataaaacatcatcatcacaaaataaagaaccaagatatctgaaggtagcaagtaacacacacaccgaaactgaatccatgcgtagccatcagagccttgttgaccatgatgattccaacagacgtggtgatgttgaaactccatgccgcaaaatccagcaccttcttcttgtcggatttgctcagggaagaagccatttcgctcgaatttcctccagacttgaacaaatcaacacccaacacttggcacgggcgggcggacctaacaaaattttttgggagaaaaacaaagaacagcaagcattactaccaaggttatgacagagagaaaaagcagcttctagatctagaagagaaagaagatgaggtgcgggtagaacgagggagatgagagaagaagaggcaggggggaaggggggggacgtgggtaggggcgggtgcttaccggcggcagccaccgctgctcgccggatggagctcgtcggcggcggctggcgatggcgaggccgaggggccttttcgtttttgttttttttttcttttcttttcttattatttttgcagcgaaagccactctctcccagatctgcccctatgatgtctgagggctatttgtactatgtttggtttgaaattttgatggaaatttgattaaagagaaactggatcacaccacatgcgttgctgggaagtttatataaaaaaacaaatattttctctaggttgattatcttatcgtttttataaagacatgtctaaaaacaattttaaccactacttattattattataatatatataaaagtatgtgccaaatgcagcctcgatctgaagataagttattatgccctcctcctatgtgtgcaaagtcaatactcgctctgtcccaaaataaggctgtgtttgagggagaggggattgagaagattggaaagatacgcaaaacgaggtgagccattagcgcatgattaattgagtattaactattttaaacttcaaaaatggattaatatgttttttttaaaagcaaactttcatatataattttttttttcaaaaaacacatcgtttaatagtttgggaagcgtgcacgtagaaaacgaaacaaacaaactccctttgttctccaaacgaacgcagtcaaatgcagttttgcactgttcgcgtctaacgtttgaccgctcatcttatttaaaatttttctatgattagtatttttattgttagtgcatgataaaacataaataatactttatgtgtgactatttttttaatattttcataaatttttcaaataggatagatggtcaaacgttcaacacggattcccacaactgcacttattttgtgacggatgtagtactctttaagataaaccaccattgccaacttaaagttactatggggttgtttggtcctttaccttataatctttggtagcgccaaattttcactatattggcactaccaattctttggtagggtagagatacatggtacatatttgaattgctaccaattagtgccaaatgttaatgagcattatcaattatttggcttcatccaaacatacactatcactattcaagatgccaataaattgataagttcacatttttttggcttcaataaaaaatagccctattccttgagagcgaggagacagcagatggaagtt

SEQ ID NO: 38425 - DNA, 2404 bp, Oryza sativa
catgggcaccccctcagcccaaaacctggaaccccctcctctttcgtctggcccaaaacaaggcccatcgctgtgtatttattagagacagcccaactgagaggagaggaggaatcgcgcacgtggttggatcgacagttcgacacggcgtagcggcggcatcgtttcatctcccaaaatgaagcgcgtgattcggtgattgtttctttctcctcgtccgtcgccgctcctgctcgcctgctccgcgtgactccgcgaccggcgaccacgcctgacatctccgactacatcccgtcgtgcgcacgtcgccgttcgcccgcggaccgccacagcccgtgctcaacgcggcgaccgcccggcgctcgcctgccgacgccgcccgtttcccacgcactccggcgactccgcgacctatgacagccctaaatcctatcatccaatccaccactccgtaagtcatgtacccctgcttcttccctcttccaattttgctagtttaccactgatttaatcttaattttcttgcttgcttttgcgatgaacgcagccatgcagggcagtctgggcagtggcagcagcaagctggccggcaatggctggatccacgagctcgccggtttgccctcattgactcgtcaaatctgcctagtgaccacaagtgcttctatcaaaaatcacatccgatagccaccacttacagcaagtggtttatcggttcatgaatataaccaccgcaaatttgataaatatcaatagataactgtttttatttatgtcaaatcatttcatgacttattgtttgttgataactaaactatgcctctcttttttaaggtgattgttgcatggaggaatgaaaatggtgacatcacattttgcatgatatattcatttgttttgggtatggagcccatgacacattattaacttcatatatattattatcagttggtttcttcattatggtacgtattttttttaatttttccatgcactttttcatatattgttattaattagggagatgatacttatatgtattgggtatgcaactatttagtataatattgttgagctatacatgtcgatattaagcaaagaaagttaggaaccctctcgttttttctctagctccgcccagtgcctgtgcctgctcttgttctgtctattacttttgtaaatacgggaaggcaagacactaatgggtgggtgcatatggtaaaagagggcttcgcatcctctgccgttccaactgaaatggcatagagctacagtgtcaagccgttggggcatttatatctgttggataagttttggatgttcgagattaaacgctacagtaacgacgaaaataagcaaaaacattttttactgtagctacagttttcattgcatcagcagcatgttactgtagcttcctcacgtttcactgtgcgcctctgccgttctccccccaacggcacaggatgggaacccggtaaaagaggggtggttaacactgtgttggtctgcaataagcatgctgatgtagatagagatgtaatgtgacaagactagaggttaaatgcacatttcattcttctcttgtctaatatcaggaactgtgttgcctcgtccaaaccatctgagctttggtctgttttggtttgccttgcacctgtcccttactactttactgtacttaaacgcaatttgtattattagatggtgccagaattatttaaacgtagacttgtgataacatgccactgatggaatcatttcaggcttcagagcgcgtctatcatcatggcaaattttaaaatgggtaaacaccgattaattgaattttatgcccccaaaccaggcaaattaaagtgactgactgtattgaagttcaaaaattacatttcgttcgtaagattgcagctttgcatttcataaaatggttagcatcttgtccatttcacaaaacgtgctttgtcacgtttgcggcagagtctcagatgaagaatgcagtaatacattgcacgtaaaaggccagtaaacctagcgagacatggatgcactgataacttgatccactttcagaatgaaaagaaaaaaaaatcacggcgtttacataagcttcatttgctgtaccaatccagaaagaggacggaaaaggtaagaacaaagaagaaaagcaggaggaaggttctactgctgctgttgcgctggatcgcctgggatagctccttgttcccacgctccacattgtttgtagcttcaactgcctgagaagaaggcatatagcacaattggacctcccgagtcatcagttaaagatcttataccccctccattctataatataaggcacaaccacttttcttagatgtttcataatataaagcatgcatgcaagcatgcaattaactataac

SEQ ID NO: 38426 - DNA, 1189 bp, Oryza sativa
cagaaaagggaattttaatttaatgaagggaatgtgtggtccatggatcccaataaaaagatcagtggatgataatagatgacagacacatcatgtttatcagtacatcagcaaaggagtgtcatttatattttttccacgaatatctacatgtatgttcacataagaagacaatctacaagaaagaaataacagatacggtgtactggcttaaatagattttctacctggtcatataaatactgtatctgctgagcttgttgtagaacatgtgttgacatgagatgattaagtgctgacatctctatcatctttgtctctgtttcttggacagcatcaagaagatttgtcaactccacctaagatacgagtaaaaggatgcaaataattaatcatgcatgacaattcactagaatttcatcagcataatacatatacaccaaaatattacctgaagagctcttgtttcatcatccaagagttgttcttgaactcttagtggtgcagtagagacctcctgatcttcaacctttgaaacatcagattttaatacaaggtttggcttagatggttcagcagctttggtttctcgtttcttctgaatccgttttcttggcatcgctctgttaatagcatcttgaaaacgcatggtccgaagacgatcaaattgtgcagttactgagtgaagacgctcactcaaaatcaaaacctggtgaaattatatggaaaacacacagcttagcaaacatgaccatgtaatttgcataaattcgtactaagaaagcaacatggccatgtggttgcctatactagcagcactgaatcagaaaacaaaatttcacattgttcaaattcacctatttttacaggatggttgcagcatggctgttttgtcgtatctaatgtccaataatagcaataaactaaggtatggatatcctgctaccagctacccacatcatccaacttcatcaggacaataaatgctggacctgtcaattcttctatttaaaggataatactcagatttatctgtgtgttaaacaacttgtctcagtaaaagataattttgtgcaaggggagaagataaattatccacaaggagttgattagtttaaaatatatatatacaaattacaaactgtattaacaaataataatgcccggaatatctgtaaaatggaaaatg

SEQ ID NO: 38427 - DNA, 1949 bp, Oryza sativa
cattttgtattggaaattagcaaaatagttgatccatggcaagaataagaaggcataccacaccatgctggtgagctatcaaatccaaccgggagctctcatcgcttgtaccaagccatgtctttgtacttccacctttttcttcatggatcctgttctttaggatatctatttgttccttgcatgcttttacaaaaacactgacctagacagataaaaagttgagaagacatgcctaatccatagccgaaaattgccaaaaaaaaatgcacacattttaccagtatgaatatatcaggatgcgataatagtattagtaccaaagaaagatactccaatgcaatgtcaaacaaaccttagtattagattttcaataaactcatccaccatgttgcaaagtatatgttttaacatgattgcagtgtagtgttgatgtcctaatgtaaccccgtcggaaaagaaagagtagttcaacaaaattttcaatgaactcatccaccaggttgcagagtacgttttaacatgatagcaggttacggtagatgtccataatgctcgtaggaaaagaaagaataaaatcaacaagtaaccactattcacctcatgctcaatgttgtcccttcttgctccgtggtgcgatgcatgtcaacatagtccttcctatgcttcacaataaacttctccagttccctgatactctcaagctacacgaaaacaaaccataaatatagtagcaagctaccataccaaatcatcaccacagcattgcagcaaagacagaattcgtaccgtcttgattgcagcctttgtaaagggtaatttggggggcggcttccggatgatgaaagaagacatgagcgcggctaactgagactgtcagaaggaaatcaacacaagggtggatcaacaatattctttcaggcgatatctgtgatagcttccattccagcgaagatgggggagaatgccgcgcaatcgcgccgccgttgagctcacctccgtgtacccatggccgagcgcggcgacgcggacggactccttgaagtcctcggccctgtcgcgaaccctcgacatcgccaacgcagagtagcagctaacgcctacggcttcctcctgtcagatctcatctctccgcgcagcactgattcgcgagccggcgagaggggaagagaggagagctcgcctcctcgctttctccgcgtccaccttgaagcccaccctcggcgacggcgacggcgacggcgcaagggggaggcggcggcggcggtgcgagggggagacgagagggcggcggaagaaaatttcataggactgcggtcctttgctcctaggaaagactttgtctcctatgcgacacgtgtccaattggaatttcaaagcaaggcttccactacactattcacccaaatactattaactgacgccgccgttatagcatgtgtagtgcgtacctctaacttgtcaccccagagcacgccgtccatcgccatgagtttttccgcccgcgtcgtcccctcacgagtcgtcgcgcgccctggttgggggacgcggctctatctccttttcggccaggggacatgcgcgagggacacaatgcggggacgggcgccacaggcgacgatctctccagctaccatattccccttccacccctctcccctctctctctcgcgtgcccgttcccctcgagaatgtgggggtattttggaaacttttcacatgaggcttctttgggctaggatacgcactgtggattagagtacctttagccagtttcttcaaattttgaagagtccatctaagtgtggctttggtcacaagatgagtgcccttgagagtgccctcagttagtgaggacactctaggggtggctttggttgtacatgcccttatgtcctcctcttcttggcttggtcttcgtgggcagtgataggcatgaagcaccacgg
